United States Patent 9,675,668 (MODIFIED POLYNUCLEOTIDES ENCODING HEPATITIS A VIRUS CELLULAR RECEPTOR 2) - sequence listing, part 12

SEQ ID NO: 22955 - DNA, 927 bp, Artificial Sequence; identical to SEQ ID NO: 22954
  Description of Artificial Sequence: Synthetic coding sequence

SEQ ID NO: 22956 - DNA, 633 bp, Artificial Sequence
  Description of Artificial Sequence: Synthetic coding sequence
atgagctgcaccgtgtacgccaaggtggcccacaccatccacatgagcgccctgggcctgcccggctaccacctgcacgccgcctacgccggcgactggcagctgagccccaccgaggtgttccccaccgtggtgggcgacatggacagcagcggcagcctgaacgcccaggtgctgctgctgctggccgagagactgagagccaaggccgtgttccagacccagcaggccaagttcctgacctggcagttcgacggcgagtacagaggcgacgactacaccgccaccctgaccctggccggcaagtacagcgccgtgcactgggtggccaccctgaacgtgggcagcggcggcgcccacgccagctactaccacagagccaacgagcaggtgcaggtgggcgtggagttcgaggccaacaccagactgcaggacaccaccttcagcttcggctaccacctgaccctgccccaggccaacatggtgttcagaggcctggtggacagcaactggtgcgtgggcgccgtgctggagaagaagatgccccccctgcccgtgaccctggccctgggcgccttcctgaaccactggagaaacagattccactgcggcttcagcatcaccgtgggctag

SEQ ID NO: 22957 - DNA, 825 bp, Artificial Sequence
  Description of Artificial Sequence: Synthetic coding sequence
atgggcaacaccctgggcctggcccccatgggcaccctgcccagaagaagccccagaagagaggagcccctgcccaaccccggcagcttcgacgagctgcacagactgtgcaaggacgtgttccccgcccagatggagggcgtgaagctggtggtgaacaaggtgctgagcagccacttccaggtggcccacaccatccacatgagcgccctgggcctgcccggctaccacctgcacgccgcctacgccggcgactggcagctgagccccaccgagacccagcaggccaagttcctgacctggcagttcgacggcgagtacagaggcgacgactacaccgccaccctgaccctgggcaaccccgacctgatcggcgagagcgtgatcatggtggcccacttcctgcagagcctgacccacagactggtgctgggcggcgagctggtgtaccacagaagacccggcgaggagggcgccatcctgaccctggccggcaagtacagcgccgtgcactgggtggccaccctgaacgtgggcagcggcggcgcccacgccagctactaccacagagccaacgagcaggtgcaggtgggcgtggagttcgaggccaacaccagactgcaggacaccaccttcagcttcggctaccacctgaccctgccccaggccaacatggtgttcagaggcctggtggacagcaactggtgcgtgggcgccgtgctggagaagaagatgccccccctgcccgtgaccctggccctgggcgccttcctgaaccactggagaaacagattccactgcggcttcagcatcaccgtgggctag

SEQ ID NO: 22958 - DNA, 156 bp, Artificial Sequence
  Description of Artificial Sequence: Synthetic coding sequence
atgttcagaatcgagggcctggcccccaagctggaccccgaggagatgaagagaaagatgagagaggacgtgatcagcagcatcagaaacttcctgatctacgtggccctgctgagagtgacccccttcatcctgaagaagctggacagcatctag

SEQ ID NO: 22959 - DNA, 258 bp, Artificial Sequence
  Description of Artificial Sequence: Synthetic coding sequence
atgttcagaatcgagggcctggcccccaagctggaccccgaggagatgaagagaaagatgagagaggacgtgatcagcagcatcagaaacttcctgatctacgtggccctgctgagagtgagcgagtgcctgcccggctgcgactgcgagaccagcggcgagctgaccgacggccaccccctgaccctgagaggccacagaggcctgagaaccgagctgaacgcccccttcatcctgaagaagctggacagcatctag

SEQ ID NO: 22960 - DNA, 279 bp, Artificial Sequence
  Description of Artificial Sequence: Synthetic coding sequence
atgttcagaatcgagggcctggcccccaagctggaccccgaggagatgaagagaaagatgagagaggacgtgatcagcagcatcagaaacttcctgatctacgtggccctgctgagagtgagcgagtgcctgcccggctgcgactgcgagaccagcggcgagctgaccgacggccaccccctgaccctgagaggccacagaggcctgagaaccgagctgaacggcagcggcgagcagggcggctgcgccctgaaggccaccggcatctgcgccgtgtag

SEQ ID NO: 22961 - DNA, 225 bp, Artificial Sequence
  Description of Artificial Sequence: Synthetic coding sequence
atggccagcagcaccgtgcccgtgagcgccgccggcagcgccaacgagacccccgagatccccgacaacgtgggcgactggctgagaggcgtgtacagattcgccaccgacagaaacgacttcagaagaaacctgatcctgaacctgggcctgttcgccgccggcgtgtggctggccagaaacctgagcgacatcgacctgatggccccccagcccggcgtgtag

SEQ ID NO: 22962 - DNA, 225 bp, Artificial Sequence; identical to SEQ ID NO: 22961
  Description of Artificial Sequence: Synthetic coding sequence

SEQ ID NO: 22963 - DNA, 168 bp, Artificial Sequence
  Description of Artificial Sequence: Synthetic coding sequence
atggtgaagctgagcaaggaggccaagcagagactgcagcagctgttcaagggcagccagttcgccatcagatggggcttcatccccctggtgatctacctgggcttcaagagaggcgccgaccccggcatgcccgagcccaccgtgctgagcctgctgtggggctag

SEQ ID NO: 22964 - DNA, 1827 bp, Artificial Sequence
  Description of Artificial Sequence: Synthetic coding sequence
atggccgccagcaagcccgtggaggccgccgtggtggccgccgccgtgcccagcagcggcagcggcgtgggcggcggcggcaccgccggccccggcaccggcggcctgcccagatggcagctggccctggccgtgggcgcccccctgctgctgggcgccggcgccatctacctgtggagcagacagcagagaagaagagaggccagaggcagaggcgacgccagcggcctgaagagaaacagcgagagaaagacccccgagggcagagccagccccgcccccggcagcggccaccccgagggccccggcgcccacctggacatgaacagcctggacagagcccaggccgccaagaacaagggcaacaagtacttcaaggccggcaagtacgagcaggccatccagtgctacaccgaggccatcagcctgtgccccaccgagaagaacgtggacctgagcaccttctaccagaacagagccgccgccttcgagcagctgcagaagtggaaggaggtggcccaggactgcaccaaggccgtggagctgaaccccaagtacgtgaaggccctgttcagaagagccaaggcccacgagaagctggacaacaagaaggagtgcctggaggacgtgaccgccgtgtgcatcctggagggcttccagaaccagcagagcatgctgctggccgacaaggtgctgaagctgctgggcaaggagaaggccaaggagaagtacaagaacagagagcccctgatgcccagcccccagttcatcaagagctacttcagcagcttcaccgacgacatcatcagccagcccatgctgaagggcgagaagagcgacgaggacaaggacaaggagggcgaggccctggaggtgaaggagaacagcggctacctgaaggccaagcagtacatggaggaggagaactacgacaagatcatcagcgagtgcagcaaggagatcgacgccgagggcaagtacatggccgaggccctgctgctgagagccaccttctacctgctgatcggcaacgccaacgccgccaagcccgacctggacaaggtgatcagcctgaaggaggccaacgtgaagctgagagccaacgccctgatcaagagaggcagcatgtacatgcagcagcagcagcccctgctgagcacccaggacttcaacatggccgccgacatcgacccccagaacgccgacgtgtaccaccacagaggccagctgaagatcctgctggaccaggtggaggaggccgtggccgacttcgacgagtgcatcagactgagacccgagagcgccctggcccaggcccagaagtgcttcgccctgtacagacaggcctacaccggcaacaacagcagccagatccaggccgccatgaagggcttcgaggaggtgatcaagaagttccccagatgcgccgagggctacgccctgtacgcccaggccctgaccgaccagcagcagttcggcaaggccgacgagatgtacgacaagtgcatcgacctggagcccgacaacgccaccacctacgtgcacaagggcctgctgcagctgcagtggaagcaggacctggacagaggcctggagctgatcagcaaggccatcgagatcgacaacaagtgcgacttcgcctacgagaccatgggcaccatcgaggtgcagagaggcaacatggagaaggccatcgacatgttcaacaaggccatcaacctggccaagagcgagatggagatggcccacctgtacagcctgtgcgacgccgcccacgcccagaccgaggtggccaagaagtacggcctgaagccccccaccctgtag

SEQ ID NO: 22965 - DNA, 1506 bp, Artificial Sequence
  Description of Artificial Sequence: Synthetic coding sequence
atgaacagcctggacagagcccaggccgccaagaacaagggcaacaagtacttcaaggccggcaagtacgagcaggccatccagtgctacaccgaggccatcagcctgtgccccaccgagaagaacgtggacctgagcaccttctaccagaacagagccgccgccttcgagcagctgcagaagtggaaggaggtggcccaggactgcaccaaggccgtggagctgaaccccaagtacgtgaaggccctgttcagaagagccaaggcccacgagaagctggacaacaagaaggagtgcctggaggacgtgaccgccgtgtgcatcctggagggcttccagaaccagcagagcatgctgctggccgacaaggtgctgaagctgctgggcaaggagaaggccaaggagaagtacaagaacagagagcccctgatgcccagcccccagttcatcaagagctacttcagcagcttcaccgacgacatcatcagccagcccatgctgaagggcgagaagagcgacgaggacaaggacaaggagggcgaggccctggaggtgaaggagaacagcggctacctgaaggccaagcagtacatggaggaggagaactacgacaagatcatcagcgagtgcagcaaggagatcgacgccgagggcaagtacatggccgaggccctgctgctgagagccaccttctacctgctgatcggcaacgccaacgccgccaagcccgacctggacaaggtgatcagcctgaaggaggccaacgtgaagctgagagccaacgccctgatcaagagaggcagcatgtacatgcagcagcagcagcccctgctgagcacccaggacttcaacatggccgccgacatcgacccccagaacgccgacgtgtaccaccacagaggccagctgaagatcctgctggaccaggtggaggaggccgtggccgacttcgacgagtgcatcagactgagacccgagagcgccctggcccaggcccagaagtgcttcgccctgtacagacaggcctacaccggcaacaacagcagccagatccaggccgccatgaagggcttcgaggaggtgatcaagaagttccccagatgcgccgagggctacgccctgtacgcccaggccctgaccgaccagcagcagttcggcaaggccgacgagatgtacgacaagtgcatcgacctggagcccgacaacgccaccacctacgtgcacaagggcctgctgcagctgcagtggaagcaggacctggacagaggcctggagctgatcagcaaggccatcgagatcgacaacaagtgcgacttcgcctacgagaccatgggcaccatcgaggtgcagagaggcaacatggagaaggccatcgacatgttcaacaaggccatcaacctggccaagagcgagatggagatggcccacctgtacagcctgtgcgacgccgcccacgcccagaccgaggtggccaagaagtacggcctgaagccccccaccctgtag

SEQ ID NO: 22966 - DNA, 1125 bp, Artificial Sequence
  Description of Artificial Sequence: Synthetic coding sequence
atggccatcagaaagaagagcaccaagagcccccccgtgctgagccacgagttcgtgctgcagaaccacgccgacatcgtgagctgcgtggccatggtgttcctgctgggcctgatgttcgagatcaccgccaaggccagcatcatcttcgtgaccctgcagtacaacgtgaccctgcccgccaccgaggagcaggccaccgagagcgtgagcctgtactactacggcatcaaggacctggccaccgtgttcttctacatgctggtggccatcatcatccacgccgtgatccaggagtacatgctggacaagatcaacagaagaatgcacttcagcaagaccaagcacagcaagttcaacgagagcggccagctgagcgccttctacctgttcgcctgcgtgtggggcaccttcatcctgatcagcgagaactacatcagcgaccccaccatcctgtggagagcctacccccacaacctgatgaccttccagatgaagttcttctacatcagccagctggcctactggctgcacgccttccccgagctgtacttccagaagaccaagaaggaggacatccccagacagctggtgtacatcggcctgtacctgttccacatcgccggcgcctacctgctgaacctgaaccacctgggcctggtgctgctggtgctgcactacttcgtggagttcctgttccacatcagcagactgttctacttcagcaacgagaagtaccagaagggcttcagcctgtgggccgtgctgttcgtgctgggcagactgctgaccctgatcctgagcgtgctgaccgtgggcttcggcctggccagagccgagaaccagaagctggacttcagcaccggcaacttcaacgtgctggccgtgagaatcgccgtgctggccagcatctgcgtgacccaggccttcatgatgtggaagttcatcaacttccagctgagaagatggagagagcacagcgccttccaggcccccgccgtgaagaagaagcccaccgtgaccaagggcagaagcagcaagaagggcaccgagaacggcgtgaacggcaccctgaccagcaacgtggccgacagccccagaaacaagaaggagaagagcagctag

SEQ ID NO: 22967 - DNA, 1032 bp, Artificial Sequence
  Description of Artificial Sequence: Synthetic coding sequence
atggtgttcctgctgggcctgatgttcgagatcaccgccaaggccagcatcatcttcgtgaccctgcagtacaacgtgaccctgcccgccaccgaggagcaggccaccgagagcgtgagcctgtactactacggcatcaaggacctggccaccgtgttcttctacatgctggtggccatcatcatccacgccgtgatccaggagtacatgctggacaagatcaacagaagaatgcacttcagcaagaccaagcacagcaagttcaacgagagcggccagctgagcgccttctacctgttcgcctgcgtgtggggcaccttcatcctgatcagcgagaactacatcagcgaccccaccatcctgtggagagcctacccccacaacctgatgaccttccagatgaagttcttctacatcagccagctggcctactggctgcacgccttccccgagctgtacttccagaagaccaagaaggaggacatccccagacagctggtgtacatcggcctgtacctgttccacatcgccggcgcctacctgctgaacctgaaccacctgggcctggtgctgctggtgctgcactacttcgtggagttcctgttccacatcagcagactgttctacttcagcaacgagaagtaccagaagggcttcagcctgtgggccgtgctgttcgtgctgggcagactgctgaccctgatcctgagcgtgctgaccgtgggcttcggcctggccagagccgagaaccagaagctggacttcagcaccggcaacttcaacgtgctggccgtgagaatcgccgtgctggccagcatctgcgtgacccaggccttcatgatgtggaagttcatcaacttccagctgagaagatggagagagcacagcgccttccaggcccccgccgtgaagaagaagcccaccgtgaccaagggcagaagcagcaagaagggcaccgagaacggcgtgaacggcaccctgaccagcaacgtggccgacagccccagaaacaagaaggagaagagcagctag

SEQ ID NO: 22968 - DNA, 1110 bp, Artificial Sequence
  Description of Artificial Sequence: Synthetic coding sequence
atgggcctgagaaagaagagcaccaagaacccccccgtgctgagccaggagttcatcctgcagaaccacgccgacatcgtgagctgcgtgggcatgttcttcctgctgggcctggtgttcgagggcaccgccgaggccagcatcgtgttcctgaccctgcagcacagcgtggccgtgcccgccgccgaggagcaggccaccggcagcaagagcctgtactactacggcgtgaaggacctggccaccgtgttcttctacatgctggtggccatcatcatccacgccaccatccaggagtacgtgctggacaagatcaacaagagaatgcagttcaccaaggccaagcagaacaagttcaacgagagcggccagttcagcgtgttctacttcttcagctgcatctggggcaccttcatcctgatcagcgagaactgcctgagcgaccccaccctgatctggaaggccagaccccacagcatgatgaccttccagatgaagttcttctacatcagccagctggcctactggttccacgccttccccgagctgtacttccagaagaccaagaagcaggacatccccagacagctggtgtacatcggcctgcacctgttccacatcaccggcgcctacctgctgtacctgaaccacctgggcctgctgctgctggtgctgcactacttcgtggagctgctgagccacatgtgcggcctgttctacttcagcgacgagaagtaccagaagggcatcagcctgtgggccatcgtgttcatcctgggcagactggtgaccctgatcgtgagcgtgctgaccgtgggcttccacctggccggcagccagaacagaaaccccgacgccctgaccggcaacgtgaacgtgctggccgccaagatcgccgtgctgagcagcagctgcaccatccaggcctacgtgacctggaacctgatcaccctgtggctgcagagatgggtggaggacagcaacatccaggccagctgcatgaagaagaagagaagcagaagcagcaagaagagaaccgagaacggcgtgggcgtggagaccagcaacagagtggactgcccccccaagagaaaggagaagagcagctag

SEQ ID NO: 22969 - DNA, 1113 bp, Artificial Sequence
  Description of Artificial Sequence: Synthetic coding sequence
atggccttcagaagaagaaccaagagctaccccctgttcagccaggagttcgtgatccacaaccacgccgacatcggcttctgcctggtgctgtgcgtgctgatcggcctgatgttcgaggtgaccgccaagaccgccttcctgttcatcctgccccagtacaacatcagcgtgcccaccgccgacagcgagaccgtgcactaccactacggccccaaggacctggtgaccatcctgttctacatcttcatcaccatcatcctgcacgccgtggtgcaggagtacatcctggacaagatcagcaagagactgcacctgagcaaggtgaagcacagcaagttcaacgagagcggccagctggtggtgttccacttcaccagcgtgatctggtgcttctacgtggtggtgaccgagggctacctgaccaaccccagaagcctgtgggaggactacccccacgtgcacctgcccttccaggtgaagttcttctacctgtgccagctggcctactggctgcacgccctgcccgagctgtacttccagaaggtgagaaaggaggagatccccagacagctgcagtacatctgcctgtacctggtgcacatcgccggcgcctacctgctgaacctgagcagactgggcctgatcctgctgctgctgcagtacagcaccgagttcctgttccacaccgccagactgttctacttcgccgacgagaacaacgagaagctgttcagcgcctgggccgccgtgttcggcgtgaccagactgttcatcctgaccctggccgtgctggccatcggcttcggcctggccagaatggagaaccaggccttcgaccccgagaagggcaacttcaacaccctgttctgcagactgtgcgtgctgctgctggtgtgcgccgcccaggcctggctgatgtggagattcatccacagccagctgagacactggagagagtactggaacgagcagagcgccaagagaagagtgcccgccacccccagactgcccgccagactgatcaagagagagagcggctaccacgagaacggcgtggtgaaggccgagaacggcaccagccccagaaccaagaagctgaagagcccctag

SEQ ID NO: 22970 - DNA, 513 bp, Artificial Sequence
  Description of Artificial Sequence: Synthetic coding sequence
atgagactgcagggcgccatcttcgtgctgctgccccacctgggccccatcctggtgtggctgttcaccagagaccacatgagcggctggtgcgagggccccagaatgctgagctggtgccccttctacaaggtgctgctgctggtgcagaccgccatctacagcgtggtgggctacgccagctacctggtgtggaaggacctgggcggcggcctgggctggcccctggccctgcccctgggcctgtacgccgtgcagctgaccatcagctggaccgtgctggtgctgttcttcaccgtgcacaaccccggcctggccctgctgcacctgctgctgctgtacggcctggtggtgagcaccgccctgatctggcaccccatcaacaagctggccgccctgctgctgctgccctacctggcctggctgaccgtgaccagcgccctgacctaccacctgtggagagacagcctgtgccccgtgcaccagccccagcccaccgagaagagcgactag

SEQ ID NO: 22971 - DNA, 513 bp, Artificial Sequence; identical to SEQ ID NO: 22970
  Description of Artificial Sequence: Synthetic coding sequence

SEQ ID NO: 22972 - DNA, 1047 bp, Artificial Sequence
  Description of Artificial Sequence: Synthetic coding sequence
atgagactgggcctgctgagcgtggccctgctgttcgtgggcagcagccacctgtacagcgaccactacagccccagcggcagacacagactgggccccagccccgagcccgccgccagcagccagcaggccgaggccgtgagaaagagactgagaagaagaagagagggcggcgcccacgccgaggactgcggcaccgcccccctgaaggacgtgctgcagggcagcagaatcatcggcggcaccgaggcccaggccggcgcctggccctgggtggtgagcctgcagatcaagtacggcagagtgctggtgcacgtgtgcggcggcaccctggtgagagagagatgggtgctgaccgccgcccactgcaccaaggacgccagcgaccccctgatgtggaccgccgtgatcggcaccaacaacatccacggcagatacccccacaccaagaagatcaagatcaaggccatcatcatccaccccaacttcatcctggagagctacgtgaacgacatcgccctgttccacctgaagaaggccgtgagatacaacgactacatccagcccatctgcctgcccttcgacgtgttccagatcctggacggcaacaccaagtgcttcatcagcggctggggcagaaccaaggaggagggcaacgccaccaacatcctgcaggacgccgaggtgcactacatcagcagagagatgtgcaacagcgagagaagctacggcggcatcatccccaacaccagcttctgcgccggcgacgaggacggcgccttcgacacctgcagaggcgacagcggcggccccctgatgtgctacctgcccgagtacaagagattcttcgtgatgggcatcaccagctacggccacggctgcggcagaagaggcttccccggcgtgtacatcggccccagcttctaccagaagtggctgaccgagcacttcttccacgccagcacccagggcatcctgaccatcaacatcctgagaggccagatcctgatcgccctgtgcttcgtgatcctgctggccaccacctag

SEQ ID NO: 22973 - DNA, 606 bp, Artificial Sequence
  Description of Artificial Sequence: Synthetic coding sequence
atgggcagcagaaagtgcggcggctgcctgagctgcctgctgatccccctggccctgtggagcatcatcgtgaacatcctgctgtacttccccaacggccagaccagctacgccagcagcaacaagctgaccaactacgtgtggtacttcgagggcatctgcttcagcggcatcatgatgctgatcgtgaccaccgtgctgctggtgctggagaacaacaacaactacaagtgctgccagagcgagaactgcagcaagaagtacgtgaccctgctgagcatcatcttcagcagcctgggcatcgccttcagcggctactgcctggtgatcagcgccctgggcctggtgcagggcccctactgcagaaccctggacggctgggagtacgccttcgagggcaccgccggcagattcctgaccgacagcagcatctggatccagtgcctggagcccgcccacgtggtggagtggaacatcatcctgttcagcatcctgatcaccctgagcggcctgcaggtgatcatctgcctgatcagagtggtgatgcagctgagcaagatcctgtgcggcagctacagcgtgatcttccagcccggcatcatctag

SEQ ID NO: 22974 - DNA, 606 bp, Artificial Sequence; identical to SEQ ID NO: 22973
  Description of Artificial Sequence: Synthetic coding sequence

SEQ ID NO: 22975 - DNA, 480 bp, Artificial Sequence
  Description of Artificial Sequence: Synthetic coding sequence
atgggcagcagaaagtgcggcggctgcctgagctgcctgctgatccccctggccctgtggagcatcatcgtgaacatcctgctgtacttccccaacggccagaccagctacgccagcagcaacaagctgaccaactacgtgtggtacttcgagggcatctgcttcagcggcatcatgatgctgatcgtgaccaccgtgctgctggtgctggagaacaacaacaactacaagtgctgccagagcgagaactgcagcaagaagtacgtgaccctgctgagcatcatcttcagcagcctgggcatcgccttcagcggctactgcctggtgatcagcgccctgggcctggtgcagggcccctactgcagaaccctggacggctgggagtacgccttcgagggcaccgccggcagattcctgaccgacagcagcatctggatccagtgcctggagcccgcccacgtggtggagtggaacatctag

SEQ ID NO: 22976 - DNA, 630 bp, Artificial Sequence
  Description of Artificial Sequence: Synthetic coding sequence
atggtgagcagcccctgcacccaggccagcagcagaacctgcagcagaatcctgggcctgagcctgggcaccgccgccctgttcgccgccggcgccaacgtggccctgctgctgcccaactgggacgtgacctacctgctgagaggcctgctgggcagacacgccatgctgggcaccggcctgtggggcggcggcctgatggtgctgaccgccgccatcctgatcagcctgatgggctggagatacggctgcttcagcaagagcggcctgtgcagaagcgtgctgaccgccctgctgagcggcggcctggccctgctgggcgccctgatctgcttcgtgaccagcggcgtggccctgaaggacggccccttctgcatgttcgacgtgagcagcttcaaccagacccaggcctggaagtacggctaccccttcaaggacctgcacagcagaaactacctgtacgacagaagcctgtggaacagcgtgtgcctggagcccagcgccgccgtggtgtggcacgtgagcctgttcagcgccctgctgtgcatcagcctgctgcagctgctgctggtggtggtgcacgtgatcaacagcctgctgggcctgttctgcagcctgtgcgagaagtag

SEQ ID NO: 22977 - DNA, 630 bp, Artificial Sequence; identical to SEQ ID NO: 22976
  Description of Artificial Sequence: Synthetic coding sequence

SEQ ID NO: 22978 - DNA, 552 bp, Artificial Sequence
  Description of Artificial Sequence: Synthetic coding sequence
atggtgagcagcccctgcacccaggccagcagcagaacctgcagcagaatcctgggcctgagcctgggcaccgccgccctgttcgccgccggcgccaacgtggccctgctgctgcccaactgggacgtgacctacctgctgagaggcctgctgggcagacacgccatgctgggcaccggcctgtggggcggcggcctgatggtgctgaccgccctgctgagcggcggcctggccctgctgggcgccctgatctgcttcgtgaccagcggcgtggccctgaaggacggccccttctgcatgttcgacgtgagcagcttcaaccagacccaggcctggaagtacggctaccccttcaaggacctgcacagcagaaactacctgtacgacagaagcctgtggaacagcgtgtgcctggagcccagcgccgccgtggtgtggcacgtgagcctgttcagcgccctgctgtgcatcagcctgctgcagctgctgctggtggtggtgcacgtgatcaacagcctgctgggcctgttctgcagcctgtgcgagaagtag

SEQ ID NO: 22979 - DNA, 690 bp, Artificial Sequence
  Description of Artificial Sequence: Synthetic coding sequence
atgacctgctgcgagggctggaccagctgcaacggcttcagcctgctggtgctgctgctgctgggcgtggtgctgaacgccatccccctgatcgtgagcctggtggaggaggaccagttcagccagaaccccatcagctgcttcgagtggtggttccccggcatcatcggcgccggcctgatggccatccccgccaccaccatgagcctgaccgccagaaagagagcctgctgcaacaacagaaccggcatgttcctgagcagcctgttcagcgtgatcaccgtgatcggcgccctgtactgcatgctgatcagcatccaggccctgctgaagggccccctgatgtgcaacagccccagcaacagcaacgccaactgcgagttcagcctgaagaacatcagcgacatccaccccgagagcttcaacctgcagtggttcttcaacgacagctgcgccccccccaccggcttcaacaagcccaccagcaacgacaccatggccagcggctggagagccagcagcttccacttcgacagcgaggagaacaagcacagactgatccacttcagcgtgttcctgggcctgctgctggtgggcatcctggaggtgctgttcggcctgagccagatcgtgatcggcttcctgggctgcctgtgcggcgtgagcaagagaagaagccagatcgtgtag

SEQ ID NO: 22980 - DNA, 45 bp, Artificial Sequence
  Description of Artificial Sequence: Synthetic coding sequence
atgacctgctgcgagggctggaccagctgcaacggcttcagctag

SEQ ID NO: 22981 - DNA, 1821 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagcatggtgctggtgttcctgctggtgggcttcgtggccgtgatcctgatgagagtgctgagaaacgacctggccagatacaacctggacgaggagaccaccagcgccggcagcggcgacgacttcgaccagggcgacaacggctggaagatcatccacaccgacgtgttcagattccccccctacagaggcctgctgtgcgccgtgctgggcgtgggcgcccagttcctggccctgggcaccggcatcatcgtgatggccctgctgggcatgttcaacgtgcacagacacggcgccatcaacagcgccgccatcctgctgtacgccctgacctgctgcatcagcggctacgtgagcagccacttctacagacagatcggcggcgagagatgggtgtggaacatcatcctgaccaccagcctgttcagcgtgcccttcttcctgacctggagcgtggtgaacagcgtgcactgggccaacggcagcacccaggccctgcccgccaccaccatcctgctgctgctgaccgtgtggctgctggtgggcttccccctgaccgtgatcggcggcatcttcggcaagaacaacgccagccccttcgacgccccctgcagaaccaagaacatcgccagagagatccccccccagccctggtacaagagcaccgtgatccacatgaccgtgggcggcttcctgcccttcagcgccatcagcgtggagctgtactacatcttcgccaccgtgtggggcagagagcagtacaccctgtacggcatcctgttcttcgtgttcgccatcctgctgagcgtgggcgcctgcatcagcatcgccctgacctacttccagctgagcggcgaggactacagatggtggtggagaagcgtgctgagcgtgggcagcaccggcctgttcatcttcctgtacagcgtgttctactacgccagaagaagcaacatgagcggcgccgtgcagaccgtggagttcttcggctacagcctgctgaccggctacgtgttcttcctgatgctgggcaccatcagcttcttcagcagcctgaagttcatcagatacatctacgtgaacctgaagatggactag

SEQ ID NO: 22982 - DNA, 1470 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagcatggtgctggtgttcctgctggtgggcttcgtggccgtgatcctgatgagagtgctgagaaacgacctggccagatacaacctggacgaggagaccaccagcgccggcagcggcgacgacttcgaccagggcgacaacggctggaagatcatccacaccgacgtgttcagattccccccctacagaggcctgctgtgcgccgtgctgggcgtgggcgcccagttcctggccctgggcaccggcatcatcgtgatggccctgctgggcatgttcaacgtgcacagacacggcgccatcaacagcgccgccatcctgctgtacgccctgacctgctgcatcagcggctacgtgagcagccacttctacagacagatcggcggcgagagatgggtgtggaacatcatcctgaccaccagcctgttcagcgtgcccttcttcctgacctggagcgtggtgaacagcgtgcactgggccaacggcagcacccaggccctgcccgccaccaccatcctgctgctgctgaccgtgtggctgctggtgggcttccccctgaccgtgatcggcggcatcttcggcaagaacaacgccagccccttcgacgccccctgcagaaccaagaacatcgccagagagatccccccccagccctggtacaagagcaccgtgatccacatgaccgtgggcggcttcctgcccttcagatacccccccttcatcccctggctgctgctgagcggcagctag

SEQ ID NO: 22983 - DNA, 729 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagctag

SEQ ID NO: 22984 - DNA, 633 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagtag

SEQ ID NO: 22985 - DNA, 906 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagcatggtgctggtgttcctgctggtgggcttcgtggccgtgatcctgatgagagtgctgagaaacgacctggccagatacaacctggacgaggagaccaccagcgccggcagcggcgacgacttcgaccagggcgacaacggctggaagatcatccacaccgacgtgttcagattcccctag

SEQ ID NO: 22986 - DNA, 774 bp, Artificial Sequence
  Description of Artificial Sequence: Synthetic coding sequence
atgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagcatggtgctggtgttcctgctggtgggcttcgtggccgtgatcctgtag

SEQ ID NO: 22987 - DNA, 2448 bp, Artificial Sequence
  Description of Artificial Sequence: Synthetic coding sequence
atgagcggcctgggcagactgttcggcaagggcaagaaggagaagggccccacccccgaggaggccatccagaagctgaaggagaccgagaagatcctgatcaagaagcaggagttcctggagcagaagatccagcaggagctgcagaccgccaagaagtacggcaccaagaacaagagagccgccctgcaggccctgagaagaaagaagagattcgagcagcagctggcccagaccgacggcaccctgagcaccctggagttccagagagaggccatcgagaacgccaccaccaacgccgaggtgctgagaaccatggagctggccgcccagagcatgaagaaggcctaccaggacatggacatcgacaaggtggacgagctgatgaccgacatcaccgagcagcaggaggtggcccagcagatcagcgacgccatcagcagacccatgggcttcggcgacgacgtggacgaggacgagctgctggaggagctggaggagctggagcaggaggagctggcccaggagctgctgaacgtgggcgacaaggaggaggagcccagcgtgaagctgcccagcgtgcccagcacccacctgcccgccggccccggcagcaccgccctgagaatgaccgtggtgggcaaccccagaagctggagctgccagtggctgcccatcctgatcctgctgctgggcaccggccacggccccggcgtggagggcgtgacccactacaaggccggcgaccccgtgatcctgtacgtgaacaaggtgggcccctaccacaacccccaggagacctaccactactaccagctgcccgtgtgctgccccgagaagatcagacacaagagcctgagcctgggcgaggtgctggacggcgacagaatggccgagagcctgtacgagatcagattcagagagaacgtggagaagagaatcctgtgccacatgcagctgagcagcgcccaggtggagcagctgagacaggccatcgaggagctgtactacttcgagttcgtggtggacgacctgcccatcagaggcttcgtgggctacatggaggagagcggcttcctgccccacagccacaagatcggcctgtggacccacctggacttccacctggagttccacggcgacagaatcatcttcgccaacgtgagcgtgagagacgtgaagccccacagcctggacggcctgagacccgacgagttcctgggcctgacccacacctacagcgtgagatggagcgagaccagcgtggagagaagaagcgacagaagaagaggcgacgacggcggcttcttccccagaaccctggagatccactggctgagcatcatcaacagcatggtgctggtgttcctgctggtgggcttcgtggccgtgatcctgatgagagtgctgagaaacgacctggccagatacaacctggacgaggagaccaccagcgccggcagcggcgacgacttcgaccagggcgacaacggctggaagatcatccacaccgacgtgttcagattccccccctacagaggcctgctgtgcgccgtgctgggcgtgggcgcccagttcctggccctgggcaccggcatcatcgtgatggccctgctgggcatgttcaacgtgcacagacacggcgccatcaacagcgccgccatcctgctgtacgccctgacctgctgcatcagcggctacgtgagcagccacttctacagacagatcggcggcgagagatgggtgtggaacatcatcctgaccaccagcctgttcagcgtgcccttcttcctgacctggagcgtggtgaacagcgtgcactgggccaacggcagcacccaggccctgcccgccaccaccatcctgctgctgctgaccgtgtggctgctggtgggcttccccctgaccgtgatcggcggcatcttcggcaagaacaacgccagccccttcgacgccccctgcagaaccaagaacatcgccagagagatccccccccagccctggtacaagagcaccgtgatccacatgaccgtgggcggcttcctgcccttcagcgccatcagcgtggagctgtactacatcttcgccaccgtgtggggcagagagcagtacaccctgtacggcatcctgttcttcgtgttcgccatcctgctgagcgtgggcgcctgcatcagcatcgccctgacctacttccagctgagcggcgaggactacagatggtggtggagaagcgtgctgagcgtgggcagcaccggcctgttcatcttcctgtacagcgtgttctactacgccagaagaagcaacatgagcggcgccgtgcagaccgtggagttcttcggctacagcctgctgaccggctacgtgttcttcctgatgctgggcaccatcagcttcttcagcagcctgaagttcatcagatacatctacgtgaacctgaagatggactag

SEQ ID NO: 22988 - DNA, 2448 bp, Artificial Sequence; identical to SEQ ID NO: 22987
  Description of Artificial Sequence: Synthetic coding sequence

SEQ ID NO: 22989 - DNA, 1992 bp, Artificial Sequence
  Description of Artificial Sequence: Synthetic coding sequence
atgagcgccagactgcccgtgctgagcccccccagatggcccagactgctgctgctgagcctgctgctgctgggcgccgtgcccggccccagaagaagcggcgccttctacctgcccggcctggcccccgtgaacttctgcgacgaggagaagaagagcgacgagtgcaaggccgagatcgagctgttcgtgaacagactggacagcgtggagagcgtgctgccctacgagtacaccgccttcgacttctgccaggccagcgagggcaagagacccagcgagaacctgggccaggtgctgttcggcgagagaatcgagcccagcccctacaagttcaccttcaacaagaaggagacctgcaagctggtgtgcaccaagacctaccacaccgagaaggccgaggacaagcagaagctggagttcctgaagaagagcatgctgctgaactaccagcaccactggatcgtggacaacatgcccgtgacctggtgctacgacgtggaggacggccagagattctgcaaccccggcttccccatcggctgctacatcaccgacaagggccacgccaaggacgcctgcgtgatcagcagcgacttccacgagagagacaccttctacatcttcaaccacgtggacatcaagatctactaccacgtggtggagaccggcagcatgggcgccagactggtggccgccaagctggagcccaagagcttcaagcacacccacatcgacaagcccgactgcagcggcccccccatggacatcagcaacaaggccagcggcgagatcaagatcgcctacacctacagcgtgagcttcgaggaggacgacaagatcagatgggccagcagatgggactacatcctggagagcatgccccacacccacatccagtggttcagcatcatgaacagcctggtgatcgtgctgttcctgagcggcatggtggccatgatcatgctgagaaccctgcacaaggacatcgccagatacaaccagatggacagcaccgaggacgcccaggaggagttcggctggaagctggtgcacggcgacatcttcagaccccccagaaagggcatgctgctgagcgtgttcctgggcagcggcacccagatcctgatcatgaccttcgtgaccctgttcttcgcctgcctgggcttcctgagccccgccaacagaggcgccctgatgacctgcgccgtggtgctgtgggtgctgctgggcacccccgccggctacgtggccgccagattctacaagagcttcggcggcgagaagtggaagaccaacgtgctgctgaccagcttcctgtgccccggcatcgtgttcgccgacttcttcatcatgaacctgatcctgtggggcgagggcagcagcgccgccatccccttcggcaccctggtggccatcctggccctgtggttctgcatcagcgtgcccctgaccttcatcggcgcctacttcggcttcaagaagaacgccatcgagcaccccgtgagaaccaaccagatccccagacagatccccgagcagagcttctacaccaagcccctgcccggcatcatcatgggcggcatcctgcccttcggctgcatcttcatccagctgttcttcatcctgaacagcatctggagccaccagatgtactacatgttcggcttcctgttcctggtgttcatcatcctggtgatcacctgcagcgaggccaccatcctgctgtgctacttccacctgtgcgccgaggactaccactggcagtggagaagcttcctgaccagcggcttcaccgccgtgtacttcctgatctacgccgtgcactacttcttcagcaagctgcagatcaccggcaccgccagcaccatcctgtacttcggctacaccatgatcatggtgctgatcttcttcctgttcaccggcaccatcggcttcttcgcctgcttctggttcgtgaccaagatctacagcgtggtgaaggtggactag

SEQ ID NO: 22990 - DNA, 1770 bp, Artificial Sequence
  Description of Artificial Sequence: Synthetic coding sequence
atgagacccctgcccggcgccctgggcgtggccgccgccgccgccctgtggctgctgctgctgctgctgcccagaaccagagccgacgagcacgagcacacctaccaggacaaggaggaggtggtgctgtggatgaacaccgtgggcccctaccacaacagacaggagacctacaagtacttcagcctgcccttctgcgtgggcagcaagaagagcatcagccactaccacgagaccctgggcgaggccctgcagggcgtggagctggagttcagcggcctggacatcaagttcaaggacgacgtgatgcccgccacctactgcgagatcgacctggacaaggagaagagagacgccttcgtgtacgccatcaagaaccactactggtaccagatgtacatcgacgacctgcccatctggggcatcgtgggcgaggccgacgagaacggcgaggactactacctgtggacctacaagaagctggagatcggcttcaacggcaacagaatcgtggacgtgaacctgaccagcgagggcaaggtgaagctggtgcccaacaccaagatccagatgagctacagcgtgaagtggaagaagagcgacgtgaagttcgaggacagattcgacaagtacctggaccccagcttcttccagcacagaatccactggttcagcatcttcaacagcttcatgatggtgatcttcctggtgggcctggtgagcatgatcctgatgagaaccctgagaaaggactacgccagatacagcaaggaggaggagatggacgacatggacagagacctgggcgacgagtacggctggaagcaggtgcacggcgacgtgttcagacccagcagccaccccctgatcttcagcagcctgatcggcagcggctgccagatcttcgccgtgagcctgatcgtgatcatcgtggccatgatcgaggacctgtacaccgagagaggcagcatgctgagcaccgccatcttcgtgtacgccgccaccagccccgtgaacggctacttcggcggcagcctgtacgccagacagggcggcagaagatggatcaagcagatgttcatcggcgccttcctgatccccgccatggtgtgcggcaccgccttcttcatcaacttcatcgccatctactaccacgccagcagagccatccccttcggcaccatggtggccgtgtgctgcatctgcttcttcgtgatcctgcccctgaacctggtgggcaccatcctgggcagaaacctgagcggccagcccaacttcccctgcagagtgaacgccgtgcccagacccatccccgagaagaagtggttcatggagcccgccgtgatcgtgtgcctgggcggcatcctgcccttcggcagcatcttcatcgagatgtacttcatcttcaccagcttctgggcctacaagatctactacgtgtacggcttcatgatgctggtgctggtgatcctgtgcatcgtgaccgtgtgcgtgaccatcgtgtgcacctacttcctgctgaacgccgaggactacagatggcagtggaccagcttcctgagcgccgccagcaccgccatctacgtgtacatgtacagcttctactactacttcttcaagaccaagatgtacggcctgttccagaccagcttctacttcggctacatggccgtgttcagcaccgccctgggcatcatgtgcggcgccatcggctacatgggcaccagcgccttcgtgagaaagatctacaccaacgtgaagatcgactag

SEQ ID NO: 22991 - DNA, 765 bp, Artificial Sequence
  Description of Artificial Sequence: Synthetic coding sequence
atgaacaccgtgggcccctaccacaacagacaggagacctacaagtacttcagcctgcccttctgcgtgggcagcaagaagagcatcagccactaccacgagaccctgggcgaggccctgcagggcgtggagctggagttcagcggcctggacatcaagttcaaggacgacgtgatgcccgccacctactgcgagatcgacctggacaaggagaagagagacgccttcgtgtacgccatcaagaaccactactggtaccagatgtacatcgacgacctgcccatctggggcatcgtgggcgaggccgacgagaacggcgaggactactacctgtggacctacaagaagctggagatcggcttcaacggcaacagaatcgtggacgtgaacctgaccagcgagggcaaggtgaagctggtgcccaacaccaagatccagatgagctacagcgtgaagtggaagaagagcgacgtgaagttcgaggacagattcgacaagtacctggaccccagcttcttccagcacagaatccactggttcagcatcttcaacagcttcatgatggtgatcttcctggtgggcctggtgagcatgatcctgatgagaaccctgagaaaggactacgccagatacagcaaggaggaggagatggacgacatggacagagacctgggcgacgagtacggctggaagcaggtgcacggcgacgtgttcagacccagcagccaccccctgatcttcagcagcctgatcggcagcggctag

SEQ ID NO: 22992 - DNA, 765 bp, Artificial Sequence
  Description of Artificial Sequence: Synthetic coding sequence
atggcctggcagggcctggtgctggccgcctgcctgctgatgttccccagcaccaccgccgactgcctgagcagatgcagcctgtgcgccgtgaagacccaggacggccccaagcccatcaaccccctgatctgcagcctgcagtgccaggccgccctgctgcccagcgaggagtgggagagatgccagagcttcctgagcttcttcacccccagcaccctgggcctgaacgacaaggaggacctgggcagcaagagcgtgggcgagggcccctacagcgagctggccaagctgagcggcagcttcctgaaggagctggagaagagcaagttcctgcccagcatcagcaccaaggagaacaccctgagcaagagcctggaggagaagctgagaggcctgagcgacggcttcagagagggcgccgagagcgagctgatgagagacgcccagctgaacgacggcgccatggagaccggcaccctgtacctggccgaggaggaccccaaggagcaggtgaagagatacggcggcttcctgagaaagtaccccaagagaagcagcgaggtggccggcgagggcgacggcgacagcatgggccacgaggacctgtacaagagatacggcggcttcctgagaagaatcagacccaagctgaagtgggacaaccagaagagatacggcggcttcctgagaagacagttcaaggtggtgaccagaagccaggaggaccccaacgcctacagcggcgagctgttcgacgcctag

SEQ ID NO: 22993 - DNA, 1929 bp, Artificial Sequence
  Description of Artificial Sequence: Synthetic coding sequence
atggccaccgccatggactggctgccctggagcctgctgctgttcagcctgatgtgcgagaccagcgccttctacgtgcccggcgtggcccccatcaacttccaccagaacgaccccgtggagatcaaggccgtgaagctgaccagcagcagaacccagctgccctacgagtactacagcctgcccttctgccagcccagcaagatcacctacaaggccgagaacctgggcgaggtgctgagaggcgacagaatcgtgaacacccccttccaggtgctgatgaacagcgagaagaagtgcgaggtgctgtgcagccagagcaacaagcccgtgaccctgaccgtggagcagagcagactggtggccgagagaatcaccgaggactactacgtgcacctgatcgccgacaacctgcccgtggccaccagactggagctgtacagcaacagagacagcgacgacaagaagaaggagaaggacgtgcagttcgagcacggctacagactgggcttcaccgacgtgaacaagatctacctgcacaaccacctgagcttcatcctgtactaccacagagaggacatggaggaggaccaggagcacacctacagagtggtgagattcgaggtgatcccccagagcatcagactggaggacctgaaggccgacgagaagagcagctgcaccctgcccgagggcaccaacagcagcccccaggagatcgaccccaccaaggagaaccagctgtacttcacctacagcgtgcactgggaggagagcgacatcaagtgggccagcagatgggacacctacctgaccatgagcgacgtgcagatccactggttcagcatcatcaacagcgtggtggtggtgttcttcctgagcggcatcctgagcatgatcatcatcagaaccctgagaaaggacatcgccaactacaacaaggaggacgacatcgaggacaccatggaggagagcggctggaagctggtgcacggcgacgtgttcagacccccccagtaccccatgatcctgagcagcctgctgggcagcggcatccagctgttctgcatgatcctgatcgtgatcttcgtggccatgctgggcatgctgagccccagcagcagaggcgccctgatgaccaccgcctgcttcctgttcatgttcatgggcgtgttcggcggcttcagcgccggcagactgtacagaaccctgaagggccacagatggaagaagggcgccttctgcaccgccaccctgtaccccggcgtggtgttcggcatctgcttcgtgctgaactgcttcatctggggcaagcacagcagcggcgccgtgcccttccccaccatggtggccctgctgtgcatgtggttcggcatcagcctgcccctggtgtacctgggctactacttcggcttcagaaagcagccctacgacaaccccgtgagaaccaaccagatccccagacagatccccgagcagagatggtacatgaacagattcgtgggcatcctgatggccggcatcctgcccttcggcgccatgttcatcgagctgttcttcatcttcagcgccatctgggagaaccagttctactacctgttcggcttcctgttcctggtgttcatcatcctggtggtgagctgcagccagatcagcatcgtgatggtgtacttccagctgtgcgccgaggactacagatggtggtggagaaacttcctggtgagcggcggcagcgccttctacgtgctggtgtacgccatcttctacttcgtgaacaagctggacatcgtggagttcatccccagcctgctgtacttcggctacaccgccctgatggtgctgagcttctggctgctgaccggcaccatcggcttctacgccgcctacatgttcgtgagaaagatctacgccgccgtgaagatcgactag

SEQ ID NO: 22994 - DNA, 735 bp, Artificial Sequence
  Description of Artificial Sequence: Synthetic coding sequence
atggcccagatgttcctggagcccctggccgacaagttcatctactgccaggtgctgatgaacagcgagaagaagtgcgaggtgctgtgcagccagagcaacaagcccgtgaccctgaccgtggagcagagcagactggtggccgagagaatcaccgaggactactacgtgcacctgatcgccgacaacctgcccgtggccaccagactggagctgtacagcaacagagacagcgacgacaagaagaaggagaaggacgtgcagttcgagcacggctacagactgggcttcaccgacgtgaacaagatctacctgcacaaccacctgagcttcatcctgtactaccacagagaggacatggaggaggaccaggagcacacctacagagtggtgagattcgaggtgatcccccagagcatcagactggaggacctgaaggccgacgagaagagcagctgcaccctgcccgagggcaccaacagcagcccccaggagatcgaccccaccaaggagaaccagctgtacttcacctacagcgtgcactgggaggagagcgacatcaagtgggccagcagatgggacacctacctgaccatgagcgacgtgcagatccactggttcagcatcatcaacagcgtggtggtggtgttcttcctgagcggcatcctgagcatgatcatcatcagaaccctgagaaaggacatcgccaactacaacaaggaggacgacatctag

SEQ ID NO: 22995 - DNA, 1425 bp, Artificial Sequence
  Description of Artificial Sequence: Synthetic coding sequence
atggtgcagagattcagcctgagaagacagctgagcaagatcgagagactggaggtgagcagcctggcccagaccagcagcgccgtggccagcagcaccgacggcagcatccacaccgacagcgtggacggcacccccgacccccagagaaccaaggccgccatcgcccacctgcagcagaagatcctgaagctgaccgagcagatcaagatcgcccagaccgccagagacgacaacgtggccgagtacctgaagctggccaacagcgccgacaagcagcaggccgccagaatcaagcaggtgttcgagaagaagaaccagaagagcgcccagaccatcctgcagctgcagaagaagctggagcactaccacagaaagctgagagaggtggagcagaacggcatccccagacagcccaaggacgtgttcagagacatgcaccagggcctgaaggacgtgggcgccaaggtgaccggcttcagcgagggcgtggtggacagcgtgaagggcggcttcagcagcttcagccaggccacccacagcgccgccggcgccgtggtgagcaagcccagagagatcgccagcctgatcagaaacaagttcggcagcgccgacaacatccccaacctgaaggacagcctggaggagggccaggtggacgacgccggcaaggccctgggcgtgatcagcaacttccagagcagccccaagtacggcagcgaggaggactgcagcagcgccaccagcggcagcgtgggcgccaacagcaccaccggcggcatcgccgtgggcgccagcagcagcaagaccaacaccctggacatgcagagcagcggcttcgacgccctgctgcacgagatccaggagatcagagagacccaggccagactggaggagagcttcgagaccctgaaggagcactaccagagagactacagcctgatcatgcagaccctgcaggaggagagatacagatgcgagagactggaggagcagctgaacgacctgaccgagctgcaccagaacgagatcctgaacctgaagcaggagctggccagcatggaggagaagatcgcctaccagagctacgagagagccagagacatccaggaggccctggaggcctgccagaccagaatcagcaagatggagctgcagcagcagcagcagcaggtggtgcagctggagggcctggagaacgccaccgccagaaacctgctgggcaagctgatcaacatcctgctggccgtgatggccgtgctgctggtgttcgtgagcaccgtggccaactgcgtggtgcccctgatgaagaccagaaacagaaccttcagcaccctgttcctggtggtgttcatcgccttcctgtggaagcactgggacgccctgttcagctacgtggagagattcttcagcagccccagatag

SEQ ID NO: 22996 - DNA, 1962 bp, Artificial Sequence
  Description of Artificial Sequence: Synthetic coding sequence
atggagcccagcggcagcgagcagctgttcgaggaccccgaccccggcggcaagagccaggacgccgaggccagaaagcagaccgagagcgagcagaagctgagcaagatgacccacaacgccctggagaacatcaacgtgatcggccagggcctgaagcacctgttccagcaccagagaagaagaagcagcgtgagcccccacgacgtgcagcagatccaggccgaccccgagcccgagatggacctggagagccagaacgcctgcgccgagatcgacggcgtgcccacccaccccaccgccctgaacagagtgctgcagcagatcagagtgccccccaagatgaagagaggcaccagcctgcacagcagaagaggcaagcccgaggcccccaagggcagcccccagatcaacagaaagagcggccaggagatgaccgccgtgatgcagagcggcagacccagaagcagcagcaccaccgacgcccccaccagcagcgccatgatggagatcgcctgcgccgccgccgccgccgccgccgcctgcctgcccggcgaggagggcaccgccgagagaatcgagagactggaggtgagcagcctggcccagaccagcagcgccgtggccagcagcaccgacggcagcatccacaccgacagcgtggacggcacccccgacccccagagaaccaaggccgccatcgcccacctgcagcagaagatcctgaagctgaccgagcagatcaagatcgcccagaccgccagagacgacaacgtggccgagtacctgaagctggccaacagcgccgacaagcagcaggccgccagaatcaagcaggtgttcgagaagaagaaccagaagagcgcccagaccatcctgcagctgcagaagaagctggagcactaccacagaaagctgagagaggtggagcagaacggcatccccagacagcccaaggacgtgttcagagacatgcaccagggcctgaaggacgtgggcgccaaggtgaccggcttcagcgagggcgtggtggacagcgtgaagggcggcttcagcagcttcagccaggccacccacagcgccgccggcgccgtggtgagcaagcccagagagatcgccagcctgatcagaaacaagttcggcagcgccgacaacatccccaacctgaaggacagcctggaggagggccaggtggacgacgccggcaaggccctgggcgtgatcagcaacttccagagcagccccaagtacggcagcgaggaggactgcagcagcgccaccagcggcagcgtgggcgccaacagcaccaccggcggcatcgccgtgggcgccagcagcagcaagaccaacaccctggacatgcagagcagcggcttcgacgccctgctgcacgagatccaggagatcagagagacccaggccagactggaggagagcttcgagaccctgaaggagcactaccagagagactacagcctgatcatgcagaccctgcaggaggagagatacagatgcgagagactggaggagcagctgaacgacctgaccgagctgcaccagaacgagatcctgaacctgaagcaggagctggccagcatggaggagaagatcgcctaccagagctacgagagagccagagacatccaggaggccctggaggcctgccagaccagaatcagcaagatggagctgcagcagcagcagcagcaggtggtgcagctggagggcctggagaacgccaccgccagaaacctgctgggcaagctgatcaacatcctgctggccgtgatggccgtgctgctggtgttcgtgagcaccgtggccaactgcgtggtgcccctgatgaagaccagaaacagaaccttcagcaccctgttcctggtggtgttcatcgccttcctgtggaagcactgggacgccctgttcagctacgtggagagattcttcagcagccccagatag

SEQ ID NO: 22997 - DNA, 1620 bp, Artificial Sequence
  Description of Artificial Sequence: Synthetic coding sequence
atgaagagaggcaccagcctgcacagcagaagaggcaagcccgaggcccccaagggcagcccccagatcaacagaaagagcggccaggagatgaccgccgtgatgcagagcggcagacccagaagcagcagcaccaccgacgcccccaccagcagcgccatgatggagatcgcctgcgccgccgccgccgccgccgccgcctgcctgcccggcgaggagggcaccgccgagagaatcgagagactggaggtgagcagcctggcccagaccagcagcgccgtggccagcagcaccgacggcagcatccacaccgacagcgtggacggcacccccgacccccagagaaccaaggccgccatcgcccacctgcagcagaagatcctgaagctgaccgagcagatcaagatcgcccagaccgccagagacgacaacgtggccgagtacctgaagctggccaacagcgccgacaagcagcaggccgccagaatcaagcaggtgttcgagaagaagaaccagaagagcgcccagaccatcctgcagctgcagaagaagctggagcactaccacagaaagctgagagaggtggagcagaacggcatccccagacagcccaaggacgtgttcagagacatgcaccagggcctgaaggacgtgggcgccaaggtgaccggcttcagcgagggcgtggtggacagcgtgaagggcggcttcagcagcttcagccaggccacccacagcgccgccggcgccgtggtgagcaagcccagagagatcgccagcctgatcagaaacaagttcggcagcgccgacaacatccccaacctgaaggacagcctggaggagggccaggtggacgacgccggcaaggccctgggcgtgatcagcaacttccagagcagccccaagtacggcagcgaggaggactgcagcagcgccaccagcggcagcgtgggcgccaacagcaccaccggcggcatcgccgtgggcgccagcagcagcaagaccaacaccctggacatgcagagcagcggcttcgacgccctgctgcacgagatccaggagatcagagagacccaggccagactggaggagagcttcgagaccctgaaggagcactaccagagagactacagcctgatcatgcagaccctgcaggaggagagatacagatgcgagagactggaggagcagctgaacgacctgaccgagctgcaccagaacgagatcctgaacctgaagcaggagctggccagcatggaggagaagatcgcctaccagagctacgagagagccagagacatccaggaggccctggaggcctgccagaccagaatcagcaagatggagctgcagcagcagcagcagcaggtggtgcagctggagggcctggagaacgccaccgccagaaacctgctgggcaagctgatcaacatcctgctggccgtgatggccgtgctgctggtgttcgtgagcaccgtggccaactgcgtggtgcccctgatgaagaccagaaacagaaccttcagcaccctgttcctggtggtgttcatcgccttcctgtggaagcactgggacgccctgttcagctacgtggagagattcttcagcagccccagatag

SEQ ID NO: 22998 - DNA, 990 bp, Artificial Sequence
  Description of Artificial Sequence: Synthetic coding sequence
atgcaccagggcctgaaggacgtgggcgccaaggtgaccggcttcagcgagggcgtggtggacagcgtgaagggcggcttcagcagcttcagccaggccacccacagcgccgccggcgccgtggtgagcaagcccagagagatcgccagcctgatcagaaacaagttcggcagcgccgacaacatccccaacctgaaggacagcctggaggagggccaggtggacgacgccggcaaggccctgggcgtgatcagcaacttccagagcagccccaagtacggcagcgaggaggactgcagcagcgccaccagcggcagcgtgggcgccaacagcaccaccggcggcatcgccgtgggcgccagcagcagcaagaccaacaccctggacatgcagagcagcggcttcgacgccctgctgcacgagatccaggagatcagagagacccaggccagactggaggagagcttcgagaccctgaaggagcactaccagagagactacagcctgatcatgcagaccctgcaggaggagagatacagatgcgagagactggaggagcagctgaacgacctgaccgagctgcaccagaacgagatcctgaacctgaagcaggagctggccagcatggaggagaagatcgcctaccagagctacgagagagccagagacatccaggaggccctggaggcctgccagaccagaatcagcaagatggagctgcagcagcagcagcagcaggtggtgcagctggagggcctggagaacgccaccgccagaaacctgctgggcaagctgatcaacatcctgctggccgtgatggccgtgctgctggtgttcgtgagcaccgtggccaactgcgtggtgcccctgatgaagaccagaaacagaaccttcagcaccctgttcctggtggtgttcatcgccttcctgtggaagcactgggacgccctgttcagctacgtggagagattcttcagcagccccagatag

SEQ ID NO: 22999 - DNA, 1410 bp, Artificial Sequence
  Description of Artificial Sequence: Synthetic coding sequence
atgaagagcaaggaggaggagaccgccgtggacaagggcgacctggtggccctgagcctgcccgccggccacggcgacaccgacggccccatcagcctggacgtgcccgacggcgcccccgacccccagagaaccaaggccgccatcgaccacctgcaccagaagatcctgaagatcaccgagcagatcaagatcgagcaggaggccagagacgacaacgtggccgagtacctgaagctggccaacaacgccgacaagcagcaggtgagcagaatcaagcaggtgttcgagaagaagaaccagaagagcgcccagaccatcgcccagctgcacaagaagctggagcactacagaagaagactgaaggagatcgagcagaacggccccagcagacagcccaaggacgtgctgagagacatgcagcagggcctgaaggacgtgggcgccaacgtgagagccggcatcagcggcttcggcggcggcgtggtggagggcgtgaagggcagcctgagcggcctgagccaggccacccacaccgccgtggtgagcaagcccagagagttcgccagcctgatcagaaacaagttcggcagcgccgacaacatcgcccacctgaaggaccccctggaggacggcccccccgaggaggccgccagagccctgagcggcagcgccaccctggtgagcagccccaagtacggcagcgacgacgagtgcagcagcgccagcgccagcagcgccggcgccggcagcaacagcggcgccggccccggcggcgccctgggcagccccaagagcaacgccctgtacggcgcccccggcaacctggacgccctgctggaggagctgagagagatcaaggagggccagagccacctggaggacagcatggaggacctgaagacccagctgcagagagactacacctacatgacccagtgcctgcaggaggagagatacagatacgagagactggaggagcagctgaacgacctgaccgagctgcaccagaacgagatgaccaacctgaagcaggagctggccagcatggaggagaaggtggcctaccagagctacgagagagccagagacatccaggaggccgtggagagctgcctgaccagagtgaccaagctggagctgcagcagcagcagcagcaggtggtgcagctggagggcgtggagaacgccaacgccagagccctgctgggcaagttcatcaacgtgatcctggccctgatggccgtgctgctggtgttcgtgagcaccatcgccaacttcatcacccccctgatgaagaccagactgagaatcaccagcaccaccctgctggtgctggtgctgttcctgctgtggaagcactgggacagcctgacctacctgctggagcacgtgctgctgcccagctag

SEQ ID NO: 23000 - DNA, 1455 bp, Artificial Sequence
  Description of Artificial Sequence: Synthetic coding sequence
atgaaccaggtggtgcagcccctgatgagcagacacagcgcctgcagaggcagccaggcccacctgagctgggtggacaagggcgacctggtggccctgagcctgcccgccggccacggcgacaccgacggccccatcagcctggacgtgcccgacggcgcccccgacccccagagaaccaaggccgccatcgaccacctgcaccagaagatcctgaagatcaccgagcagatcaagatcgagcaggaggccagagacgacaacgtggccgagtacctgaagctggccaacaacgccgacaagcagcaggtgagcagaatcaagcaggtgttcgagaagaagaaccagaagagcgcccagaccatcgcccagctgcacaagaagctggagcactacagaagaagactgaaggagatcgagcagaacggccccagcagacagcccaaggacgtgctgagagacatgcagcagggcctgaaggacgtgggcgccaacgtgagagccggcatcagcggcttcggcggcggcgtggtggagggcgtgaagggcagcctgagcggcctgagccaggccacccacaccgccgtggtgagcaagcccagagagttcgccagcctgatcagaaacaagttcggcagcgccgacaacatcgcccacctgaaggaccccctggaggacggcccccccgaggaggccgccagagccctgagcggcagcgccaccctggtgagcagccccaagtacggcagcgacgacgagtgcagcagcgccagcgccagcagcgccggcgccggcagcaacagcggcgccggccccggcggcgccctgggcagccccaagagcaacgccctgtacggcgcccccggcaacctggacgccctgctggaggagctgagagagatcaaggagggccagagccacctggaggacagcatggaggacctgaagacccagctgcagagagactacacctacatgacccagtgcctgcaggaggagagatacagatacgagagactggaggagcagctgaacgacctgaccgagctgcaccagaacgagatgaccaacctgaagcaggagctggccagcatggaggagaaggtggcctaccagagctacgagagagccagagacatccaggaggccgtggagagctgcctgaccagagtgaccaagctggagctgcagcagcagcagcagcaggtggtgcagctggagggcgtggagaacgccaacgccagagccctgctgggcaagttcatcaacgtgatcctggccctgatggccgtgctgctggtgttcgtgagcaccatcgccaacttcatcacccccctgatgaagaccagactgagaatcaccagcaccaccctgctggtgctggtgctgttcctgctgtggaagcactgggacagcctgacctacctgctggagcacgtgctgctgcccagctag

SEQ ID NO: 23001 - DNA, 2130 bp, Artificial Sequence
  Description of Artificial Sequence: Synthetic coding sequence
atgaagagatgcagaagcgacgagctgcagcagcagcagggcgaggaggacggcgccggcctggaggacgccgccagccacctgcccggcgccgacctgagacccggcgagaccaccggcgccaacagcgccggcggccccaccagcgacgccggcgccgccgccgcccccaaccccggccccagaagcaagccccccgacctgaagaagatccagcagctgagcgagggcagcatgttcggccacggcctgaagcacctgttccacagcagaagaagaagcagagagagagagcaccagaccagccaggacagccagcagcaccagcagcagcagggcatgagcgaccacgacagccccgacgagaaggagagaagccccgagatgcacagagtgagctacgccatgagcctgcacgacctgcccgccagacccaccgccttcaacagagtgctgcagcagatcagaagcagacccagcatcaagagaggcgccagcctgcacagcagcagcggcggcggcagcagcggcagcagcagcagaagaaccaagagcagcagcctggagccccagagaggcagcccccacctgctgagaaaggccccccaggacagcagcctggccgccatcctgcaccagcaccagtgcagacccagaagcagcagcaccaccgacaccgccctgctgctggccgacggcagcaacgtgtacctgctggccgaggaggccgagggcatcggcgacaaggtggacaagggcgacctggtggccctgagcctgcccgccggccacggcgacaccgacggccccatcagcctggacgtgcccgacggcgcccccgacccccagagaaccaaggccgccatcgaccacctgcaccagaagatcctgaagatcaccgagcagatcaagatcgagcaggaggccagagacgacaacgtggccgagtacctgaagctggccaacaacgccgacaagcagcaggtgagcagaatcaagcaggtgttcgagaagaagaaccagaagagcgcccagaccatcgcccagctgcacaagaagctggagcactacagaagaagactgaaggagatcgagcagaacggccccagcagacagcccaaggacgtgctgagagacatgcagcagggcctgaaggacgtgggcgccaacgtgagagccggcatcagcggcttcggcggcggcgtggtggagggcgtgaagggcagcctgagcggcctgagccaggccacccacaccgccgtggtgagcaagcccagagagttcgccagcctgatcagaaacaagttcggcagcgccgacaacatcgcccacctgaaggaccccctggaggacggcccccccgaggaggccgccagagccctgagcggcagcgccaccctggtgagcagccccaagtacggcagcgacgacgagtgcagcagcgccagcgccagcagcgccggcgccggcagcaacagcggcgccggccccggcggcgccctgggcagccccaagagcaacgccctgtacggcgcccccggcaacctggacgccctgctggaggagctgagagagatcaaggagggccagagccacctggaggacagcatggaggacctgaagacccagctgcagagagactacacctacatgacccagtgcctgcaggaggagagatacagatacgagagactggaggagcagctgaacgacctgaccgagctgcaccagaacgagatgaccaacctgaagcaggagctggccagcatggaggagaaggtggcctaccagagctacgagagagccagagacatccaggaggccgtggagagctgcctgaccagagtgaccaagctggagctgcagcagcagcagcagcaggtggtgcagctggagggcgtggagaacgccaacgccagagccctgctgggcaagttcatcaacgtgatcctggccctgatggccgtgctgctggtgttcgtgagcaccatcgccaacttcatcacccccctgatgaagaccagactgagaatcaccagcaccaccctgctggtgctggtgctgttcctgctgtggaagcactgggacagcctgacctacctgctggagcacgtgctgctgcccagctag

SEQ ID NO: 23002 - DNA, 771 bp, Artificial Sequence
  Description of Artificial Sequence: Synthetic coding sequence
atgaaccaggtggtgcagcccctgatgagcagacacagcgcctgcagaggcagccaggcccacctgagctggctgtggaccagcgtgcccctgtgctggcccctgaccgagttccccgccggcaccgtgaagatgaagagcaaggaggaggagaccgccgtggacaagggcgacctggtggccctgagcctgcccgccggccacggcgacaccgacggccccatcagcctggacgtgcccgacggcgcccccgacccccagagaaccaaggccgccatcgaccacctgcaccagaagatcctgaagatcaccgagcagatcaagatcgagcaggaggccagagacgacaacgtggccgagtacctgaagctggccaacaacgccgacaagcagcaggtgagcagaatcaagcaggtgttcgagaagaagaaccagaagagcgcccagaccatcgcccagctgcacaagaagctggagcactacagaagaagactgaaggagatcgagcagaacggccccagcagacagcccaaggacgtgctgagagacatgcagcagggcctgaaggacgtgggcgccaacgtgagagccggcatcagcggcttcggcggcggcgtggtggagggcgtgaagggcagcctgagcggcctgagccaggccacccacaccgccgtggtgagcaagcccagagagttcgccagcctgatcagaaacaagttcggcagcgccgacaacatcgcccacctgaaggaccccctggaggacggctag

SEQ ID NO: 23003 - DNA, 1896 bp, Artificial Sequence
  Description of Artificial Sequence: Synthetic coding sequence
atgttcggccacggcctgaagcacctgttccacagcagaagaagaagcagagagagagagcaccagaccagccaggacagccagcagcaccagcagcagcagggcatgagcgaccacgacagccccgacgagaaggagagaagccccgagatgcacagagtgagctacgccatgagcctgcacgacctgcccgccagacccaccgccttcaacagagtgctgcagcagatcagaagcagacccagcatcaagagaggcgccagcctgcacagcagcagcggcggcggcagcagcggcagcagcagcagaagaaccaagagcagcagcctggagccccagagaggcagcccccacctgctgagaaaggccccccaggacagcagcctggccgccatcctgcaccagcaccagtgcagacccagaagcagcagcaccaccgacaccgccctgctgctggccgacggcagcaacgtgtacctgctggccgaggaggccgagggcatcggcgacaaggtggacaagggcgacctggtggccctgagcctgcccgccggccacggcgacaccgacggccccatcagcctggacgtgcccgacggcgcccccgacccccagagaaccaaggccgccatcgaccacctgcaccagaagatcctgaagatcaccgagcagatcaagatcgagcaggaggccagagacgacaacgtggccgagtacctgaagctggccaacaacgccgacaagcagcaggtgagcagaatcaagcaggtgttcgagaagaagaaccagaagagcgcccagaccatcgcccagctgcacaagaagctggagcactacagaagaagactgaaggagatcgagcagaacggccccagcagacagcccaaggacgtgctgagagacatgcagcagggcctgaaggacgtgggcgccaacgtgagagccggcatcagcggcttcggcggcggcgtggtggagggcgtgaagggcagcctgagcggcctgagccaggccacccacaccgccgtggtgagcaagcccagagagttcgccagcctgatcagaaacaagttcggcagcgccgacaacatcgcccacctgaaggaccccctggaggacggcccccccgaggaggccgccagagccctgagcggcagcgccaccctggtgagcagccccaagtacggcagcgacgacgagtgcagcagcgccagcgccagcagcgccggcgccggcagcaacagcggcgccggccccggcggcgccctgggcagccccaagagcaacgccctgtacggcgcccccggcaacctggacgccctgctggaggagctgagagagatcaaggagggccagagccacctggaggacagcatggaggacctgaagacccagctgcagagagactacacctacatgacccagtgcctgcaggaggagagatacagatacgagagactggaggagcagctgaacgacctgaccgagctgcaccagaacgagatgaccaacctgaagcaggagctggccagcatggaggagaaggtggcctaccagagctacgagagagccagagacatccaggaggccgtggagagctgcctgaccagagtgaccaagctggagctgcagcagcagcagcagcaggtggtgcagctggagggcgtggagaacgccaacgccagagccctgctgggcaagttcatcaacgtgatcctggccctgatggccgtgctgctggtgttcgtgagcaccatcgccaacttcatcacccccctgatgaagaccagactgagaatcaccagcaccaccctgctggtgctggtgctgttcctgctgtggaagcactgggacagcctgacctacctgctggagcacgtgctgctgcccagctag

SEQ ID NO: 23004 - DNA, 1434 bp, Artificial Sequence
  Description of Artificial Sequence: Synthetic coding sequence
atgcccggcagcgacaccgccctgaccgtggacagaacctacagctaccccggcagacaccacagatgcaagagcagagtggagagacacgacatgaacaccctgagcctgcccctgaacatcagaagaggcggcagcgacaccaacctgaacttcgacgtgcccgacggcatcctggacttccacaaggtgaagctgaccgccgacagcctgaagcagaagatcctgaaggtgaccgagcagatcaagatcgagcagaccagcagagacggcaacgtggccgagtacctgaagctggtgaacaacgccgacaagcagcaggccggcagaatcaagcaggtgttcgagaagaagaaccagaagagcgcccacagcatcgcccagctgcagaagaagctggagcagtaccacagaaagctgagagagatcgagcagaacggcgccagcagaagcagcaaggacatcagcaaggaccacctgaaggacatccacagaagcctgaaggacgcccacgtgaagagcagaaccgccccccactgcatggagagcagcaagagcggcatgcccggcgtgagcctgaccccccccgtgttcgtgttcaacaagagcagagagttcgccaacctgatcagaaacaagttcggcagcgccgacaacatcgcccacctgaagaacagcctggaggagttcagacccgaggccagcgccagagcctacggcggcagcgccaccatcgtgaacaagcccaagtacggcagcgacgacgagtgcagcagcggcaccagcggcagcgccgacagcaacggcaaccagagcttcggcgccggcggcgccagcaccctggacagccagggcaagctggccgtgatcctggaggagctgagagagatcaaggacacccaggcccagctggccgaggacatcgaggccctgaaggtgcagttcaagagagagtacggcttcatcagccagaccctgcaggaggagagatacagatacgagagactggaggaccagctgcacgacctgaccgacctgcaccagcacgagaccgccaacctgaagcaggagctggccagcatcgaggagaaggtggcctaccaggcctacgagagaagcagagacatccaggaggccctggagagctgccagaccagaatcagcaagctggagctgcaccagcaggagcagcaggccctgcagaccgacaccgtgaacgccaaggtgctgctgggcagatgcatcaacgtgatcctggccttcatgaccgtgatcctggtgtgcgtgagcaccatcgccaagttcgtgagccccatgatgaagagcagatgccacatcctgggcaccttcttcgccgtgaccctgctggccatcttctgcaagaactgggaccacatcctgtgcgccatcgagagaatgatcatccccagatag

SEQ ID NO: 23005 - DNA, 549 bp, Artificial Sequence
  Description of Artificial Sequence: Synthetic coding sequence
atgagcaccagcagcagcagcagctgggacaacctgctggagagcctgagcctgagcaccgtgtggaactggatccaggccagcttcctgggcgagaccagcgccccccagcagaccagcctgggcctgctggacaacctggcccccgccgtgcagatcatcctgagaatcagcttcctgatcctgctgggcatcggcatctacgccctgtggaagagaagcatccagagcatccagaagaccctgctgttcgtgatcaccctgtacaagctgtacaagaagggcagccacatcttcgaggccctgctggccaaccccgagggcagcggcctgagaatccaggacaacaacaacctgttcctgagcctgggcctgcaggagaagatcctgaagaagctgaagaccgtggagaacaagatgaagaacctggagggcatcatcgtggcccagaagcccgccaccaagagagactgcagcagcgagccctactgcagctgcagcgactgccagagccccctgagcaccagcggcttcaccagccccatctag

SEQ ID NO: 23006 - DNA, 2034 bp, Artificial Sequence
  Description of Artificial Sequence: Synthetic coding sequence
atgaaggtgctgggcagaagcttcttctgggtgctgttccccgtgctgccctgggccgtgcaggccgtggagcacgaggaggtggcccagagagtgatcaagctgcacagaggcagaggcgtggccgccatgcagagcagacagtgggtgagagacagctgcagaaagctgagcggcctgctgagacagaagaacgccgtgctgaacaagctgaagaccgccatcggcgccgtggagaaggacgtgggcctgagcgacgaggagaagctgttccaggtgcacaccttcgagatcttccagaaggagctgaacgagagcgagaacagcgtgttccaggccgtgtacggcctgcagagagccctgcagggcgactacaaggacgtggtgaacatgaaggagagcagcagacagagactggaggccctgagagaggccgccatcaaggaggagaccgagtacatggagctgctggccgccgagaagcaccaggtggaggccctgaagaacatgcagcaccagaaccagagcctgagcatgctggacgagatcctggaggacgtgagaaaggccgccgacagactggaggaggagatcgaggagcacgccttcgacgacaacaagagcgtgaagggcgtgaacttcgaggccgtgctgagagtggaggaggaggaggccaacagcaagcagaacatcaccaagagagaggtggaggacgacctgggcctgagcatgctgatcgacagccagaacaaccagtacatcctgaccaagcccagagacagcaccatccccagagccgaccaccacttcatcaaggacatcgtgaccatcggcatgctgagcctgccctgcggctggctgtgcaccgccatcggcctgcccaccatgttcggctacatcatctgcggcgtgctgctgggccccagcggcctgaacagcatcaagagcatcgtgcaggtggagaccctgggcgagttcggcgtgttcttcaccctgttcctggtgggcctggagttcagccccgagaagctgagaaaggtgtggaagatcagcctgcagggcccctgctacatgaccctgctgatgatcgccttcggcctgctgtggggccacctgctgagaatcaagcccacccagagcgtgttcatcagcacctgcctgagcctgagcagcacccccctggtgagcagattcctgatgggcagcgccagaggcgacaaggagggcgacatcgactacagcaccgtgctgctgggcatgctggtgacccaggacgtgcagctgggcctgttcatggccgtgatgcccaccctgatccaggccggcgccagcgccagcagcagcatcgtggtggaggtgctgagaatcctggtgctgatcggccagatcctgttcagcctggccgccgtgttcctgctgtgcctggtgatcaagaagtacctgatcggcccctactacagaaagctgcacatggagagcaagggcaacaaggagatcctgatcctgggcatcagcgccttcatcttcctgatgctgaccgtgaccgagctgctggacgtgagcatggagctgggctgcttcctggccggcgccctggtgagcagccagggccccgtggtgaccgaggagatcgccaccagcatcgagcccatcagagacttcctggccatcgtgttcttcgccagcatcggcctgcacgtgttccccaccttcgtggcctacgagctgaccgtgctggtgttcctgaccctgagcgtggtggtgatgaagttcctgctggccgccctggtgctgagcctgatcctgcccagaagcagccagtacatcaagtggatcgtgagcgccggcctggcccaggtgagcgagttcagcttcgtgctgggcagcagagccagaagagccggcgtgatcagcagagaggtgtacctgctgatcctgagcgtgaccaccctgagcctgctgctggcccccgtgctgtggagagccgccatcaccagatgcgtgcccagacccgagagaagaagcagcctgtag

SEQ ID NO: 23007 - DNA, 1905 bp, Artificial Sequence
  Description of Artificial Sequence: Synthetic coding sequence
atggccatgtggaacagaccctgccagagactgccccagcagcccctggtggccgagcccaccgccgagggcgagccccacctgcccaccggcagagagctgaccgaggccaacagattcgcctacgccgccctgtgcggcatcagcctgagccagctgttccccgagcccgagcacagcagcttctgcaccgagttcatggccggcctggtgcagtggctggagctgagcgaggccgtgctgcccaccatgaccgccttcgccagcggcctgggcggcgagggcgccgacgtgttcgtgcagatcctgctgaaggaccccatcctgaaggacgaccccaccgtgatcacccaggacctgctgagcttcagcctgaaggacggccactacgacgccagagccagagtgctggtgtgccacatgaccagcctgctgcaggtgcccctggaggagctggacgtgctggaggagatgttcctggagagcctgaaggagatcaaggaggaggagagcgagatggccgaggccagcagaaagaagaaggagaacagaagaaagtggaagagatacctgctgatcggcctggccaccgtgggcggcggcaccgtgatcggcgtgaccggcggcctggccgcccccctggtggccgccggcgccgccaccatcatcggcagcgccggcgccgccgccctgggcagcgccgccggcatcgccatcatgaccagcctgttcggcgccgccggcgccggcctgaccggctacaagatgaagaagagagtgggcgccatcgaggagttcaccttcctgcccctgaccgagggcagacagctgcacatcaccatcgccgtgaccggctggctggccagcggcaagtacagaaccttcagcgccccctgggccgccctggcccacagcagagagcagtactgcctggcctgggaggccaagtacctgatggagctgggcaacgccctggagaccatcctgagcggcctggccaacatggtggcccaggaggccctgaagtacaccgtgctgagcggcatcgtggccgccctgacctggcccgccagcctgctgagcgtggccaacgtgatcgacaacccctggggcgtgtgcctgcacagaagcgccgaggtgggcaagcacctggcccacatcctgctgagcagacagcagggcagaagacccgtgaccctgatcggcttcagcctgggcgccagagtgatctacttctgcctgcaggagatggcccaggagaaggactgccagggcatcatcgaggacgtgatcctgctgggcgcccccgtggagggcgaggccaagcactgggagcccttcagaaaggtggtgagcggcagaatcatcaacggctactgcagaggcgactggctgctgagcttcgtgtacagaaccagcagcgtgcagctgagagtggccggcctgcagcccgtgctgctgcaggacagaagagtggagaacgtggacctgaccagcgtggtgagcggccacctggactacgccaagcagatggacgccatcctgaaggccgtgggcatcagaaccaagcccggctgggacgagaagggcctgctgctggcccccggctgcctgcccagcgaggagcccagacaggccgccgccgccgccagcagcggcgagaccccccaccaggtgggccagacccagggccccatcagcggcgacaccagcaagctggccatgagcaccgaccccagccaggcccaggtgcccgtgggcctggaccagagcgagggcgccagcctgcccgccgccgccagccccgagagaccccccatctgcagccacggcatggaccccaaccccctgggctgccccgactgcgcctgcaagacccagggccccagcaccggcctggactag

SEQ ID NO: 23008 - DNA, 1785 bp, Artificial Sequence
  Description of Artificial Sequence: Synthetic coding sequence
atggccatgtggaacagaccctgccagagactgccccagcagcccctggtggccgagcccaccgccgagggcgagccccacctgcccaccggcagagagctgaccgaggccaacagattcgcctacgccgccctgtgcggcatcagcctgagccagctgttccccgagcccgagcacagcagcttctgcaccgagttcatggccggcctggtgcagtggctggagctgagcgaggccgtgctgcccaccatgaccgccttcgccagcggcctgggcggcgagggcgccgacgtgttcgtgcagatcctgctgaaggaccccatcctgaaggacgaccccaccgtgatcacccaggacctgctgagcttcagcctgaaggacggccactacgacgccagagccagagtgctggtgtgccacatgaccagcctgctgcaggtgcccctggaggagctggacgtgctggaggagatgttcctggagagcctgaaggagatcaaggaggaggagagcgagatggccgaggccagcagaaagaagaaggagaacagaagaaagtggaagagatacctgctgatcggcctggccaccgtgggcggcggcaccgtgatcggcgtgaccggcggcctggccgcccccctggtggccgccggcgccgccaccatcatcggcagcgccggcgccgccgccctgggcagcgccgccggcatcgccatcatgaccagcctgttcggcgccgccggcgccggcctgaccggcaccttcagcgccccctgggccgccctggcccacagcagagagcagtactgcctggcctgggaggccaagtacctgatggagctgggcaacgccctggagaccatcctgagcggcctggccaacatggtggcccaggaggccctgaagtacaccgtgctgagcggcatcgtggccgccctgacctggcccgccagcctgctgagcgtggccaacgtgatcgacaacccctggggcgtgtgcctgcacagaagcgccgaggtgggcaagcacctggcccacatcctgctgagcagacagcagggcagaagacccgtgaccctgatcggcttcagcctgggcgccagagtgatctacttctgcctgcaggagatggcccaggagaaggactgccagggcatcatcgaggacgtgatcctgctgggcgcccccgtggagggcgaggccaagcactgggagcccttcagaaaggtggtgagcggcagaatcatcaacggctactgcagaggcgactggctgctgagcttcgtgtacagaaccagcagcgtgcagctgagagtggccggcctgcagcccgtgctgctgcaggacagaagagtggagaacgtggacctgaccagcgtggtgagcggccacctggactacgccaagcagatggacgccatcctgaaggccgtgggcatcagaaccaagcccggctgggacgagaagggcctgctgctggcccccggctgcctgcccagcgaggagcccagacaggccgccgccgccgccagcagcggcgagaccccccaccaggtgggccagacccagggccccatcagcggcgacaccagcaagctggccatgagcaccgaccccagccaggcccaggtgcccgtgggcctggaccagagcgagggcgccagcctgcccgccgccgccagccccgagagaccccccatctgcagccacggcatggaccccaaccccctgggctgccccgactgcgcctgcaagacccagggccccagcaccggcctggactag

SEQ ID NO: 23009 - DNA, 1743 bp, Artificial Sequence
  Description of Artificial Sequence: Synthetic coding sequence
atggccatgtggaacagaccctgccagagactgccccagcagcccctggtggccgagcccaccgccgagggcgagccccacctgcccaccggcagagagctgaccgaggccaacagattcgcctacgccgccctgtgcggcatcagcctgagccagctgttccccgagcccgagcacagcagcttctgcaccgagttcatggccggcctggtgcagtggctggagctgagcgaggccgtgctgcccaccatgaccgccttcgccagcggcctgggcggcgagggcgccgacgtgttcgtgcagatcctgctgaaggaccccatcctgaaggacgaccccaccgtgatcacccaggacctgctgagcttcagcctgaaggacggccactacgacgccagagccagagtgctggtgtgccacatgaccagcctgctgcaggtgcccctggaggagctggacgtgctggaggagatgttcctggagagcctgaaggagatcaaggaggaggagagcgagatggccgaggccagcagaaagaagaaggagaacagaagaaagtggaagagatacctgctgatcggcctggccaccgtgggcggcggcaccgtgatcggcgtgaccggcggcctggccgcccccctggtggccgccggcgccgccaccatcatcggcagcgccggcgccgccgccctgggcagcgccgccggcatcgccatcatgaccagcctgttcggcgccgccggcgccggcctgaccggctacaagatgaagaagagagtgggcgccatcgaggagttcaccttcctgcccctgaccgagggcagacagctgcacatcaccatcgccgtgaccggctggctggccagcggcaagtacagaaccttcagcgccccctgggccgccctggcccacagcagagagcagtactgcctggcctgggaggccaagtacctgatggagctgggcaacgccctggagaccatcctgagcggcctggccaacatggtggcccaggaggccctgaagtacaccgtgctgagcggcatcgtggccgccctgacctggcccgccagcctgctgagcgtggccaacgtgatcgacaacccctggggcgtgtgcctgcacagaagcgccgaggtgggcaagcacctggcccacatcctgctgagcagacagcagggcagaagacccgtgaccctgatcggcttcagcctgggcgccagagtgatctacttctgcctgcaggagatggcccaggagaaggactgccagggcatcatcgaggacgtgatcctgctgggcgcccccgtggagggcgaggccaagcactgggagcccttcagaaaggtggtgagcggcagaatcatcaacggctactgcagaggcgactggctgctgagcttcgtgtacagaaccagcagcgtgcagctgagagtggccggcctgcagcccgtgctgctgcaggacagaagagtggagaacgtggacctgaccagcgtggtgagcggccacctggactacgccaagcagatggacgccatcctgaaggccgtgggcatcagaaccaagcccggctgggacgagaagggcctgctgctggcccccggctgcctgcccagcgaggagcccagacaggccgccgccgccgccagcagcgccctggagagcggctgccccagcggcggccccgagggcagcctgggccccgaggcccccacccccgccctgccctggccccagtag

SEQ ID NO: 23010 - DNA, 867 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccaccatggagagagagagagccctgcaggagctggaggaggagaccgccagactggagagaaagaacaagaccctggtgcacagcatcaccgagctgcagcagaagctgaccagaaagagccagaagatcaccaactgcgagcagagcagccccgacggcgccctggaggagaccaaggtgaagctgcagcagctggaggccagctacgcctgccaggagaaggagctgctgaaggtgatgaaggagtacgccttcgtgacccagctgtgcgaggaccaggccctgtacatcaagaagtaccaggagaccctgaagaagatcgaggaggagctggaggccctgttcctggagagagaggtgagcaagctggtgagcatgaaccccgtggagaaggagcacaccagccagaacaacgagggcacccccacccagaagaccgccagactgttcagcaagaagatcttctgctgcctgttcttcatcaccctgttcttcatcagactgctgagctacatgttcttccacgtgagattcatcaaccccgacctgctggtgaacgtgctgcccaaggtgctgggcagaagcaccctgtggaagctgagatgcttcttcttccccagcctgaccctggagaccgaggacatgctgccccactag

SEQ ID NO: 23011 - DNA, 687 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccaccatggagagagagagagccctgcaggagctggaggaggagaccgccagactggagagaaagaacaagaccctggtgcacagcatcaccgagctgcagcagaagctgaccagaaagagccagaagatcaccaactgcgagcagagcagccccgacggcgccctggaggagaccaaggtgaagctgcagcagctggaggccagctacgcctgccaggagaaggagctgctgaaggtgatgaaggagtacgccttcgtgacccagctgtgcgaggaccaggccctgtacatcaagaagtaccaggagaccctgaagaagatcgaggaggagctggaggccctgttcctggagagagaggtgagcaagctggtgagcatgaaccccgtggagaaggagcacaccagccagaacaacgagggcacccccacccagaagaccgccagactgttcagcaagaactggcaccacagcttctag

SEQ ID NO: 23012 - DNA, 246 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccaccatggagagagagagagccctgcaggagctgtag

SEQ ID NO: 23013 - DNA, 435 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccaccatggagagagagagagccctgcaggagctggaggaggagaccgccagactggagagaaagaacaagaccctggtgcacagcatcaccgagctgcagcagaagctgaccagaaagagccagaagatcaccaactgcgagcagagcagccccgacggcgccctggaggagaccaaggtgaagctgcagcagctggaggccagctacgcctgccaggagaagtag

SEQ ID NO: 23014 - DNA, 687 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccaccatggagagagagagagccctgcaggagctggaggaggagaccgccagactggagagaaagaacaagaccctggtgcacagcatcaccgagctgcagcagaagctgaccagaaagagccagaagatcaccaactgcgagcagagcagccccgacggcgccctggaggagaccaaggtgaagctgcagcagctggaggccagctacgcctgccaggagaaggagctgctgaaggtgatgaaggagtacgccttcgtgacccagctgtgcgaggaccaggccctgtacatcaagaagtaccaggagaccctgaagaagatcgaggaggagctggaggccctgttcctggagagagaggtgagcaagctggtgagcatgaaccccgtggagaaggagcacaccagccagaacaacgagggcacccccacccagaagaccgccagactgttcagcaagaagtgggccagcagcttctag

SEQ ID NO: 23015 - DNA, 216 bp, Artificial Sequence
  Description of Artificial Sequence: Synthetic coding sequence
atggagatcagcagactggcccagagcaagagaaacatcatcagcctgaacatggacctggagagagacacccagagaatcgacgaggccaaccagaagctgctgctgaagatccaggagagagaggacaagatccagagactggagagcgagatcatccagaccagaggcctggtggaggacgaggagtgggagaaggagaacagaaccacctag

SEQ ID NO: 23016 - DNA, 3285 bp, Artificial Sequence
  Description of Artificial Sequence: Synthetic coding sequence
atggccgccagacaggccgtgggcagcggcgcccaggagacctgcggcctggacagaatcctggaggccctgaagctgctgctgagccccggcggcagcggcagcagcagcctgcaggtgaccaagcacgacgtgctgctggccaccctgaagagcaacctgagcgccctggaggacaagttcctgaaggacccccagtggaagaacctgaagctgctgagagacgagatcgccgacaaggccgagtggccccagaacagcgtggacgtgacctggagcttcaccagccagaccctgctgctgctgctgtgcctgaaggagaccatgatcagactggccgccaacttcaaccccggcaagcccaaccccagaacccccgaggtggcccccgccctgagccccgacgccctgagcatcagccagcagaagaccgtgcagttcgtgctgcagttcgtggtgaccctgggcatctgcccctacctgatgcccggcgtgggcgtgcccctgagatacagaaccgagttcggcgccgtggtgcaggacgtggtgtgcttcgacgccgcccccgacgccaccagaagactgtacaccagctgcaaggccctgctgaacgtggcccagcacaccagcctgggcagcctgatcttctgccaccacttcggcgacatcgccgccggcctgtgccagctgggcttctgccccaccaagagaaagctgctgacccccgccgaggaggtgctgaccgaggaggagagaaccctgagcagaggcgccctgagagacatgctggaccaggtgtaccagcccctggccgtgagagagctgctgatcctgcagggcggccccccccagagctgcaccgacgtgaagacccagatgagatgcagagcccccgcctggctgagaagactgtgcggccagctgctgagcgagagactgatgagacccaacggcgtgcaggccgtggtgagaggcatcctggagggcgccggcgccggcgccgccggcggcagcgacgccgaggtgaccgccgccgactggaagaagtgcgacctgatcgccaagatcctggccagctgcccccagcagagcctgagccccgagaactactacagagacatctgcccccaggtgctggacctgttccacttccaggacaagctgaccgccagacagttccagagagtggccaccaccaccttcatcaccctgagcagagagagaccccacctggccgccaagtacctgctgcagcccgtgctggcccccctgcacagatgcctgaacaccgccgagctgagcgagagcgacatggtgcccggcaccatcctggtgaccgaggaggagctgagcagatgcatcgaggacgtgttcaaggtgtacgtggtgggcaacgagcccctgaccgtgctgatggacagcctgctgcccgtgctgggcgtgctgttcctgctgtactgcttcaccaagcagagcgtgagccacatcagaagcctgtgccaggagatcctgctgtggatcctgggcaagctggagagaaagaaggccatcgccagcctgaagggcttcgccggcctggacaaggccgtgcccagcctgcacagcctgtgccagttcagagtggccacccagggcggcatcatgatcaccatcaaggaggccatcagcgacgaggacgaggacgaggccctgtaccagaaggtgagcagcgagcagggcagagtggagcacctgggcgacctgctgagccactgccaggagtgcggcctggccggcgacttcttcatcttctgcctgaaggagctgacccacgtggccagcgagaacgagaccgagctgaagaccgagcccttcagcagcaagagcctgctggagctggagcagcaccagaccctgctggtggagggccaggagagaaagctgctggtgctgcagctgatggccgtgctgtgcgagagaatgagcgagcagatcttcaccaacgtgacccaggtggtggacttcgtggccgccaccctgcagagagcctgcgccagcctggcccaccaggccgagagcaccgtggagagccagaccctgagcatgagcatgggcctggtggccgtgatgctgggcggcgccgtgcagctgaagagcagcgacttcgccgtgctgaagcagctgctgcccctgctggagaaggtgagcaacacctaccccgaccccgtgatccaggagctggccgtggacctgagaatcaccatcagcacccacggcgccttcgccaccgaggccgtgagcatggccgcccagagcaccctgaacagaaaggacctggagggcaagatcgaggagcagcagcagaccagccacgagagacccaccgacgtggcccacagccacctggagcagcagcagagccacgagaccgccccccagaccggcctgcagagcaacgcccccatcatcccccagggcgtgaacgagcccagcaccaccaccagccagaagagcggcagcgtgaccaccgagcagctgcaggaggtgctgctgagcgcctacgacccccagatccccaccagagccgccgccctgagaaccctgagccactggatcgagcagagagaggccaaggccctggagatgcaggagaagctgctgaagatcttcctggagaacctggagcacgaggacaccttcgtgtacctgagcgccatccagggcgtggccctgctgagcgacgtgtaccccgagaagatcctgcccgacctgctggcccagtacgacagcagcaaggacaagcacacccccgagaccagaatgaaggtgggcgaggtgctgatgagaatcgtgagagccctgggcgacatggtgagcaagtacagagagcccctgatccacaccttcctgagaggcgtgagagaccccgacggcgcccacagagccagcagcctggccaacctgggcgagctgtgccagagactggacttcctgctgggcagcgtggtgcacgaggtgaccgcctgcctgatcgccgtggccaagaccgacggcgaggtgcaggtgagaagagccgccatccacgtggtggtgctgctgctgagaggcctgagccagaaggccaccgaggtgctgagcgccgtgctgaaggacctgtaccacctgctgaagcacgtggtgtgcctggagcccgacgacgtggccaagctgcacgcccagctggccctggaggagctggacgacatcatgaagaacttcctgttccccccccagaagctggagaagaagatcatggtgctgccctag

SEQ ID NO: 23017 - DNA, 789 bp, Artificial Sequence
  Description of Artificial Sequence: Synthetic coding sequence
atggcctggaagagcagcgtgatcatgcagatgggcagattcctgctgctggtgatcctgttcctgcccagagagatgaccagcagcgtgctgaccgtgaacggcaagaccgagaactacatcctggacaccacccccggcagccaggccagcctgatctgcgccgtgcagaaccacaccagagaggaggagctgctgtggtacagagaggagggcagagtggacctgaagagcggcaacaagatcaacagcagcagcgtgtgcgtgagcagcatcagcgagaacgacaacggcatcagcttcacctgcagactgggcagagaccagagcgtgagcgtgagcgtggtgctgaacgtgaccttcccccccctgctgagcggcaacgacttccagaccgtggaggagggcagcaacgtgaagctggtgtgcaacgtgaaggccaacccccaggcccagatgatgtggtacaagaacagcagcctgctggacctggagaagagcagacaccagatccagcagaccagcgagagcttccagctgagcatcaccaaggtggagaagcccgacaacggcacctacagctgcatcgccaagagcagcctgaagaccgagagcctggacttccacctgatcgtgaaggacaagaccgtgggcgtgcccatcgagcccatcatcgccgcctgcgtggtgatcttcctgaccctgtgcttcggcctgatcgccagaagaaagaagatcatgaagctgtgcatgaaggacaaggacccccacagcgagaccgccctgtag

SEQ ID NO: 23018 - DNA, 657 bp, Artificial Sequence
  Description of Artificial Sequence: Synthetic coding sequence
atggcctggaagagcagcgtgatcatgcagatgggcagattcctgctgctggtgatcctgttcctgcccagagagatgaccagcagcgtgctgaccgtgaacggcaagaccgagaactacatcctggacaccacccccggcagccaggccagcctgatctgcgccgtgcagaaccacaccagagaggaggagctgctgtggtacagagaggagggcagagtggacctgaagagcggcaacaagatcaacagcagcagcgtgtgcgtgagcagcatcagcgagaacgacaacggcatcagcttcacctgcagactgggcagagaccagagcgtgagcgtgagcgtggtgctgaacgtgaccttcccccccctgctgagcggcaacgacttccagaccgtggaggagggcagcaacgtgaagctggtgtgcaacgtgaaggccaacccccaggcccagatgatgtggtacaagaacagcagcctgctggacctggagaagagcagacaccagatccagcagaccagcgagagcttccagctgagcatcaccaaggtggagaagcccgacaacggcacctacagctgcatcgccaagagcagcctgaagaccgagagcctggacttccacctgatcgtgaaggccctgcagcagggctag

SEQ ID NO: 23019 - DNA, 849 bp, Artificial Sequence
  Description of Artificial Sequence: Synthetic coding sequence
atgggcagccccggcatggtgctgggcctgctggtgcagatctgggccctgcaggaggccagcagcctgagcgtgcagcagggccccaacctgctgcaggtgagacagggcagccaggccaccctggtgtgccaggtggaccaggccaccgcctgggagagactgagagtgaagtggaccaaggacggcgccatcctgtgccagccctacatcaccaacggcagcctgagcctgggcgtgtgcggcccccagggcagactgagctggcaggcccccagccacctgaccctgcagctggaccccgtgagcctgaaccacagcggcgcctacgtgtgctgggccgccgtggagatccccgagctggaggaggccgagggcaacatcaccagactgttcgtggaccccgacgaccccacccagaacagaaacagaatcgccagcttccccggcttcctgttcgtgctgctgggcgtgggcagcatgggcgtggccgccatcgtgtggggcgcctggttctggggcagaagaagctgccagcagagagacagcggcaacagccccggcaacgccttctacagcaacgtgctgtacagacccagaggcgcccccaagaagagcgaggactgcagcggcgagggcaaggaccagagaggccagagcatctacagcaccagcttcccccagcccgcccccagacagccccacctggccagcagaccctgccccagccccagaccctgccccagccccagacccggccaccccgtgagcatggtgagagtgagccccagacccagccccacccagcagcccagacccaagggcttccccaaggtgggcgaggagtag

SEQ ID NO: 23020 - DNA, 2325 bp, Artificial Sequence
  Description of Artificial Sequence: Synthetic coding sequence
atgaaccccttctacttccacgccgtgaacatcatcctgcactgcctggtgaccctggtgctgatgtacacctgcgacaagaccgtgttcaagaacagaggcctggccttcgtgaccgccctgctgttcgccgtgcaccccatccacaccgaggccgtggccggcatcgtgggcagagccgacgtgctggcctgcctgctgttcctgctggccttcctgagctacaacagaagcctggaccagggctgcgtgggcggcagcttccccagcaccgtgagccccttcttcctgctgctgagcctgttcctgggcacctgcgccatgctggtgaaggagaccggcatcaccgtgttcggcgtgtgcctggtgtacgacctgttcagcctgagcaacaagcaggacaagagcagcaacggcgccctgtgccccagaagcccccagcagcccggcagcccccagcccagcagcctgcccggccacccccacagagagaacggcaagcagcagagattcccccacaagggcgcctggggcggctgccacagccccctgccccccgagcccaagagcagcggcttccccgtgagccccagagccgtgtggagcatgatgagattcctgacctacagctacctgctggccttcaacgtgtggctgctgctggcccccgtgaccctgtgctacgactggcaggtgggcagcatccccctggtggagaccatctgggacatgagaaacctggccaccatcttcctggccgtggtgatggccctgctgagcctgcactgcctggccgccttcaagagactggagcacaaggaggtgctggtgggcctgctgttcctggtgttccccttcatccccgccagcaacctgttcttcagagtgggcttcgtggtggccgagagagtgctgtacatgcccagcatgggctactgcatcctgttcgtgcacggcctgagcaagctgtgcacctggctgaacagatgcggcgccaccaccctgatcgtgagcaccgtgctgctgctgctgctgttcagctggaagaccgtgaagcagaacgagatctggctgagcagagagagcctgttcagaagcggcgtgcagaccctgccccacaacgccaaggtgcactacaactacgccaacttcctgaaggaccagggcagaaacaaggaggccatctaccactacagaaccgccctgaagctgtaccccagacacgccagcgccctgaacaacctgggcaccctgaccagagacaccgccgaggccaagatgtactaccagagagccctgcagctgcacccccagcacaacagagccctgttcaacctgggcaacctgctgaagagccaggagaagaaggaggaggccatcaccctgctgaaggacagcatcaagtacggccccgagttcgccgacgcctacagcagcctggccagcctgctggccgagcaggagagattcaaggaggccgaggagatctaccagaccggcatcaagaactgccccgacagcagcgacctgcacaacaactacggcgtgttcctggtggacaccggcctgcccgagaaggccgtggcccactaccagcaggccatcaagctgagccccagccaccacgtggccatggtgaacctgggcagactgtacagaagcctgggcgagaacagcatggccgaggagtggtacaagagagccctgcaggtggcccacaaggccgagatcctgagccccctgggcgccctgtactacaacaccggcagatacgaggaggccctgcagatctaccaggaggccgccgccctgcagcccagccagagagagctgagactggccctggcccaggtgctggccgtgatgggccagaccaaggaggccgagaagatgaccaaccacatcgtgagcgaggagaccggctgcctggagtgctacagactgctgagcgccatctacagcaagcaggagaaccacgacaaggccctggacgccatcgacaaggccctgcagctgaagcccaaggaccccaaggtgatcagcgagctgttcttcaccaagggcaaccagctgagagagcagaacctgctggacaaggccttcgagagctacagagtggccgtgcagctgaaccccgaccaggcccaggcctggatgaacatgggcggcatccagcacatcaagggcaagtacgtgagcgccagagcctactacgagagagccctgcagctggtgcccgacagcaagctgctgaaggagaacctggccaagctggacagactggagaagagactgcaggaggtgagagagaaggaccagacctag

SEQ ID NO: 23021 - DNA, 1725 bp, Artificial Sequence
  Description of Artificial Sequence: Synthetic coding sequence
atgaaccccttctacttccacgccgtgaacatcatcctgcactgcctggtgaccctggtgctgatgtacacctgcgacaagaccgtgttcaagaacagaggcctggccttcgtgaccgccctgctgttcgccgtgcaccccatccacaccgaggccgtggccggcatcgtgggcagagccgacgtgctggcctgcctgctgttcctgctggccttcctgagctacaacagaagcctggaccagggctgcgtgggcggcagcttccccagcaccgtgagccccttcttcctgctgctgagcctgttcctgggcacctgcgccatgctggtgaaggagaccggcatcaccgtgttcggcgtgtgcctggtgtacgacctgttcagcctgagcaacaagcaggacaagagcagcaacggcgccctgtgccccagaagcccccagcagcccggcagcccccagcccagcagcctgcccggccacccccacagagagaacggcaagcagcagagattcccccacaagggcgcctggggcggctgccacagccccctgccccccgagcccaagagcagcggcttccccgtgagccccagagccgtgtggagcatgatgagatacctgagagccagcagcaacagaaacttcctgctgaccatgagacccttcctgaagagagccatcctggtgctgagctacgtgctggtgatcctgtacttcagactgtggatcatgggcggcagcatgcccctgttcagcgagcaggacaaccccgccagcttcagcccctacatcctgaccagattcctgacctacagctacctgctggccttcaacgtgtggctgctgctggcccccgtgaccctgtgctacgactggcaggtgggcagcatccccctggtggagaccatctgggacatgagaaacctggccaccatcttcctggccgtggtgatggccctgctgagcctgcactgcctggccgccttcaagagactggagcacaaggaggtgctggtgggcctgctgttcctggtgttccccttcatccccgccagcaacctgttcttcagagtgggcttcgtggtggccgagagagtgctgtacatgcccagcatgggctactgcatcctgttcgtgcacggcctgagcaagctgtgcacctggctgaacagatgcggcgccaccaccctgatcgtgagcaccgtgctgctgctgctgctgttcagctggaagaccgtgaagcagaacgagatctggctgagcagagagagcctgttcagaagcggcgtgcagaccctgccccacaacgccaaggtgcactacaactacgccaacttcctgaaggaccagggcagaaacaaggaggccatctaccactacagaaccgccctgaagctgtaccccagacacgccagcgccctgaacaacctgggcaccctgaccagagacaccgccgaggccaagatgtactaccagagagccctgcagctgcacccccagcacaacagagccctgttcaacctgggcaacctgctgaagagccaggagaagaaggaggaggccatcaccctgctgaaggacagcatcaagtacggccccgagttcgccgacgcctacagcagcctggccagcctgctggccgagcaggtgatcgtgagccacagcagcttcttccagtgctactgctacatgtacaagctgatgctgcacagattcctgtactag

SEQ ID NO: 23022 - DNA, 2649 bp, Artificial Sequence
  Description of Artificial Sequence: Synthetic coding sequence
atggtggtgaccaccagcgccagaggcggcggcggcgacagaacccccagcagaagaagaggctgcggcctggcccccgccggcgccgccgccctgctggccggcgccagctgcctgtgctacggcagaagcctgcagggcgagttcgtgcacgacgacgtgtgggccatcgtgaacaaccccgacgtgagacccggcgcccccctgagatggggcatcttcaccaacgacttctggggcaagggcatggccgagaacaccagccacaagagctacagacccctgtgcgtgctgaccttcaagctgaacatcttcctgaccggcatgaaccccttctacttccacgccgtgaacatcatcctgcactgcctggtgaccctggtgctgatgtacacctgcgacaagaccgtgttcaagaacagaggcctggccttcgtgaccgccctgctgttcgccgtgcaccccatccacaccgaggccgtggccggcatcgtgggcagagccgacgtgctggcctgcctgctgttcctgctggccttcctgagctacaacagaagcctggaccagggctgcgtgggcggcagcttccccagcaccgtgagccccttcttcctgctgctgagcctgttcctgggcacctgcgccatgctggtgaaggagaccggcatcaccgtgttcggcgtgtgcctggtgtacgacctgttcagcctgagcaacaagcaggacaagagcagcaacggcgccctgtgccccagaagcccccagcagcccggcagcccccagcccagcagcctgcccggccacccccacagagagaacggcaagcagcagagattcccccacaagggcgcctggggcggctgccacagccccctgccccccgagcccaagagcagcggcttccccgtgagccccagagccgtgtggagcatgatgagattcctgacctacagctacctgctggccttcaacgtgtggctgctgctggcccccgtgaccctgtgctacgactggcaggtgggcagcatccccctggtggagaccatctgggacatgagaaacctggccaccatcttcctggccgtggtgatggccctgctgagcctgcactgcctggccgccttcaagagactggagcacaaggaggtgctggtgggcctgctgttcctggtgttccccttcatccccgccagcaacctgttcttcagagtgggcttcgtggtggccgagagagtgctgtacatgcccagcatgggctactgcatcctgttcgtgcacggcctgagcaagctgtgcacctggctgaacagatgcggcgccaccaccctgatcgtgagcaccgtgctgctgctgctgctgttcagctggaagaccgtgaagcagaacgagatctggctgagcagagagagcctgttcagaagcggcgtgcagaccctgccccacaacgccaaggtgcactacaactacgccaacttcctgaaggaccagggcagaaacaaggaggccatctaccactacagaaccgccctgaagctgtaccccagacacgccagcgccctgaacaacctgggcaccctgaccagagacaccgccgaggccaagatgtactaccagagagccctgcagctgcacccccagcacaacagagccctgttcaacctgggcaacctgctgaagagccaggagaagaaggaggaggccatcaccctgctgaaggacagcatcaagtacggccccgagttcgccgacgcctacagcagcctggccagcctgctggccgagcaggagagattcaaggaggccgaggagatctaccagaccggcatcaagaactgccccgacagcagcgacctgcacaacaactacggcgtgttcctggtggacaccggcctgcccgagaaggccgtggcccactaccagcaggccatcaagctgagccccagccaccacgtggccatggtgaacctgggcagactgtacagaagcctgggcgagaacagcatggccgaggagtggtacaagagagccctgcaggtggcccacaaggccgagatcctgagccccctgggcgccctgtactacaacaccggcagatacgaggaggccctgcagatctaccaggaggccgccgccctgcagcccagccagagagagctgagactggccctggcccaggtgctggccgtgatgggccagaccaaggaggccgagaagatgaccaaccacatcgtgagcgaggagaccggctgcctggagtgctacagactgctgagcgccatctacagcaagcaggagaaccacgacaaggccctggacgccatcgacaaggccctgcagctgaagcccaaggaccccaaggtgatcagcgagctgttcttcaccaagggcaaccagctgagagagcagaacctgctggacaaggccttcgagagctacagagtggccgtgcagctgaaccccgaccaggcccaggcctggatgaacatgggcggcatccagcacatcaagggcaagtacgtgagcgccagagcctactacgagagagccctgcagctggtgcccgacagcaagctgctgaaggagaacctggccaagctggacagactggagaagagactgcaggaggtgagagagaaggaccagacctag

SEQ ID NO: 23023 - DNA, 1938 bp, Artificial Sequence
  Description of Artificial Sequence: Synthetic coding sequence
gtgaccgagagagacagcgtgagcaagaagaagaagaagagatacctgagagccagcagcaacagaaacttcctgctgaccatgagacccttcctgaagagagccatcctggtgctgagctacgtgctggtgatcctgtacttcagactgtggatcatgggcggcagcatgcccctgttcagcgagcaggacaaccccgccagcttcagcccctacatcctgaccagattcctgacctacagctacctgctggccttcaacgtgtggctgctgctggcccccgtgaccctgtgctacgactggcaggtgggcagcatccccctggtggagaccatctgggacatgagaaacctggccaccatcttcctggccgtggtgatggccctgctgagcctgcactgcctggccgccttcaagagactggagcacaaggaggtgctggtgggcctgctgttcctggtgttccccttcatccccgccagcaacctgttcttcagagtgggcttcgtggtggccgagagagtgctgtacatgcccagcatgggctactgcatcctgttcgtgcacggcctgagcaagctgtgcacctggctgaacagatgcggcgccaccaccctgatcgtgagcaccgtgctgctgctgctgctgttcagctggaagaccgtgaagcagaacgagatctggctgagcagagagagcctgttcagaagcggcgtgcagaccctgccccacaacgccaaggtgcactacaactacgccaacttcctgaaggaccagggcagaaacaaggaggccatctaccactacagaaccgccctgaagctgtaccccagacacgccagcgccctgaacaacctgggcaccctgaccagagacaccgccgaggccaagatgtactaccagagagccctgcagctgcacccccagcacaacagagccctgttcaacctgggcaacctgctgaagagccaggagaagaaggaggaggccatcaccctgctgaaggacagcatcaagtacggccccgagttcgccgacgcctacagcagcctggccagcctgctggccgagcaggagagattcaaggaggccgaggagatctaccagaccggcatcaagaactgccccgacagcagcgacctgcacaacaactacggcgtgttcctggtggacaccggcctgcccgagaaggccgtggcccactaccagcaggccatcaagctgagccccagccaccacgtggccatggtgaacctgggcagactgtacagaagcctgggcgagaacagcatggccgaggagtggtacaagagagccctgcaggtggcccacaaggccgagatcctgagccccctgggcgccctgtactacaacaccggcagatacgaggaggccctgcagatctaccaggaggccgccgccctgcagcccagccagagagagctgagactggccctggcccaggtgctggccgtgatgggccagaccaaggaggccgagaagatgaccaaccacatcgtgagcgaggagaccggctgcctggagtgctacagactgctgagcgccatctacagcaagcaggagaaccacgacaaggccctggacgccatcgacaaggccctgcagctgaagcccaaggaccccaaggtgatcagcgagctgttcttcaccaagggcaaccagctgagagagcagaacctgctggacaaggccttcgagagctacagagtggccgtgcagctgaaccccgaccaggcccaggcctggatgaacatgggcggcatccagcacatcaagggcaagtacgtgagcgccagagcctactacgagagagccctgcagctggtgcccgacagcaagctgctgaaggagaacctggccaagctggacagactggagaagagactgcaggaggtgagagagaaggaccagacctag

SEQ ID NO: 23024 - DNA, 2835 bp, Artificial Sequence
  Description of Artificial Sequence: Synthetic coding sequence
atggtggtgaccaccagcgccagaggcggcggcggcgacagaacccccagcagaagaagaggctgcggcctggcccccgccggcgccgccgccctgctggccggcgccagctgcctgtgctacggcagaagcctgcagggcgagttcgtgcacgacgacgtgtgggccatcgtgaacaaccccgacgtgagacccggcgcccccctgagatggggcatcttcaccaacgacttctggggcaagggcatggccgagaacaccagccacaagagctacagacccctgtgcgtgctgaccttcaagctgaacatcttcctgaccggcatgaaccccttctacttccacgccgtgaacatcatcctgcactgcctggtgaccctggtgctgatgtacacctgcgacaagaccgtgttcaagaacagaggcctggccttcgtgaccgccctgctgttcgccgtgcaccccatccacaccgaggccgtggccggcatcgtgggcagagccgacgtgctggcctgcctgctgttcctgctggccttcctgagctacaacagaagcctggaccagggctgcgtgggcggcagcttccccagcaccgtgagccccttcttcctgctgctgagcctgttcctgggcacctgcgccatgctggtgaaggagaccggcatcaccgtgttcggcgtgtgcctggtgtacgacctgttcagcctgagcaacaagcaggacaagagcagcaacggcgccctgtgccccagaagcccccagcagcccggcagcccccagcccagcagcctgcccggccacccccacagagagaacggcaagcagcagagattcccccacaagggcgcctggggcggctgccacagccccctgccccccgagcccaagagcagcggcttccccgtgagccccagagccgtgtggagcatgatgagatacctgagagccagcagcaacagaaacttcctgctgaccatgagacccttcctgaagagagccatcctggtgctgagctacgtgctggtgatcctgtacttcagactgtggatcatgggcggcagcatgcccctgttcagcgagcaggacaaccccgccagcttcagcccctacatcctgaccagattcctgacctacagctacctgctggccttcaacgtgtggctgctgctggcccccgtgaccctgtgctacgactggcaggtgggcagcatccccctggtggagaccatctgggacatgagaaacctggccaccatcttcctggccgtggtgatggccctgctgagcctgcactgcctggccgccttcaagagactggagcacaaggaggtgctggtgggcctgctgttcctggtgttccccttcatccccgccagcaacctgttcttcagagtgggcttcgtggtggccgagagagtgctgtacatgcccagcatgggctactgcatcctgttcgtgcacggcctgagcaagctgtgcacctggctgaacagatgcggcgccaccaccctgatcgtgagcaccgtgctgctgctgctgctgttcagctggaagaccgtgaagcagaacgagatctggctgagcagagagagcctgttcagaagcggcgtgcagaccctgccccacaacgccaaggtgcactacaactacgccaacttcctgaaggaccagggcagaaacaaggaggccatctaccactacagaaccgccctgaagctgtaccccagacacgccagcgccctgaacaacctgggcaccctgaccagagacaccgccgaggccaagatgtactaccagagagccctgcagctgcacccccagcacaacagagccctgttcaacctgggcaacctgctgaagagccaggagaagaaggaggaggccatcaccctgctgaaggacagcatcaagtacggccccgagttcgccgacgcctacagcagcctggccagcctgctggccgagcaggagagattcaaggaggccgaggagatctaccagaccggcatcaagaactgccccgacagcagcgacctgcacaacaactacggcgtgttcctggtggacaccggcctgcccgagaaggccgtggcccactaccagcaggccatcaagctgagccccagccaccacgtggccatggtgaacctgggcagactgtacagaagcctgggcgagaacagcatggccgaggagtggtacaagagagccctgcaggtggcccacaaggccgagatcctgagccccctgggcgccctgtactacaacaccggcagatacgaggaggccctgcagatctaccaggaggccgccgccctgcagcccagccagagagagctgagactggccctggcccaggtgctggccgtgatgggccagaccaaggaggccgagaagatgaccaaccacatcgtgagcgaggagaccggctgcctggagtgctacagactgctgagcgccatctacagcaagcaggagaaccacgacaaggccctggacgccatcgacaaggccctgcagctgaagcccaaggaccccaaggtgatcagcgagctgttcttcaccaagggcaaccagctgagagagcagaacctgctggacaaggccttcgagagctacagagtggccgtgcagctgaaccccgaccaggcccaggcctggatgaacatgggcggcatccagcacatcaagggcaagtacgtgagcgccagagcctactacgagagagccctgcagctggtgcccgacagcaagctgctgaaggagaacctggccaagctggacagactggagaagagactgcaggaggtgagagagaaggaccagacctag

SEQ ID NO: 23025 - DNA, 2511 bp, Artificial Sequence
  Description of Artificial Sequence: Synthetic coding sequence
atgatcgccgagctggtgagcagcgccctgggcctggccctgtacctgaacaccctgagcgccgacttctgctacgacgacagcagagccatcaagaccaaccaggacctgctgcccgagaccccctggacccacatcttctacaacgacttctggggcaccctgctgacccacagcggcagccacaagagctacagacccctgtgcaccctgagcttcagactgaaccacgccatcggcggcctgaacccctggagctaccacctggtgaacgtgctgctgcacgccgccgtgaccggcctgttcaccagcttcagcaagatcctgctgggcgacggctactggaccttcatggccggcctgatgttcgccagccaccccatccacaccgaggccgtggccggcatcgtgggcagagccgacgtgggcgccagcctgttcttcctgctgagcctgctgtgctacatcaagcactgcagcaccagaggctacagcgccagaacctggggctggttcctgggcagcggcctgtgcgccggctgcagcatgctgtggaaggagcagggcgtgaccgtgctggccgtgagcgccgtgtacgacgtgttcgtgttccacagactgaagatcaagcagatcctgcccaccatctacaagagaaagaacctgagcctgttcctgagcatcagcctgctgatcttctggggcagcagcctgctgggcgccagactgtactggatgggcaacaagccccccagcttcagcaacagcgacaaccccgccgccgacagcgacagcctgctgaccagaaccctgaccttcttctacctgcccaccaagaacctgtggctgctgctgtgccccgacaccctgagcttcgactggagcatggacgccgtgcccctgctgaagaccgtgtgcgactggagaaacctgcacaccgtggccttctacaccggcctgctgctgctggcctactacggcctgaagagccccagcgtggacagagagtgcaacggcaagaccgtgaccaacggcaagcagaacgccaacggccacagctgcctgagcgacgtggagtaccagaacagcgagaccaagagcagcttcgccagcaaggtggagaacggcatcaagaacgacgtgagccagagaacccagctgcccagcaccgagaacatcgtggtgctgagcctgagcctgctgatcatccccttcgtgcccgccaccaacctgttcttctacgtgggcttcgtgatcgccgagagagtgctgtacatccccagcatgggcttctgcctgctgatcaccgtgggcgccagagccctgtacgtgaaggtgcagaagagattcctgaagagcctgatcttctacgccaccgccaccctgatcgtgttctacggcctgaagaccgccatcagaaacggcgactggcagaacgaggagatgctgtacagaagcggcatcaaggtgaaccccgccaaggcctggggcaacctgggcaacgtgctgaagagccagagcaagatcagcgaggccgagagcgcctacagaaacgccctgtactacagaagcaacatggccgacatgctgtacaacctgggcctgctgctgcaggagaacagcagattcgccgaggccctgcactactacaagctggccatcggcagcagacccaccctggccagcgcctacctgaacaccggcatcatcctgatgaaccagggcagaaccgaggaggccagaagaaccttcctgaagtgcagcgagatccccgacgagaacctgaaggacccccacgcccacaagagcagcgtgaccagctgcctgtacaacctgggcaagctgtaccacgagcagggccactacgaggaggccctgagcgtgtacaaggaggccatccagaagatgcccagacagttcgccccccagagcctgtacaacatgatgggcgaggcctacatgagactgagcaagctgcccgaggccgagcactggtacatggagagcctgagaagcaagaccgaccacatccccgcccacctgacctacggcaagctgctggccctgaccggcagaaagagcgaggccgagaagctgttcctgaaggccatcgagctggaccccaccaagggcaactgctacatgcactacggccagttcctgctggaggaggccagactgatcgaggccgccgagatggccaagaaggccgccgagctggacagcaccgagttcgacgtggtgttcaacgccgcccacatgctgagacaggccagcctgaacgaggccgccgagaagtactacgacctggccgccagactgagacccaactaccccgccgccctgatgaacctgggcgccatcctgcacctgaacggcagactgcagaaggccgaggccaactacctgagagccctgcagctgaagcccgacgacgtgatcacccagagcaacctgagaaagctgtggaacatcatggagaagcagggcctgaagaccagcaagacctag

SEQ ID NO: 23026 - DNA, 2745 bp, Artificial Sequence
  Description of Artificial Sequence: Synthetic coding sequence
atggccaacatcaacctgaaggagatcaccctgatcgtgggcgtggtgaccgcctgctactggaacagcctgttctgcggcttcgtgttcgacgacgtgagcgccatcctggacaacaaggacctgcaccccagcacccccctgaagaccctgttccagaacgacttctggggcacccccatgagcgaggagagaagccacaagagctacagacccctgaccgtgctgaccttcagactgaactacctgctgagcgagctgaagcccatgagctaccacctgctgaacatgatcttccacgccgtggtgagcgtgatcttcctgaaggtgtgcaagctgttcctggacaacaagagcagcgtgatcgccagcctgctgttcgccgtgcaccccatccacaccgaggccgtgaccggcgtggtgggcagagccgagctgctgagcagcatcttcttcctggccgccttcctgagctacaccagaagcaagggccccgacaacagcatcatctggacccccatcgccctgaccgtgttcctggtggccgtggccaccctgtgcaaggagcagggcatcaccgtggtgggcatctgctgcgtgtacgaggtgttcatcgcccagggctacaccctgcccctgctgtgcaccaccgccggccagttcctgagaggcaagggcagcatccccttcagcatgctgcagaccctggtgaagctgatcgtgctgatgttcagcaccctgctgctggtggtgatcagagtgcaggtgatccagagccagctgcccgtgttcaccagattcgacaaccccgccgccgtgagccccacccccaccagacagctgaccttcaactacctgctgcccgtgaacgcctggctgctgctgaaccccagcgagctgtgctgcgactggaccatgggcaccatccccctgatcgagagcctgctggacatcagaaacctggccaccttcaccttcttctgcttcctgggcatgctgggcgtgttcagcatcagatacagcggcgacagcagcaagaccgtgctgatggccctgtgcctgatggccctgcccttcatccccgccagcaacctgttcttccccgtgggcttcgtggtggccgagagagtgctgtacgtgcccagcatgggcttctgcatcctggtggcccacggctggcagaagatcagcaccaagagcgtgttcaagaagctgagctggatctgcctgagcatggtgatcctgacccacagcctgaagaccttccacagaaactgggactgggagagcgagtacaccctgttcatgagcgccctgaaggtgaacaagaacaacgccaagctgtggaacaacgtgggccacgccctggagaacgagaagaacttcgagagagccctgaagtacttcctgcaggccacccacgtgcagcccgacgacatcggcgcccacatgaacgtgggcagaacctacaagaacctgaacagaaccaaggaggccgaggagagctacatgatggccaagagcctgatgccccagatcatccccggcaagaagtacgccgccagaatcgcccccaaccacctgaacgtgtacatcaacctggccaacctgatcagagccaacgagagcagactggaggaggccgaccagctgtacagacaggccatcagcatgagacccgacttcaagcaggcctacatcagcagaggcgagctgctgctgaagatgaacaagcccctgaaggccaaggaggcctacctgaaggccctggagctggacagaaacaacgccgacctgtggtacaacctggccatcgtgcacatcgagctgaaggagcccaacgaggccctgaagaacttcaacagagccctggagctgaaccccaagcacaagctggccctgttcaacagcgccatcgtgatgcaggagagcggcgaggtgaagctgagacccgaggccagaaagagactgctgagctacatcaacgaggagcccctggacgccaacggctacttcaacctgggcatgctggccatggacgacaagaaggacaacgaggccgagatctggatgaagaaggccatcaagctgcaggccgacttcagaagcgccctgttcaacctggccctgctgtacagccagaccgccaaggagctgaaggccctgcccatcctggaggagctgctgagatactaccccgaccacatcaagggcctgatcctgaagggcgacatcctgatgaaccagaagaaggacatcctgggcgccaagaagtgcttcgagagaatcctggagatggaccccagcaacgtgcagggcaagcacaacctgtgcgtggtgtacttcgaggagaaggacctgctgaaggccgagagatgcctgctggagaccctggccctggccccccacgaggagtacatccagagacacctgaacatcgtgagagacaagatcagcagcagcagcttcatcgagcccatcttccccaccagcaagatcagcagcgtggagggcaagaagatccccaccgagagcgtgaaggagatcagaggcgagagcagacagacccagatcgtgaagaccagcgacaacaagagccagagcaagagcaacaagcagctgggcaagaacggcgacgaggagaccccccacaagaccaccaaggacatcaaggagatcgagaagaagagagtggccgccctgaagagactggaggagatcgagagaatcctgaacggcgagtag

SEQ ID NO: 23027 - DNA, 447 bp, Artificial Sequence
  Description of Artificial Sequence: Synthetic coding sequence
atggccaacatcaacctgaaggagatcaccctgatcgtgggcgtggtgaccgcctgctactggaacagcctgttctgcggcttcgtgttcgacgacgtgagcgccatcctggacaacaaggacctgcaccccagcacccccctgaagaccctgttccagaacgacttctggggcacccccatgagcgaggagagaagccacaagagctacagacccctgaccgtgctgaccttcagactgaactacctgctgagcgagctgaagcccatgagctaccacctgctgaacatgatcttccacgccgtggtgagcgtgatcttcctgaaggtgtgcaagctgttcctggacaacaagagcagcgtgatcgccagcctgctgttcgccgtgcaccccatccacaccgaggccgtgaccggcgtggtgggcagagccgagctgctgagctag

SEQ ID NO: 23028 - DNA, 1893 bp, Artificial Sequence
  Description of Artificial Sequence: Synthetic coding sequence
atggccgtgctggacaccgacctggaccacatcctgcccagcagcgtgctgccccccttctgggccaagctggtggtgggcagcgtggccatcgtgtgcttcgccagaagctacgacggcgacttcgtgttcgacgacagcgaggccatcgtgaacaacaaggtggccggcgtggtgggcagagccgacctgctgtgcgccctgttcttcctgctgagcttcctgggctactgcaaggccttcagagagagcaacaaggagggcgcccacagcagcaccttctgggtgctgctgagcatcttcctgggcgccgtggccatgctgtgcaaggagcagggcatcaccgtgctgggcctgaacgccgtgttcgacatcctggtgatcggcaagttcaacgtgctggagatcgtgcagaaggtgctgcacaaggacaagagcctggagaacctgggcatgctgagaaacggcggcctgctgttcagaatgaccctgctgaccagcggcggcgccggcatgctgtacgtgagatggagaatcatgggcaccggcccccccgccttcaccgaggtggacaaccccgccagcttcgccgacagcatgctggtgagagccgtgaactacaactactactacagcctgaacgcctggctgctgctgtgcccctggtggctgtgcttcgactggagcatgggctgcatccccctgatcaagagcatcagcgactggagagtgatcgccctggccgccctgtggttctgcctgatcggcctgatctgccaggccctgtgcagcgaggacggccacaagagaagaatcctgaccctgggcctgggcttcctggtgatccccttcctgcccgccagcaacctgttcttcagagtgggcttcgtggtggccgagagagtgctgtacctgcccagcgtgggctactgcgtgctgctgaccttcggcttcggcgccctgagcaagcacaccaagaagaagaagctgatcgccgccgtggtgctgggcatcctgttcatcaacaccctgagatgcgtgctgagaagcggcgagtggagaagcgaggagcagctgttcagaagcgccctgagcgtgtgccccctgaacgccaaggtgcactacaacatcggcaagaacctggccgacaagggcaaccagaccgccgccatcagatactacagagaggccgtgagactgaaccccaagtacgtgcacgccatgaacaacctgggcaacatcctgaaggagagaaacgagctgcaggaggccgaggagctgctgagcctggccgtgcagatccagcccgacttcgccgccgcctggatgaacctgggcatcgtgcagaacagcctgaagagattcgaggccgccgagcagagctacagaaccgccatcaagcacagaagaaagtaccccgactgctactacaacctgggcagactgtacgccgacctgaacagacacgtggacgccctgaacgcctggagaaacgccaccgtgctgaagcccgagcacagcctggcctggaacaacatgatcatcctgctggacaacaccggcaacctggcccaggccgaggccgtgggcagagaggccctggagctgatccccaacgaccacagcctgatgttcagcctggccaacgtgctgggcaagagccagaagtacaaggagagcgaggccctgttcctgaaggccatcaaggccaaccccaacgccgccagctaccacggcaacctggccgtgctgtaccacagatggggccacctggacctggccaagaagcactacgagatcagcctgcagctggaccccaccgccagcggcaccaaggagaactacggcctgctgagaagaaagctggagctgatgcagaagaaggccgtgtag

SEQ ID NO: 23029 - DNA, 2283 bp, Artificial Sequence
  Description of Artificial Sequence: Synthetic coding sequence
atgatccccaaccagcacaacgccggcgccggcagccaccagcccgccgtgttcagaatggccgtgctggacaccgacctggaccacatcctgcccagcagcgtgctgccccccttctgggccaagctggtggtgggcagcgtggccatcgtgtgcttcgccagaagctacgacggcgacttcgtgttcgacgacagcgaggccatcgtgaacaacaaggacctgcaggccgagacccccctgggcgacctgtggcaccacgacttctggggcagcagactgagcagcaacaccagccacaagagctacagacccctgaccgtgctgaccttcagaatcaactactacctgagcggcggcttccaccccgtgggcttccacgtggtgaacatcctgctgcacagcggcatcagcgtgctgatggtggacgtgttcagcgtgctgttcggcggcctgcagtacaccagcaagggcagaagactgcacctggcccccagagccagcctgctggccgccctgctgttcgccgtgcaccccgtgcacaccgagtgcgtggccggcgtggtgggcagagccgacctgctgtgcgccctgttcttcctgctgagcttcctgggctactgcaaggccttcagagagagcaacaaggagggcgcccacagcagcaccttctgggtgctgctgagcatcttcctgggcgccgtggccatgctgtgcaaggagcagggcatcaccgtgctgggcctgaacgccgtgttcgacatcctggtgatcggcaagttcaacgtgctggagatcgtgcagaaggtgctgcacaaggacaagagcctggagaacctgggcatgctgagaaacggcggcctgctgttcagaatgaccctgctgaccagcggcggcgccggcatgctgtacgtgagatggagaatcatgggcaccggcccccccgccttcaccgaggtggacaaccccgccagcttcgccgacagcatgctggtgagagccgtgaactacaactactactacagcctgaacgcctggctgctgctgtgcccctggtggctgtgcttcgactggagcatgggctgcatccccctgatcaagagcatcagcgactggagagtgatcgccctggccgccctgtggttctgcctgatcggcctgatctgccaggccctgtgcagcgaggacggccacaagagaagaatcctgaccctgggcctgggcttcctggtgatccccttcctgcccgccagcaacctgttcttcagagtgggcttcgtggtggccgagagagtgctgtacctgcccagcgtgggctactgcgtgctgctgaccttcggcttcggcgccctgagcaagcacaccaagaagaagaagctgatcgccgccgtggtgctgggcatcctgttcatcaacaccctgagatgcgtgctgagaagcggcgagtggagaagcgaggagcagctgttcagaagcgccctgagcgtgtgccccctgaacgccaaggtgcactacaacatcggcaagaacctggccgacaagggcaaccagaccgccgccatcagatactacagagaggccgtgagactgaaccccaagtacgtgcacgccatgaacaacctgggcaacatcctgaaggagagaaacgagctgcaggaggccgaggagctgctgagcctggccgtgcagatccagcccgacttcgccgccgcctggatgaacctgggcatcgtgcagaacagcctgaagagattcgaggccgccgagcagagctacagaaccgccatcaagcacagaagaaagtaccccgactgctactacaacctgggcagactgtacgccgacctgaacagacacgtggacgccctgaacgcctggagaaacgccaccgtgctgaagcccgagcacagcctggcctggaacaacatgatcatcctgctggacaacaccggcaacctggcccaggccgaggccgtgggcagagaggccctggagctgatccccaacgaccacagcctgatgttcagcctggccaacgtgctgggcaagagccagaagtacaaggagagcgaggccctgttcctgaaggccatcaaggccaaccccaacgccgccagctaccacggcaacctggccgtgctgtaccacagatggggccacctggacctggccaagaagcactacgagatcagcctgcagctggaccccaccgccagcggcaccaaggagaactacggcctgctgagaagaaagctggagctgatgcagaagaaggccgtgtag

SEQ ID NO: 23030 - DNA, 2226 bp, Artificial Sequence
  Description of Artificial Sequence: Synthetic coding sequence
atggccgtgctggacaccgacctggaccacatcctgcccagcagcgtgctgccccccttctgggccaagctggtggtgggcagcgtggccatcgtgtgcttcgccagaagctacgacggcgacttcgtgttcgacgacagcgaggccatcgtgaacaacaaggacctgcaggccgagacccccctgggcgacctgtggcaccacgacttctggggcagcagactgagcagcaacaccagccacaagagctacagacccctgaccgtgctgaccttcagaatcaactactacctgagcggcggcttccaccccgtgggcttccacgtggtgaacatcctgctgcacagcggcatcagcgtgctgatggtggacgtgttcagcgtgctgttcggcggcctgcagtacaccagcaagggcagaagactgcacctggcccccagagccagcctgctggccgccctgctgttcgccgtgcaccccgtgcacaccgagtgcgtggccggcgtggtgggcagagccgacctgctgtgcgccctgttcttcctgctgagcttcctgggctactgcaaggccttcagagagagcaacaaggagggcgcccacagcagcaccttctgggtgctgctgagcatcttcctgggcgccgtggccatgctgtgcaaggagcagggcatcaccgtgctgggcctgaacgccgtgttcgacatcctggtgatcggcaagttcaacgtgctggagatcgtgcagaaggtgctgcacaaggacaagagcctggagaacctgggcatgctgagaaacggcggcctgctgttcagaatgaccctgctgaccagcggcggcgccggcatgctgtacgtgagatggagaatcatgggcaccggcccccccgccttcaccgaggtggacaaccccgccagcttcgccgacagcatgctggtgagagccgtgaactacaactactactacagcctgaacgcctggctgctgctgtgcccctggtggctgtgcttcgactggagcatgggctgcatccccctgatcaagagcatcagcgactggagagtgatcgccctggccgccctgtggttctgcctgatcggcctgatctgccaggccctgtgcagcgaggacggccacaagagaagaatcctgaccctgggcctgggcttcctggtgatccccttcctgcccgccagcaacctgttcttcagagtgggcttcgtggtggccgagagagtgctgtacctgcccagcgtgggctactgcgtgctgctgaccttcggcttcggcgccctgagcaagcacaccaagaagaagaagctgatcgccgccgtggtgctgggcatcctgttcatcaacaccctgagatgcgtgctgagaagcggcgagtggagaagcgaggagcagctgttcagaagcgccctgagcgtgtgccccctgaacgccaaggtgcactacaacatcggcaagaacctggccgacaagggcaaccagaccgccgccatcagatactacagagaggccgtgagactgaaccccaagtacgtgcacgccatgaacaacctgggcaacatcctgaaggagagaaacgagctgcaggaggccgaggagctgctgagcctggccgtgcagatccagcccgacttcgccgccgcctggatgaacctgggcatcgtgcagaacagcctgaagagattcgaggccgccgagcagagctacagaaccgccatcaagcacagaagaaagtaccccgactgctactacaacctgggcagactgtacgccgacctgaacagacacgtggacgccctgaacgcctggagaaacgccaccgtgctgaagcccgagcacagcctggcctggaacaacatgatcatcctgctggacaacaccggcaacctggcccaggccgaggccgtgggcagagaggccctggagctgatccccaacgaccacagcctgatgttcagcctggccaacgtgctgggcaagagccagaagtacaaggagagcgaggccctgttcctgaaggccatcaaggccaaccccaacgccgccagctaccacggcaacctggccgtgctgtaccacagatggggccacctggacctggccaagaagcactacgagatcagcctgcagctggaccccaccgccagcggcaccaaggagaactacggcctgctgagaagaaagctggagctgatgcagaagaaggccgtgtag

SEQ ID NO: 23031 - DNA, 165 bp, Artificial Sequence
  Description of Artificial Sequence: Synthetic coding sequence
atggccgtgctggacaccgacctggaccacatcctgcccagcagcgtgctgccccccttctgggccaagctggtggtgggcagcgtggccatcgtgtgcttcgccagaagctacgacggcgacttcgtgttcgacgacagcgaggccatcgtgaacaacaagtag

SEQ ID NO: 23032 - DNA, 222 bp, Artificial Sequence
  Description of Artificial Sequence: Synthetic coding sequence
atgatccccaaccagcacaacgccggcgccggcagccaccagcccgccgtgttcagaatggccgtgctggacaccgacctggaccacatcctgcccagcagcgtgctgccccccttctgggccaagctggtggtgggcagcgtggccatcgtgtgcttcgccagaagctacgacggcgacttcgtgttcgacgacagcgaggccatcgtgaacaacaagtag

SEQ ID NO: 23033 - DNA, 741 bp, Artificial Sequence
  Description of Artificial Sequence: Synthetic coding sequence
atgaccctgatcgagggcgtgggcgacgaggtgaccgtgctgttcagcgtgctggcctgcctgctggtgctggccctggcctgggtgagcacccacaccgccgagggcggcgaccccctgccccagcccagcggcacccccacccccagccagcccagcgccgccatggccgccaccgacagcatgagaggcgaggcccccggcgccgagacccccagcctgagacacagaggccaggccgcccagcccgagcccagcaccggcttcaccgccaccccccccgcccccgacagcccccaggagcccctggtgctgagactgaagttcctgaacgacagcgagcaggtggccagagcctggccccacgacaccatcggcagcctgaagagaacccagttccccggcagagagcagcaggtgagactgatctaccagggccagctgctgggcgacgacacccagaccctgggcagcctgcacctgccccccaactgcgtgctgcactgccacgtgagcaccagagtgggcccccccaaccccccctgcccccccggcagcgagcccggccccagcggcctggagatcggcagcctgctgctgcccctgctgctgctgctgctgctgctgctgtggtactgccagatccagtacagacccttcttccccctgaccgccaccctgggcctggccggcttcaccctgctgctgagcctgctggccttcgccatgtacagaccctag

SEQ ID NO: 23034 - DNA, 741 bp, Artificial Sequence; identical to SEQ ID NO: 23033
  Description of Artificial Sequence: Synthetic coding sequence

SEQ ID NO: 23035 - DNA, 741 bp, Artificial Sequence; identical to SEQ ID NO: 23033
  Description of Artificial Sequence: Synthetic coding sequence

SEQ ID NO: 23036 - DNA, 741 bp, Artificial Sequence; identical to SEQ ID NO: 23033
  Description of Artificial Sequence: Synthetic coding sequence

SEQ ID NO: 23037 - DNA, 741 bp, Artificial Sequence; identical to SEQ ID NO: 23033
  Description of Artificial Sequence: Synthetic coding sequence

SEQ ID NO: 23038 - DNA, 516 bp, Artificial Sequence
  Description of Artificial Sequence: Synthetic coding sequence
atgaccctgatcgagggcgtgggcgacgaggtgaccgtgctgttcagcgtgctggcctgcctgctggtgctggccctggcctgggtgagcacccacaccgccgagggcggcgaccccctgccccagcccagcggcacccccacccccagccagcccagcgccgccatggccgccaccgacagcatgagaggcgaggcccccggcgccgagacccccagcctgagacacagaggccaggccgcccagcccgagcccagcaccggcttcaccgccaccccccccgcccccgacagcccccaggagcccctggtgctgagactgaagttcctgaacgacagcgagcaggtggccagagcctggccccacgacaccatcggcagcctgaagagaacccagttccccggcagagagcagcaggtgagactgatctaccagggccagctgctgggcgacgacacccagaccctgggcagcctgcacctgccccccaactgcgtgctgcactgccacgtgtag

SEQ ID NO: 23039 - DNA, 459 bp, Artificial Sequence
  Description of Artificial Sequence: Synthetic coding sequence
atgaccctgatcgagggcgtgggcgacgaggtgaccgtgctgttcagcgtgctggcctgcctgctggtgctggccctggcctgggtgagcacccacaccgccgagggcggcgaccccctgccccagcccagcggcacccccacccccagccagcccagcgccgccatggccgccaccgacagcatgagaggcgaggcccccggcgccgagacccccagcctgagacacagaggccaggccgcccagcccgagcccagcaccggcttcaccgccaccccccccgcccccgacagcccccaggagcccctggtgctgagactgaagttcctgaacgacagcgagcaggtggccagagcctggccccacgacaccatcggcagcctgaagagaacccagttccccggcagagagcagcaggtgagactgatctaccagggccagctgctgggcgacgactag

SEQ ID NO: 23040 - DNA, 906 bp, Artificial Sequence
  Description of Artificial Sequence: Synthetic coding sequence
atggagctgagcgacgtgaccctgatcgagggcgtgggcaacgaggtgatggtggtggccggcgtggtggtgctgatcctggccctggtgctggcctggctgagcacctacgtggccgacagcggcagcaaccagctgctgggcgccatcgtgagcgccggcgacaccagcgtgctgcacctgggccacgtggaccacctggtggccggccagggcaaccccgagcccaccgagctgccccaccccagcgagggcaacgacgagaaggccgaggaggccggcgagggcagaggcgacagcaccggcgaggccggcgccggcggcggcgtggagcccagcctggagcacctgctggacatccagggcctgcccaagagacaggccggcgccggcagcagcagccccgaggcccccctgagaagcgaggacagcacctgcctgccccccagccccggcctgatcaccgtgagactgaagttcctgaacgacaccgaggagctggccgtggccagacccgaggacaccgtgggcgccctgaagagcaagtacttccccggccaggagagccagatgaagctgatctaccagggcagactgctgcaggaccccgccagaaccctgagaagcctgaacatcaccgacaactgcgtgatccactgccacagaagcccccccggcagcgccgtgcccggccccagcgccagcctggcccccagcgccaccgagccccccagcctgggcgtgaacgtgggcagcctgatggtgcccgtgttcgtggtgctgctgggcgtggtgtggtacttcagaatcaactacagacagttcttcaccgcccccgccaccgtgagcctggtgggcgtgaccgtgttcttcagcttcctggtgttcggcatgtacggcagatag

SEQ ID NO: 23041 - DNA, 906 bp, Artificial Sequence; identical to SEQ ID NO: 23040
  Description of Artificial Sequence: Synthetic coding sequence

SEQ ID NO: 23042 - DNA, 795 bp, Artificial Sequence
  Description of Artificial Sequence: Synthetic coding sequence
atggagctgagcgacgtgaccctgatcgagggcgtgggcaacgaggtgatggtggtggccggcgtggtggtgctgatcctggccctggtgctggcctggctgagcacctacgtggccgacagcggcagcaaccagctgctgggcgccatcgtgagcgccggcgacaccagcgtgctgcacctgggccacgtggaccacctggtggccggccagggcaaccccgagcccaccgagctgccccaccccagcgagggcctgcccaagagacaggccggcgccggcagcagcagccccgaggcccccctgagaagcgaggacagcacctgcctgccccccagccccggcctgatcaccgtgagactgaagttcctgaacgacaccgaggagctggccgtggccagacccgaggacaccgtgggcgccctgaagagcaagtacttccccggccaggagagccagatgaagctgatctaccagggcagactgctgcaggaccccgccagaaccctgagaagcctgaacatcaccgacaactgcgtgatccactgccacagaagcccccccggcagcgccgtgcccggccccagcgccagcctggcccccagcgccaccgagccccccagcctgggcgtgaacgtgggcagcctgatggtgcccgtgttcgtggtgctgctgggcgtggtgtggtacttcagaatcaactacagacagttcttcaccgcccccgccaccgtgagcctggtgggcgtgaccgtgttcttcagcttcctggtgttcggcatgtacggcagatag

SEQ ID NO: 23043 - DNA, 966 bp, Artificial Sequence
  Description of Artificial Sequence: Synthetic coding sequence
atgatcagcagacacctgcagaacaacctgatgagcgtggaccccgccagcagccaggccatggagctgagcgacgtgaccctgatcgagggcgtgggcaacgaggtgatggtggtggccggcgtggtggtgctgatcctggccctggtgctggcctggctgagcacctacgtggccgacagcggcagcaaccagctgctgggcgccatcgtgagcgccggcgacaccagcgtgctgcacctgggccacgtggaccacctggtggccggccagggcaaccccgagcccaccgagctgccccaccccagcgagggcaacgacgagaaggccgaggaggccggcgagggcagaggcgacagcaccggcgaggccggcgccggcggcggcgtggagcccagcctggagcacctgctggacatccagggcctgcccaagagacaggccggcgccggcagcagcagccccgaggcccccctgagaagcgaggacagcacctgcctgccccccagccccggcctgatcaccgtgagactgaagttcctgaacgacaccgaggagctggccgtggccagacccgaggacaccgtgggcgccctgaagagcaagtacttccccggccaggagagccagatgaagctgatctaccagggcagactgctgcaggaccccgccagaaccctgagaagcctgaacatcaccgacaactgcgtgatccactgccacagaagcccccccggcagcgccgtgcccggccccagcgccagcctggcccccagcgccaccgagccccccagcctgggcgtgaacgtgggcagcctgatggtgcccgtgttcgtggtgctgctgggcgtggtgtggtacttcagaatcaactacagacagttcttcaccgcccccgccaccgtgagcctggtgggcgtgaccgtgttcttcagcttcctggtgttcggcatgtacggcagatag

SEQ ID NO: 23044 - DNA, 936 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatcagcgtgcagctgctgatcaccgtggccatcatcgccatcttcaccttcgtggagcccgtgagcgccttcgtgagaagaaacgtggccgtgtactacgtgagctacgccgtgttcgtggtgacctacctgatcctggcctgctgccagggccccagaagaagattcccctggaacatcatcctgctgaccctgttcaccttcgccatgggcttcatgaccggcaccatcagcagcatgtaccagaccaaggccgtgatcatcgccatgatcatcaccgccgtggtgagcatcagcgtgaccatcttctgcttccagaccaaggtggacttcaccagctgcaccggcctgttctgcgtgctgggcatcgtgctgctggtgaccggcatcgtgaccagcatcgtgctgtacttccagtacgtgtactggctgcacatgctgtacgccgccctgggcgccatctgcttcaccctgttcctggcctacgacacccagctggtgctgggcaacagaaagcacaccatcagccccgaggactacatcaccggcgccctgcagatctacaccgacatcatctacatcttcaccttcgtgctgcagctgatgggcgacagaaactag

SEQ ID NO: 23045 - DNA, 936 bp, Artificial Sequence; identical to SEQ ID NO: 23044
  Description of Artificial Sequence: Synthetic coding sequence

SEQ ID NO: 23046 - DNA, 141 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctag

SEQ ID NO: 23047 - DNA, 456 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatcagcgtgcagctgctgatcaccgtggccatcatcgccatcttcaccttcgtggagcccgtgagcgccttcgtgagaagaaacgtggccgtgtactacgtgagctacgccgtgttcgtggtgacctacctgatcctgtag

SEQ ID NO: 23048 - DNA, 27 bp, Artificial Sequence
  Description of Artificial Sequence: Synthetic coding sequence
atgagcaaccccagcgcccccccctag

SEQ ID NO: 23049 - DNA, 504 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatcagcgtgcagctgctgatcaccgtggccatcatcgccatcttcaccttcgtggagcccgtgagcgccttcgtgagaagaaacgtggccgtgtactacgtgagctacgccgtgttcgtggtgacctacctgatcctggcctgctgccagggccccagaagaagattcccctggaacatcatcctgtag

SEQ ID NO: 23050 - DNA, 516 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatcagcgtgcagctgctgatcaccgtggccatcatcgccatcttcaccttcgtggagcccgtgagcgccttcgtgagaagaaacgtggccgtgtactacgtgagctacgccgtgttcgtggtgacctacctgatcctggcctgctgccagggccccagaagaagattcccctggaacatcatcctgctgaccctgttctag

SEQ ID NO: 23051 - DNA, 207 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggctag

SEQ ID NO: 23052 - DNA, 648 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaagggcacctgccagagactgtgcgaggagaagtgcggctgcctgctgagagtgctgtgctgcctgagatgccacctgcccgacccctgcctgctgcccggcacccagacccccttccccatggagcaccacagcgccgaccccttctacttctgccacggcctgcacgacggccaccacttccagtacgtgcccaaccagagcagacaccactgcaacgaccaccactgcggcggcatccacttcagccaccacctgctgctgagcgaccagggcggcctgcacctggtgcacagacccctgctgtgccccggcaactgcgcccccggcgactgggactgccactag

SEQ ID NO: 23053 - DNA, 324 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatcagctag

SEQ ID NO: 23054 - DNA, 273 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggactag

SEQ ID NO: 23055 - DNA, 321 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagaaaggtgagacacaccttcatcagaaaggtgtacagcatcatctag

SEQ ID NO: 23056 - DNA, 936 bp, Artificial Sequence; identical to SEQ ID NO: 23044
  Description of Artificial Sequence: Synthetic coding sequence

SEQ ID NO: 23057 - DNA, 414 bp, Artificial Sequence
  Description of Artificial Sequence: Synthetic coding sequence
atgggcttcatgaccggcaccatcagcagcatgtaccagaccaaggccgtgatcatcgccatgatcatcaccgccgtggtgagcatcagcgtgaccatcttctgcttccagaccaaggtggacttcaccagctgcaccggcctgttctgcgtgctgggcatcgtgctgctggtgaccggcatcgtgaccagcatcgtgctgtacttccagtacgtgtactggctgcacatgctgtacgccgccctgggcgccatctgcttcaccctgttcctggcctacgacacccagctggtgctgggcaacagaaagcacaccatcagccccgaggactacatcaccggcgccctgcagatctacaccgacatcatctacatcttcaccttcgtgctgcagctgatgggcgacagaaactag

SEQ ID NO: 23058 - DNA, 222 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctactag

SEQ ID NO: 23059 - DNA, 255 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttctag

SEQ ID NO: 23060 - DNA, 279 bp, Artificial Sequence
  Description of Artificial Sequence: Synthetic coding sequence
atgagcaaccccagcgccccccccccctacgaggacagaaaccccctgtaccccggcccccccccccccggcggctacggccagcccagcgtgctgcccggcggctaccccgcctaccccggctacccccagcccggctacggccaccccgccggctacccccagcccatgccccccacccaccccatgcccatgaactacggccccggccacggctacgacggcgaggagagagccgtgagcgacagcttcggccccggcgagtgggacgacagatag

SEQ ID NO: 23061 - DNA, 750 bp, Artificial Sequence
  Description of Artificial Sequence: Synthetic coding sequence
atgcccatgaactacggccccggccacggctacgacggcgaggagagagccgtgagcgacagcttcggccccggcgagtgggacgacagaaaggtgagacacaccttcatcagaaaggtgtacagcatcatcagcgtgcagctgctgatcaccgtggccatcatcgccatcttcaccttcgtggagcccgtgagcgccttcgtgagaagaaacgtggccgtgtactacgtgagctacgccgtgttcgtggtgacctacctgatcctggcctgctgccagggccccagaagaagattcccctggaacatcatcctgctgaccctgttcaccttcgccatgggcttcatgaccggcaccatcagcagcatgtaccagaccaaggccgtgatcatcgccatgatcatcaccgccgtggtgagcatcagcgtgaccatcttctgcttccagaccaaggtggacttcaccagctgcaccggcctgttctgcgtgctgggcatcgtgctgctggtgaccggcatcgtgaccagcatcgtgctgtacttccagtacgtgtactggctgcacatgctgtacgccgccctgggcgccatctgcttcaccctgttcctggcctacgacacccagctggtgctgggcaacagaaagcacaccatcagccccgaggactacatcaccggcgccctgcagatctacaccgacatcatctacatcttcaccttcgtgctgcagctgatgggcgacagaaactag

SEQ ID NO: 23062 - DNA, 717 bp, Artificial Sequence
  Description of Artificial Sequence: Synthetic coding sequence
atggccgaccccgaccccagataccccagaagcagcatcgaggacgacttcaactacggcagcagcgtggccagcgccaccgtgcacatcagaatggccttcctgagaaaggtgtacagcatcctgagcctgcaggtgctgctgaccaccgtgaccagcaccgtgttcctgtacttcgagagcgtgagaaccttcgtgcacgagagccccgccctgatcctgctgttcgccctgggcagcctgggcctgatcttcgccctgatcctgaacagacacaagtaccccctgaacctgtacctgctgttcggcttcaccctgctggaggccctgaccgtggccgtggtggtgaccttctacgacgtgtacatcatcctgcaggccttcatcctgaccaccaccgtgttcttcggcctgaccgtgtacaccctgcagagcaagaaggacttcagcaagttcggcgccggcctgttcgccctgctgtggatcctgtgcctgagcggcttcctgaagttcttcttctacagcgagatcatggagctggtgctggccgccgccggcgccctgctgttctgcggcttcatcatctacgacacccacagcctgatgcacaagctgagccccgaggagtacgtgctggccgccatcagcctgtacctggacatcatcaacctgttcctgcacctgctgagattcctggaggccgtgaacaagaagtag

SEQ ID NO: 23063 - DNA, 636 bp, Artificial Sequence
  Description of Artificial Sequence: Synthetic coding sequence
atggccgaccccgaccccagataccccagaagcagcatcgaggacgacttcaactacggcagcagcgtggccagcgccaccgtgcacatcagaatggccttcctgagaaaggtgtacagcatcctgagcctgcaggtgctgctgaccaccgtgaccagcaccgtgttcctgtacttcgagagcgtgagaaccttcgtgcacgagagccccgccctgatcctgctgttcgccctgggcagcctgggcctgatcttcgccctgatcctgaacagacacaagtaccccctgaacctgtacctgctgttcggcttcaccctgctggaggccctgaccgtggccgtggtggtgaccttctacgacgtgtacatcatcctgcaggccttcatcctgaccaccaccgtgttcttcggcctgaccgtgtacaccctgcagagcaagaaggacttcagcaagttcggcgccggccagagcgccctgctggtggacatcgtgcccgtgagaatcctggaggtgttcttctacagcgagatcatggagctggtgctggccgccgccggcgccctgctgttctgcggcttcatcatctacgacacccacagcctgatgcacaagctgagccccaagagcacctactag

SEQ ID NO: 23064 - DNA, 852 bp, Artificial Sequence
  Description of Artificial Sequence: Synthetic coding sequence
atggccgacagaccccccgtgcccagcctgagcatcgaggacgacttcaactacggcagcagcgtggccagcgccaccgtgcacatcagaatggtgctgcagagagactgcaccttcagcaagcagtacatgagaatccccagcgcccccagcgccaccctgaacatcatcagattcttccacctgagacagagcggcagaagcggcatggtgaacatcttctacaagggccccaccttcctgagaaaggtgtacagcatcctgagcctgcaggtgctgctgaccaccgtgaccagcaccgtgttcctgtacttcgagagcgtgagaaccttcgtgcacgagagccccgccctgatcctgctgttcgccctgggcagcctgggcctgatcttcgccctgatcctgaacagacacaagtaccccctgaacctgtacctgctgttcggcttcaccctgctggaggccctgaccgtggccgtggtggtgaccttctacgacgtgtacatcatcctgcaggccttcatcctgaccaccaccgtgttcttcggcctgaccgtgtacaccctgcagagcaagaaggacttcagcaagttcggcgccggcctgttcgccctgctgtggatcctgtgcctgagcggcctggaggtgttcttctacagcgagatcatggagctggtgctggccgccgccggcgccctgctgttctgcggcttcatcatctacgacacccacagcctgatgcacaagctgagccccgaggagtacgtgctggccgccatcagcctgtacctggacatcatcaacctgttcctgcacctgctgagattcctggaggccgtgaacaagaagtag

SEQ ID NO: 23065 - DNA, 507 bp, Artificial Sequence
  Description of Artificial Sequence: Synthetic coding sequence
atggccgaccccgaccccagataccccagaagcagcatcgaggacgacttcaactacggcagcagcgtggccagcgccaccgtgcacatcagaatggccttcctgagaaaggtgtacagcatcctgagcctgcaggtgctgctgaccaccgtgaccagcaccgtgttcctgtacttcgagagcgtgagaaccttcgtgcacgagagccccgccctgatcctgctgttcgccctgggcagcctgggcctgatcttcgccctgatcctgaacagacacaagtaccccctgaacctgtacctgctgttcggcttcaccctgctggaggccctgaccgtggccgtggtggtgaccttctacgacgtgtacatcatcctgcaggccttcatcctgaccaccaccgtgttcttcggcctgaccgtgtacaccctgcagagcaagaaggacttcagcaagttcggcgccggcagatgcagaagccccagcttcctgtggatccaccacctgtag

SEQ ID NO: 23066 - DNA, 714 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgagcgccctgtacgccagaagaagaagctacctgttcctgggcggcatcctgatgagcgccctgagcctgctgctgctgagcagcctgggcaacgtgttcttcggcagcatctggctgttccaggccaacctgtacgtgggcctggtggtgatgtgcggcttcgtgctgttcgacacccagctgatcatcgagaaggccgagcacggcgaccaggactacatctggcactgcatcgacctgttcctggacttcatcaccgtgttcagaaagctgatgatgatcctggccatgaacgagaaggacaagaagaaggagaagaagtag

SEQ ID NO: 23067 - DNA, 714 bp, Artificial Sequence; identical to SEQ ID NO: 23066
  Description of Artificial Sequence: Synthetic coding sequence

SEQ ID NO: 23068 - DNA, 888 bp, Artificial Sequence
  Description of Artificial Sequence: Synthetic coding sequence
atgagccacagcagcgtgaccagagaggccccccagctgctgagccagagacagagaagagaggtgagaggcgtgtggggctggggctgcctgcccggccccagaggcggccccgccctgttcggcctggtgaccttcggccagagcggcgactgctgcaccgacagcggcaccatgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgagcgccctgtacgccagaagaagaagctacctgttcctgggcggcatcctgatgagcgccctgagcctgctgctgctgagcagcctgggcaacgtgttcttcggcagcatctggctgttccaggccaacctgtacgtgggcctggtggtgatgtgcggcttcgtgctgttcgacacccagctgatcatcgagaaggccgagcacggcgaccaggactacatctggcactgcatcgacctgttcctggacttcatcaccgtgttcagaaagctgatgatgatcctggccatgaacgagaaggacaagaagaaggagaagaagtag

SEQ ID NO: 23069 - DNA, 381 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccctgatcagcagctag

SEQ ID NO: 23070 - DNA, 714 bp, Artificial Sequence; identical to SEQ ID NO: 23066
  Description of Artificial Sequence: Synthetic coding sequence

SEQ ID NO: 23071 - DNA, 438 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgagcgccctgtacgccagaagaagaagctacctgttcctgggcggctag

SEQ ID NO: 23072 - DNA, 291 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggctag

SEQ ID NO: 23073 - DNA, 291 bp, Artificial Sequence; identical to SEQ ID NO: 23072
  Description of Artificial Sequence: Synthetic coding sequence

SEQ ID NO: 23074 - DNA, 417 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgagcgccctgtacgccagaagaagatag

SEQ ID NO: 23075 - DNA, 393 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgtag

SEQ ID NO: 23076 - DNA, 33 bp, Artificial Sequence
  Description of Artificial Sequence: Synthetic coding sequence
atgaacatcttcgacagaaagatcaacttctag

SEQ ID NO: 23077 - DNA, 36 bp, Artificial Sequence
  Description of Artificial Sequence: Synthetic coding sequence
atgaacatcttcgacagaaagatcaacttcgactag

SEQ ID NO: 23078 - DNA, 51 bp, Artificial Sequence
  Description of Artificial Sequence: Synthetic coding sequence
atgaacatcttcgacagaaagatcaacttcgacgccctgctgaagttctag

SEQ ID NO: 23079 - DNA, 270 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggcctag

SEQ ID NO: 23080 - DNA, 714 bp, Artificial Sequence; identical to SEQ ID NO: 23066
  Description of Artificial Sequence: Synthetic coding sequence

SEQ ID NO: 23081 - DNA, 291 bp, Artificial Sequence; identical to SEQ ID NO: 23072
  Description of Artificial Sequence: Synthetic coding sequence

SEQ ID NO: 23082 - DNA, 327 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgcctag

SEQ ID NO: 23083 - DNA, 438 bp, Artificial Sequence; identical to SEQ ID NO: 23071
  Description of Artificial Sequence: Synthetic coding sequence

SEQ ID NO: 23084 - DNA, 135 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggctag

SEQ ID NO: 23085 - DNA, 126 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggcctag

SEQ ID NO: 23086 - DNA, 618 bp, Artificial Sequence
  Description of Artificial Sequence: Synthetic coding sequence
atgaacatcttcgacagaaagatcaacttcgacgccctgctgaagttcagccacatcacccccagcacccagcagcacctgaagaaggtgtacgccagcttcgccctgtgcatgttcgtggccgccgccggcgcctacgtgcacatggtgacccacttcatccaggccggcctgctgagcgccctgggcagcctgatcctgatgatctggctgatggccaccccccacagccacgagaccgagcagaagagactgggcctgctggccggcttcgccttcctgaccggcgtgggcctgggccccgccctggagttctgcatcgccgtgaaccccagcatcctgcccaccgccttcatgggcaccgccatgatcttcacctgcttcaccctgagcgccctgtacgccagaagaagaagctacctgttcctgggcggcatcctgatgagcgccctgagcctgctgctgctgagcagcctgggcaacgtgttcttcggcagcatctggctgttccaggccaacctgtacgtgggcctggtggtgatgtgcggcttcgtgctgttcgacacccagctgatcatcgagaaggccgagcacggcgaccaggactacatctggtag

SEQ ID NO: 23087 - DNA, 888 bp, Artificial Sequence; identical to SEQ ID NO: 23068
  Description of Artificial Sequence: Synthetic coding sequence

SEQ ID NO: 23088 - DNA, 3303 bp, Artificial Sequence
  Description of Artificial Sequence: Synthetic coding sequence
atgaagaccagcaaggccagccagagatacagaggcatcagaagaaacgccagccagtgctacctgtaccaggagagcctgctgctgagcaacctggacgacagcttcagcgccgacgagaccggcgacagcaacgaccccgagcagatcttccagaacatccagttccagaaggacctgatggccaacatcagatgcagaccctggaccatgggccagaagctgagagccctgagacaggccaagaacatcgtgctgaagttcgagggcagactgaccagaaccagaggctaccaggccgccggcgccgagctgtggagaaagttcgccagactggcctgcaacttcgtggtgatcttcatcccctgggagatgagaatcaagaagatcgagagccacttcggcagcggcgtggccagctacttcatcttcctgagatggctgttcggcatcaacatcgtgctgaccatcatgaccggcgccttcatcgtgatccccgagctgatcgccggccagcccttcggcagcaccgccagaaagaccatccccaaggagcaggtgagcagcgcccaggacctggacaccgtgtggagcctgggcggctacctgcagtacagcgtgctgttctacggctactacggcagagagagaaagatcggcagagccggctacagactgcccctggcctacttcctggtgggcatggccgtgttcgcctacagcttcatcatcctgctgaagaagatggccaagaacagcagaaccagcctggccagcgccagcaacgagaactacaccttctgctggagagtgttctgcgcctgggactacctgatcggcaaccccgaggccgccgagagcaagaccgccgccatcgtgaacagcatcagagaggccatcctggaggagcaggagaagaagaagagcaagaacctggccgtgaccatctgcctgagaatcatcgccaacatcctggtgctgctgagcctggccggcagcatctacctgatctacttcgtggtggacagaagccagaagctggagcagagcaagaaggagctgaccctgtgggagaagaacgaggtgagcgtggtggtgagcctggtgaccatgatcgcccccagcgccttcgacctgatcgccgccctggagatgtaccaccccagaaccaccctgagattccagctggccagagtgctggtgctgtacctgggcaacctgtacagcctgatcatcgccctgctggacaaggtgaacagcatgagcatcgaggagatggccaccaagaacaacaccagccactggatcgacagcaccaccttcttcgccaccagaaccgcccccgaggaggagaagtggagcaccagcagacccggcatgggcctgagaagaaacaacacctgggccctggaggagaccagcatcagcgcctacaccatgcccctgatcaaggccaacaagaccagcctgcacacccagagcccccaggaccagtgctgggagacctacgtgggccaggagatgctgaagctgagcatcatcgacatgctgttcaccgtggccagcatcctgctgatcgacttcttcagaggcctgttcgtgagatacctgagcgactactggtgctgggacctggagagcaagttccccgagtacggcgagttcaagatcgccgagaacgtgctgcacctggtgtacaaccagggcatgatctggatgggcgccttcttcagcccctgcctgcccgccttcaacgtgctgaagctgatcggcctgatgtacctgagaagctgggccgtgctgacctgcaacgtgccccaccagcaggtgttcagagccagcagaagcaacaacttctacctggccatgctgctgttcatgctgttcctgtgcatgctgcccaccatcttcgccatcgtgagatacaagcccagcctgaactgcggccccttcagcggccaggagaagatctacgacatcgtgagcgagaccatcgagaaggacttccccgtgtggttcggcagcgtggtgggccacatcagcagccccgtggtgatcctgcccgccgtgctgctgctgttcatgctgatctactacctgcagagcatcgccagaagcctgaagctgagcaaccaccagctgaagatgcagatccagaacgccagaagcgaggacaagaagaaggtggcccagatggtggaggccagaatccagacccaggaggagagcaccaagaagctgcccaacgacagcgacctgaccagccagctgagcagcgcccacagcggcaccccccagaacaacggcaacgtggcccacttcgacagcggcagcagcaagagcggcagaatcgagaccgtggcccagagcatgccccagagccccagacccggcgacagagcccccagcagccccctgcccggcgtgcccaagagcagactggagcacgagaccaacagatacctgcacggcctgtgcgccagcaccagcgacctgcacagaaacagaagcagaacccccatgaccttcaccacccacatcgaggacgtgcacagcgagcccctgttcagaaaggacttccagcagatcaaccccccccacagaggcccccaggccagcaccctgctggcccagggccccagaccccacgcccccagatactacgtgatcaacgagtgcgacagctacaagaagaagcacctgaacgtgtggcccgagagacacttcaagatcgacgccagcggcgacatcgtggagctgtaccccagaaacgtgagacagtacgccagcagagtgcccagacagccccccagcccccagctgagcgaggaggaggaggagacccccagcagagactggatcaagagaagcctgccccccagaagcctgatcgacctgagaagagccccccacttctacatcggcgagagaagcgagagccagaccagagaccccgagcaccagggcagagtgcactacaagagctggaacgaggacttcgagggccacctggagagacccgcctacgtgcccagaaagcccagaagcagaaacttccagtacccccagccccccctgaagcccagaggcaagcccagattcgagcccagcctgaccgagagcgacagcgtgagcgccgccagcagcagcgaccagcagaacagcagcgccgaccagtacctgcaggtgacccacagccagggcagattccccagaagcgtgggccagcccagcagaagaaaggccaagagcggccaggagctgaccgtggacctggacgacctgatctgcagcgacgtgtag

SEQ ID NO: 23089 - DNA, 3306 bp, Artificial Sequence
  Description of Artificial Sequence: Synthetic coding sequence
atgaagaccagcaaggccagccagagatacagaggcatcagaagaaacgccagccagtgctacctgtaccaggagagcctgctgctgagcaacctggacgacagcttcagcgccgacgagaccggcgacagcaacgaccccgagcagatcttccagaacatccagttccagaaggacctgatggccaacatcagatgcagaccctggaccatgggccagaagctgagagccctgagacaggccaagaacatcgtgctgaagttcgagggcagactgaccagaaccagaggctaccaggccgccggcgccgagctgtggagaaagttcgccagactggcctgcaacttcgtggtgatcttcatcccctgggagatgagaatcaagaagatcgagagccacttcggcagcggcgtggccagctacttcatcttcctgagatggctgttcggcatcaacatcgtgctgaccatcatgaccggcgccttcatcgtgatccccgagctgatcgccggccagcccttcggcagcaccgccagaaagaccatccccaaggagcaggtgagcagcgcccaggacctggacaccgtgtggagcctgggcggctacctgcagtacagcgtgctgttctacggctactacggcagagagagaaagatcggcagagccggctacagactgcccctggcctacttcctggtgggcatggccgtgttcgcctacagcttcatcatcctgctgaagaagatggccaagaacagcagaaccagcctggccagcgccagcaacgagaactacaccttctgctggagagtgttctgcgcctgggactacctgatcggcaaccccgaggccgccgagagcaagaccgccgccatcgtgaacagcatcagagaggccatcctggaggagcaggagaagaagaagagcaagaacctggccgtgaccatctgcctgagaatcatcgccaacatcctggtgctgctgagcctggccggcagcatctacctgatctacttcgtggtggacagaagccagaagctggagcagagcaagaaggagctgaccctgtgggagaagaacgagcaggtgagcgtggtggtgagcctggtgaccatgatcgcccccagcgccttcgacctgatcgccgccctggagatgtaccaccccagaaccaccctgagattccagctggccagagtgctggtgctgtacctgggcaacctgtacagcctgatcatcgccctgctggacaaggtgaacagcatgagcatcgaggagatggccaccaagaacaacaccagccactggatcgacagcaccaccttcttcgccaccagaaccgcccccgaggaggagaagtggagcaccagcagacccggcatgggcctgagaagaaacaacacctgggccctggaggagaccagcatcagcgcctacaccatgcccctgatcaaggccaacaagaccagcctgcacacccagagcccccaggaccagtgctgggagacctacgtgggccaggagatgctgaagctgagcatcatcgacatgctgttcaccgtggccagcatcctgctgatcgacttcttcagaggcctgttcgtgagatacctgagcgactactggtgctgggacctggagagcaagttccccgagtacggcgagttcaagatcgccgagaacgtgctgcacctggtgtacaaccagggcatgatctggatgggcgccttcttcagcccctgcctgcccgccttcaacgtgctgaagctgatcggcctgatgtacctgagaagctgggccgtgctgacctgcaacgtgccccaccagcaggtgttcagagccagcagaagcaacaacttctacctggccatgctgctgttcatgctgttcctgtgcatgctgcccaccatcttcgccatcgtgagatacaagcccagcctgaactgcggccccttcagcggccaggagaagatctacgacatcgtgagcgagaccatcgagaaggacttccccgtgtggttcggcagcgtggtgggccacatcagcagccccgtggtgatcctgcccgccgtgctgctgctgttcatgctgatctactacctgcagagcatcgccagaagcctgaagctgagcaaccaccagctgaagatgcagatccagaacgccagaagcgaggacaagaagaaggtggcccagatggtggaggccagaatccagacccaggaggagagcaccaagaagctgcccaacgacagcgacctgaccagccagctgagcagcgcccacagcggcaccccccagaacaacggcaacgtggcccacttcgacagcggcagcagcaagagcggcagaatcgagaccgtggcccagagcatgccccagagccccagacccggcgacagagcccccagcagccccctgcccggcgtgcccaagagcagactggagcacgagaccaacagatacctgcacggcctgtgcgccagcaccagcgacctgcacagaaacagaagcagaacccccatgaccttcaccacccacatcgaggacgtgcacagcgagcccctgttcagaaaggacttccagcagatcaaccccccccacagaggcccccaggccagcaccctgctggcccagggccccagaccccacgcccccagatactacgtgatcaacgagtgcgacagctacaagaagaagcacctgaacgtgtggcccgagagacacttcaagatcgacgccagcggcgacatcgtggagctgtaccccagaaacgtgagacagtacgccagcagagtgcccagacagccccccagcccccagctgagcgaggaggaggaggagacccccagcagagactggatcaagagaagcctgccccccagaagcctgatcgacctgagaagagccccccacttctacatcggcgagagaagcgagagccagaccagagaccccgagcaccagggcagagtgcactacaagagctggaacgaggacttcgagggccacctggagagacccgcctacgtgcccagaaagcccagaagcagaaacttccagtacccccagccccccctgaagcccagaggcaagcccagattcgagcccagcctgaccgagagcgacagcgtgagcgccgccagcagcagcgaccagcagaacagcagcgccgaccagtacctgcaggtgacccacagccagggcagattccccagaagcgtgggccagcccagcagaagaaaggccaagagcggccaggagctgaccgtggacctggacgacctgatctgcagcgacgtgtag

SEQ ID NO: 23090 - DNA, 2121 bp, Artificial Sequence
  Description of Artificial Sequence: Synthetic coding sequence
atggaggagaaccccaccctggagagcgaggcctggggcagcagcagaggctggctggcccccagagaggccagaggcggccccagcctgagcagcgtgctgaacgagctgcccagcgccgccaccctgagatacagagaccccggcgtgctgccctggggcgccctggaggaggaggaggaggacggcggcagaagcagaaaggccttcaccgaggtgacccagaccgagctgcaggacccccaccccagcagagagctgccctggcccatgcaggccagaagagcccacagacagagaaacgccagcagagaccaggtggtgtacggcagcggcaccaagaccgacagatgggccagactgctgagaagaagcaaggagaagaccaaggagggcctgagaagcctgcagccctgggcctggaccctgaagagaatcggcggccagttcggcgccggcaccgagagctacttcagcctgctgagattcctgctgctgctgaacgtgctggccagcgtgctgatggcctgcatgaccctgctgcccacctggctgggcggcgccccccccggcccccccggccccgacatcagcagcccctgcggcagctacaacccccacagccagggcctggtgaccttcgccacccagctgttcaacctgctgagcggcgagggctacctggagtggagccccctgttctacggcttctacccccccagacccagactggccgtgacctacctgtgctgggccttcgccgtgggcctgatctgcctgctgctgatcctgcacagaagcgtgagcggcctgaagcagaccctgctggccgagagcgaggccctgaccagctacagccacagagtgttcagcgcctgggacttcggcctgtgcggcgacgtgcacgtgagactgagacagagaatcatcctgtacgagctgaaggtggagctggaggagaccgtggtgagaagacaggccgccgtgagaaccctgggccagcaggccagagtgtggctggtgagagtgctgctgaacctgctggtggtggccctgctgggcgccgccttctacggcgtgtactgggccaccggctgcaccgtggagctgcaggagatgcccctggtgcaggagctgcccctgctgaagctgggcgtgaactacctgcccagcatcttcatcgccggcgtgaacttcgtgctgccccccgtgttcaagctgatcgcccccctggagggctacaccagaagcagacagatcgtgttcatcctgctgagaaccgtgttcctgagactggccagcctggtggtgctgctgttcagcctgtggaaccagatcacctgcggcggcgacagcgaggccgaggactgcaagacctgcggctacaactacaagcagctgccctgctgggagaccgtgctgggccaggagatgtacaagctgctgctgttcgacctgctgaccgtgctggccgtggccctgctgatccagttccccagaaagctgctgtgcggcctgtgccccggcgccctgggcagactggccggcacccaggagttccaggtgcccgacgaggtgctgggcctgatctacgcccagaccgtggtgtgggtgggcagcttcttctgccccctgctgcccctgctgaacaccgtgaagttcctgctgctgttctacctgaagaagctgaccctgttcagcacctgcagccccgccgccagaaccttcagagccagcgccgccaacttcttcttccccctggtgctgctgctgggcctggccatcagcagcgtgcccctgctgtacagcatcttcctgatcccccccagcaagctgtgcggccccttcagaggccagagcagcatctgggcccagatccccgagagcatcagcagcctgcccgagaccacccagaacttcctgttcttcctgggcacccaggccttcgccgtgcccctgctgctgatcagcagcatcctgatggcctacaccgtggccctggccaacagctacggcagactgatcagcgagctgaagagacagagacagaccgaggcccagaacaaggtgttcctggccagaagagccgtggccctgaccagcaccaagcccgccctgtag

SEQ ID NO: 23091 - DNA, 2139 bp, Artificial Sequence
  Description of Artificial Sequence: Synthetic coding sequence
atggaggagaaccccaccctggagagcgaggcctggggcagcagcagaggctggctggcccccagagaggccagaggcgccccctgcagcagccccggccccagcctgagcagcgtgctgaacgagctgcccagcgccgccaccctgagatacagagaccccggcgtgctgccctggggcgccctggaggaggaggaggaggacggcggcagaagcagaaaggccttcaccgaggtgacccagaccgagctgcaggacccccaccccagcagagagctgccctggcccatgcaggccagaagagcccacagacagagaaacgccagcagagaccaggtggtgtacggcagcggcaccaagaccgacagatgggccagactgctgagaagaagcaaggagaagaccaaggagggcctgagaagcctgcagccctgggcctggaccctgaagagaatcggcggccagttcggcgccggcaccgagagctacttcagcctgctgagattcctgctgctgctgaacgtgctggccagcgtgctgatggcctgcatgaccctgctgcccacctggctgggcggcgccccccccggcccccccggccccgacatcagcagcccctgcggcagctacaacccccacagccagggcctggtgaccttcgccacccagctgttcaacctgctgagcggcgagggctacctggagtggagccccctgttctacggcttctacccccccagacccagactggccgtgacctacctgtgctgggccttcgccgtgggcctgatctgcctgctgctgatcctgcacagaagcgtgagcggcctgaagcagaccctgctggccgagagcgaggccctgaccagctacagccacagagtgttcagcgcctgggacttcggcctgtgcggcgacgtgcacgtgagactgagacagagaatcatcctgtacgagctgaaggtggagctggaggagaccgtggtgagaagacaggccgccgtgagaaccctgggccagcaggccagagtgtggctggtgagagtgctgctgaacctgctggtggtggccctgctgggcgccgccttctacggcgtgtactgggccaccggctgcaccgtggagctgcaggagatgcccctggtgcaggagctgcccctgctgaagctgggcgtgaactacctgcccagcatcttcatcgccggcgtgaacttcgtgctgccccccgtgttcaagctgatcgcccccctggagggctacaccagaagcagacagatcgtgttcatcctgctgagaaccgtgttcctgagactggccagcctggtggtgctgctgttcagcctgtggaaccagatcacctgcggcggcgacagcgaggccgaggactgcaagacctgcggctacaactacaagcagctgccctgctgggagaccgtgctgggccaggagatgtacaagctgctgctgttcgacctgctgaccgtgctggccgtggccctgctgatccagttccccagaaagctgctgtgcggcctgtgccccggcgccctgggcagactggccggcacccaggagttccaggtgcccgacgaggtgctgggcctgatctacgcccagaccgtggtgtgggtgggcagcttcttctgccccctgctgcccctgctgaacaccgtgaagttcctgctgctgttctacctgaagaagctgaccctgttcagcacctgcagccccgccgccagaaccttcagagccagcgccgccaacttcttcttccccctggtgctgctgctgggcctggccatcagcagcgtgcccctgctgtacagcatcttcctgatcccccccagcaagctgtgcggccccttcagaggccagagcagcatctgggcccagatccccgagagcatcagcagcctgcccgagaccacccagaacttcctgttcttcctgggcacccaggccttcgccgtgcccctgctgctgatcagcagcatcctgatggcctacaccgtggccctggccaacagctacggcagactgatcagcgagctgaagagacagagacagaccgaggcccagaacaaggtgttcctggccagaagagccgtggccctgaccagcaccaagcccgccctgtag

SEQ ID NO: 23092 - DNA, 885 bp, Artificial Sequence
  Description of Artificial Sequence: Synthetic coding sequence
atgaagggcggcggcggccagagagacgtgggcgccgacagaaccgtgttcctgagactggccagcctggtggtgctgctgttcagcctgtggaaccagatcacctgcggcggcgacagcgaggccgaggactgcaagacctgcggctacaactacaagcagctgccctgctgggagaccgtgctgggccaggagatgtacaagctgctgctgttcgacctgctgaccgtgctggccgtggccctgctgatccagttccccagaaagctgctgtgcggcctgtgccccggcgccctgggcagactggccggcacccaggagttccaggtgcccgacgaggtgctgggcctgatctacgcccagaccgtggtgtgggtgggcagcttcttctgccccctgctgcccctgctgaacaccgtgaagttcctgctgctgttctacctgaagaagctgaccctgttcagcacctgcagccccgccgccagaaccttcagagccagcgccgccaacttcttcttccccctggtgctgctgctgggcctggccatcagcagcgtgcccctgctgtacagcatcttcctgatcccccccagcaagctgtgcggccccttcagaggccagagcagcatctgggcccagatccccgagagcatcagcagcctgcccgagaccacccagaacttcctgttcttcctgggcacccaggccttcgccgtgcccctgctgctgatcagcagcatcctgatggcctacaccgtggccctggccaacagctacggcagactgatcagcgagctgaagagacagagacagaccgaggcccagaacaaggtgttcctggccagaagagccgtggccctgaccagcaccaagcccgccctgtag

SEQ ID NO: 23093 - DNA, 1377 bp, Artificial Sequence
  Description of Artificial Sequence: Synthetic coding sequence
atggccgcccagggcgccgccgccgccgtggccgccggcaccagcggcgtggccggcgagggcgagcccggccccggcgagaacgccgccgccgagggcaccgcccccagccccggcagagtgagcccccccacccccgccagaggcgagcccgaggtgaccgtggagatcggcgagacctacctgtgcagaagacccgacagcacctggcacagcgccgaggtgatccagagcagagtgaacgaccaggagggcagagaggagttctacgtgcactacgtgggcttcaacagaagactggacgagtgggtggacaagaacagactggccctgaccaagaccgtgaaggacgccgtgcagaagaacagcgagaagtacctgagcgagctggccgagcagcccgagagaaagatcaccagaaaccagaagagaaagcacgacgagatcaaccacgtgcagaagacctacgccgagatggaccccaccaccgccgccctggagaaggagcacgaggccatcaccaaggtgaagtacgtggacaagatccacatcggcaactacgagatcgacgcctggtacttcagccccttccccgaggactacggcaagcagcccaagctgtggctgtgcgagtactgcctgaagtacatgaagtacgagaagagctacagattccacctgggccagtgccagtggagacagccccccggcaaggagatctacagaaagagcaacatcagcgtgtacgaggtggacggcaaggaccacaagatctactgccagaacctgtgcctgctggccaagctgttcctggaccacaagaccctgtacttcgacgtggagcccttcgtgttctacatcctgaccgaggtggacagacagggcgcccacatcgtgggctacttcagcaaggagaaggagagccccgacggcaacaacgtggcctgcatcctgaccctgcccccctaccagagaagaggctacggcaagttcctgatcgccttcagctacgagctgagcaagctggagagcaccgtgggcagccccgagaagcccctgagcgacctgggcaagctgagctacagaagctactggagctgggtgctgctggagatcctgagagacttcagaggcaccctgagcatcaaggacctgagccagatgaccagcatcacccagaacgacatcatcagcaccctgcagagcctgaacatggtgaagtactggaagggccagcacgtgatctgcgtgacccccaagctggtggaggagcacctgaagagcgcccagtacaagaagccccccatcaccgtggacagcgtgtgcctgaagtgggccccccccaagcacaagcaggtgaagctgagcaagaagtag

SEQ ID NO: 23094 - DNA, 2847 bp, Artificial Sequence
  Description of Artificial Sequence: Synthetic coding sequence
atgagcgcctactacagaaacaactggagcgaggaggaccccgactaccccgactacagcggcagccagaacagaacccagggctacctgaagacccagggctaccccgacgtgcccggccccctgaacaaccccgactaccccggcaccagaagcaacccctacagcgtggccagcagaaccagacccgactaccccggcagcctggccgagcccaactaccccagaagcctgagcaaccccgactacagcggcaccagaagcaacgcctacagcgccgccagcagaaccagccccgaccaccccaccagcctgcccgagcccgactacagcgagttccagagccacccctaccacagagccagcagcagacagcccgactaccccggcagccagagaaaccccgacttcgccggcagcagcagcagcggcaactacgccggcagcagaacccaccccgaccacttcggcagcctggagcccgactaccccggcgcccagagcaacagcgaccaccccggccccagagccaacctgaaccaccccggcagcagaaagaacctggagcacaccagcttcagaatcaacccctacgccgacagcctgggcaagcccgactaccccggcgccgacatccagcccaacagcccccccttcttcggcgagcccgactaccccagcgccgaggacaaccagaacctgcccagcacctggagagagcccgactacagcgacgccgagaacggccacgactacggcagcagcgagacccccaagatgaccagaggcgtgctgagcagaaccagcagcatccagcccagcttcagacacagaagcgacgaccccgtgggcagcctgtggggcgagaacgactaccccgagggcatcgagatggccagcatggagatggccaacagctacggccacagcctgcccggcgcccccggcagcggctacgtgaaccccgcctacgtgggcgagagcggccccgtgcacgcctacggcaacccccccctgagcgagtgcgactggcacaagagcccccagggccagaagctgatcgccagcctgatccccatgaccagcagagacagaatcaaggccatcagaaaccagcccagaaccatggaggagaagagaaacctgagaaagatcgtggacaaggagaagagcaagcagacccacagaatcctgcagctgaactgctgcatccagtgcctgaacagcatcagcagagcctacagaagaagcaagaacagcctgagcgagatcctgaacagcatcagcctgtggcagaagaccctgaagatcatcggcggcaagttcggcaccagcgtgctgagctacttcaacttcctgagatggctgctgaagttcaacatcttcagcttcatcctgaacttcagcttcatcatcatcccccagttcaccgtggccaagaagaacaccctgcagttcaccggcctggagttcttcaccggcgtgggctacttcagagacaccgtgatgtactacggcttctacaccaacagcaccatccagcacggcaacagcggcgccagctacaacatgcagctggcctacatcttcaccatcggcgcctgcctgaccacctgcttcttcagcctgctgttcagcatggccaagtacttcagaaacaacttcatcaacccccacatctacagcggcggcatcaccaagctgatcttctgctgggacttcaccgtgacccacgagaaggccgtgaagctgaagcagaagaacctgagcaccgagatcagagagaacctgagcgagctgagacaggagaacagcaagctgaccttcaaccagctgctgaccagattcagcgcctacatggtggcctgggtggtgagcaccggcgtggccatcgcctgctgcgccgccgtgtactacctggccgagtacaacctggagttcctgaagacccacagcaaccccggcgccgtgctgctgctgcccttcgtggtgagctgcatcaacctggccgtgccctgcatctacagcatgttcagactggtggagagatacgagatgcccagacacgaggtgtacgtgctgctgatcagaaacatcttcctgaagatcagcatcatcggcatcctgtgctactactggctgaacaccgtggccctgagcggcgaggagtgctgggagaccctgatcggccaggacatctacagactgctgctgatggacttcgtgttcagcctggtgaacagcttcctgggcgagttcctgagaagaatcatcggcatgcagctgatcaccagcctgggcctgcaggagttcgacatcgccagaaacgtgctggagctgatctacgcccagaccctggtgtggatcggcatcttcttctgccccctgctgcccttcatccagatgatcatgctgttcatcatgttctacagcaagaacatcagcctgatgatgaacttccagccccccagcaaggcctggagagccagccagatgatgaccttcttcatcttcctgctgttcttccccagcttcaccggcgtgctgtgcaccctggccatcaccatctggagaatcatcacctacctgtactggcagatcaccgagggcagaaagatcatgatcagactgctgcacgagcagatcatcaacgagggcaaggacaagatgttcctgatcgagaagctgatcaagctgcaggacatggagaagaaggccaaccccagcagcctggtgctggagagaagagaggtggagcagcagggcttcctgcacctgggcgagcacgacggcagcctggacctgagaagcagaagaagcgtgcaggagggcaaccccagagcctag

SEQ ID NO: 23095 - DNA, 3021 bp, Artificial Sequence
  Description of Artificial Sequence: Synthetic coding sequence
atgagcgcctactacagaaacaactggagcgaggaggaccccgactaccccgactacagcggcagccagaacagaacccagggctacctgaagacccagggctaccccgacgtgcccggccccctgaacaaccccgactaccccggcaccagaagcaacccctacagcgtggccagcagaaccagacccgactaccccggcagcctggccgagcccaactaccccagaagcctgagcaaccccgactacagcggcaccagaagcaacgcctacagcgccgccagcagaaccagccccgaccaccccaccagcctgcccgagcccgactacagcgagttccagagccacccctaccacagagccagcagcagacagcccgactaccccggcagccagagaaaccccgacttcgccggcagcagcagcagcggcaactacgccggcagcagaacccaccccgaccacttcggcagcctggagcccgactaccccggcgcccagagcaacagcgaccaccccggccccagagccaacctgaaccaccccggcagcagaaagaacctggagcacaccagcttcagaatcaacccctacgccgacagcctgggcaagcccgactaccccggcgccgacatccagcccaacagcccccccttcttcggcgagcccgactaccccagcgccgaggacaaccagaacctgcccagcacctggagagagcccgactacagcgacgccgagaacggccacgactacggcagcagcgagacccccaagatgaccagaggcgtgctgagcagaaccagcagcatccagcccagcttcagacacagaagcgacgaccccgtgggcagcctgtggggcgagaacgactaccccgagggcatcgagatggccagcatggagatggccaacagctacggccacagcctgcccggcgcccccggcagcggctacgtgaaccccgcctacgtgggcgagagcggccccgtgcacgcctacggcaacccccccctgagcgagtgcgactggcacaagagcccccagggccagaagctgatcgccagcctgatccccatgaccagcagagacagaatcaaggccatcagaaaccagcccagaaccatggaggagaagagaaacctgagaaagatcgtggacaaggagaagagcaagcagacccacagaatcctgcagctgaactgctgcatccagtgcctgaacagcatcagcagagcctacagaagaagcaagaacagcctgagcgagatcctgaacagcatcagcctgtggcagaagaccctgaagatcatcggcggcaagttcggcaccagcgtgctgagctacttcaacttcctgagatggctgctgaagttcaacatcttcagcttcatcctgaacttcagcttcatcatcatcccccagttcaccgtggccaagaagaacaccctgcagttcaccggcctggagttcttcaccggcgtgggctacttcagagacaccgtgatgtactacggcttctacaccaacagcaccatccagcacggcaacagcggcgccagctacaacatgcagctggcctacatcttcaccatcggcgcctgcctgaccacctgcttcttcagcctgctgttcagcatggccaagtacttcagaaacaacttcatcaacccccacatctacagcggcggcatcaccaagctgatcttctgctgggacttcaccgtgacccacgagaaggccgtgaagctgaagcagaagaacctgagcaccgagatcagagagaacctgagcgagctgagacaggagaacagcaagctgaccttcaaccagctgctgaccagattcagcgcctacatggtggcctgggtggtgagcaccggcgtggccatcgcctgctgcgccgccgtgtactacctggccgagtacaacctggagttcctgaagacccacagcaaccccggcgccgtgctgctgctgcccttcgtggtgagctgcatcaacctggccgtgccctgcatctacagcatgttcagactggtggagagatacgagatgcccagacacgaggtgtacgtgctgctgatcagaaacatcttcctgaagatcagcatcatcggcatcctgtgctactactggctgaacaccgtggccctgagcggcgaggagtgctgggagaccctgatcggccaggacatctacagactgctgctgatggacttcgtgttcagcctggtgaacagcttcctgggcgagttcctgagaagaatcatcggcatgcagctgatcaccagcctgggcctgcaggagttcgacatcgccagaaacgtgctggagctgatctacgcccagaccctggtgtggatcggcatcttcttctgccccctgctgcccttcatccagatgatcatgctgttcatcatgttctacagcaagaacatcagcctgatgatgaacttccagccccccagcaaggcctggagagccagccagatgatgaccttcttcatcttcctgctgttcttccccagcttcaccggcgtgctgtgcaccctggccatcaccatctggagactgaagcccagcgccgactgcggccccttcagaggcctgcccctgttcatccacagcatctacagctggatcgacaccctgagcaccagacccggctacctgtgggtggtgtggatctacagaaacctgatcggcagcgtgcacttcttcttcatcctgaccctgatcgtgctgatcatcacctacctgtactggcagatcaccgagggcagaaagatcatgatcagactgctgcacgagcagatcatcaacgagggcaaggacaagatgttcctgatcgagaagctgatcaagctgcaggacatggagaagaaggccaaccccagcagcctggtgctggagagaagagaggtggagcagcagggcttcctgcacctgggcgagcacgacggcagcctggacctgagaagcagaagaagcgtgcaggagggcaaccccagagcctag

SEQ ID NO: 23096 - DNA, 2103 bp, Artificial Sequence
  Description of Artificial Sequence: Synthetic coding sequence
atgctgagcgacgaccacgtgaacgagatcatcatccagaagctgatcgccagcctgatccccatgaccagcagagacagaatcaaggccatcagaaaccagcccagaaccatggaggagaagagaaacctgagcagaggcggcctgaccatcaccaccgaggacgagggcagagccaaggcccacctgacctggtggaagatcgtggacaaggagaagagcaagcagacccacagaatcctgcagctgaactgctgcatccagtgcctgaacagcatcagcagagcctacagaagaagcaagaacagcctgagcgagatcctgaacagcatcagcctgtggcagaagaccctgaagatcatcggcggcaagttcggcaccagcgtgctgagctacttcaacttcctgagatggctgctgaagttcaacatcttcagcttcatcctgaacttcagcttcatcatcatcccccagttcaccgtggccaagaagaacaccctgcagttcaccggcctggagttcttcaccggcgtgggctacttcagagacaccgtgatgtactacggcttctacaccaacagcaccatccagcacggcaacagcggcgccagctacaacatgcagctggcctacatcttcaccatcggcgcctgcctgaccacctgcttcttcagcctgctgttcagcatggccaagtacttcagaaacaacttcatcaacccccacatctacagcggcggcatcaccaagctgatcttctgctgggacttcaccgtgacccacgagaaggccgtgaagctgaagcagaagaacctgagcaccgagatcagagagaacctgagcgagctgagacaggagaacagcaagctgaccttcaaccagctgctgaccagattcagcgcctacatggtggcctgggtggtgagcaccggcgtggccatcgcctgctgcgccgccgtgtactacctggccgagtacaacctggagttcctgaagacccacagcaaccccggcgccgtgctgctgctgcccttcgtggtgagctgcatcaacctggccgtgccctgcatctacagcatgttcagactggtggagagatacgagatgcccagacacgaggtgtacgtgctgctgatcagaaacatcttcctgaagatcagcatcatcggcatcctgtgctactactggctgaacaccgtggccctgagcggcgaggagtgctgggagaccctgatcggccaggacatctacagactgctgctgatggacttcgtgttcagcctggtgaacagcttcctgggcgagttcctgagaagaatcatcggcatgcagctgatcaccagcctgggcctgcaggagttcgacatcgccagaaacgtgctggagctgatctacgcccagaccctggtgtggatcggcatcttcttctgccccctgctgcccttcatccagatgatcatgctgttcatcatgttctacagcaagaacatcagcctgatgatgaacttccagccccccagcaaggcctggagagccagccagatgatgaccttcttcatcttcctgctgttcttccccagcttcaccggcgtgctgtgcaccctggccatcaccatctggagactgaagcccagcgccgactgcggccccttcagaggcctgcccctgttcatccacagcatctacagctggatcgacaccctgagcaccagacccggctacctgtgggtggtgtggatctacagaaacctgatcggcagcgtgcacttcttcttcatcctgaccctgatcgtgctgatcatcacctacctgtactggcagatcaccgagggcagaaagatcatgatcagactgctgcacgagcagatcatcaacgagggcaaggacaagatgttcctgatcgagaagctgatcaagctgcaggacatggagaagaaggccaaccccagcagcctggtgctggagagaagagaggtggagcagcagggcttctgcatctggggcaacatgatggccgtgctgacctgcgacctggaggaccagttcaagaaggtgatccagggccccgacgacagcttcggcaaccagacccccatcaagtag

SEQ ID NO: 23097 - DNA, 2865 bp, Artificial Sequence
  Description of Artificial Sequence: Synthetic coding sequence
atgagcgcctactacagaaacaactggagcgaggaggaccccgactaccccgactacagcggcagccagaacagaacccagggctacctgaagacccagggctaccccgacgtgcccggccccctgaacaaccccgactaccccggcaccagaagcaacccctacagcgtggccagcagaaccagacccgactaccccggcagcctggccgagcccaactaccccagaagcctgagcaaccccgactacagcggcaccagaagcaacgcctacagcgccgccagcagaaccagccccgaccaccccaccagcctgcccgagcccgactacagcgagttccagagccacccctaccacagagccagcagcagacagcccgactaccccggcagccagagaaaccccgacttcgccggcagcagcagcagcggcaactacgccggcagcagaacccaccccgaccacttcggcagcctggagcccgactaccccggcgcccagagcaacagcgaccaccccggccccagagccaacctgaaccaccccggcagcagaaagaacctggagcacaccagcttcagaatcaacccctacgccgacagcctgggcaagcccgactaccccggcgccgacatccagcccaacagcccccccttcttcggcgagcccgactaccccagcgccgaggacaaccagaacctgcccagcacctggagagagcccgactacagcgacgccgagaacggccacgactacggcagcagcgagacccccaagatgaccagaggcgtgctgagcagaaccagcagcatccagcccagcttcagacacagaagcgacgaccccgtgggcagcctgtggggcgagaacgactaccccgagggcatcgagatggccagcatggagatggccaacagctacggccacagcctgcccggcgcccccggcagcggctacgtgaaccccgcctacgtgggcgagagcggccccgtgcacgcctacggcaacccccccctgagcgagtgcgactggcacaagagcccccagggccagaagctgatcgccagcctgatccccatgaccagcagagacagaatcaaggccatcagaaaccagcccagaaccatggaggagaagagaaacctgagaaagatcgtggacaaggagaagagcaagcagacccacagaatcctgcagctgaactgctgcatccagtgcctgaacagcatcagcagagcctacagaagaagcaagaacagcctgagcgagatcctgaacagcatcagcctgtggcagaagaccctgaagatcatcggcggcaagttcggcaccagcgtgctgagctacttcaacttcctgagatggctgctgaagttcaacatcttcagcttcatcctgaacttcagcttcatcatcatcccccagttcaccgtggccaagaagaacaccctgcagttcaccggcctggagttcttcaccggcgtgggctacttcagagacaccgtgatgtactacggcttctacaccaacagcaccatccagcacggcaacagcggcgccagctacaacatgcagctggcctacatcttcaccatcggcgcctgcctgaccacctgcttcttcagcctgctgttcagcatggccaagtacttcagaaacaacttcatcaacccccacatctacagcggcggcatcaccaagctgatcttctgctgggacttcaccgtgacccacgagaaggccgtgaagctgaagcagaagaacctgagcaccgagatcagattcctgaagacccacagcaaccccggcgccgtgctgctgctgcccttcgtggtgagctgcatcaacctggccgtgccctgcatctacagcatgttcagactggtggagagatacgagatgcccagacacgaggtgtacgtgctgctgatcagaaacatcttcctgaagatcagcatcatcggcatcctgtgctactactggctgaacaccgtggccctgagcggcgaggagtgctgggagaccctgatcggccaggacatctacagactgctgctgatggacttcgtgttcagcctggtgaacagcttcctgggcgagttcctgagaagaatcatcggcatgcagctgatcaccagcctgggcctgcaggagttcgacatcgccagaaacgtgctggagctgatctacgcccagaccctggtgtggatcggcatcttcttctgccccctgctgcccttcatccagatgatcatgctgttcatcatgttctacagcaagaacatcagcctgatgatgaacttccagccccccagcaaggcctggagagccagccagatgatgaccttcttcatcttcctgctgttcttccccagcttcaccggcgtgctgtgcaccctggccatcaccatctggagactgaagcccagcgccgactgcggccccttcagaggcctgcccctgttcatccacagcatctacagctggatcgacaccctgagcaccagacccggctacctgtgggtggtgtggatctacagaaacctgatcggcagcgtgcacttcttcttcatcctgaccctgatcgtgctgatcatcacctacctgtactggcagatcaccgagggcagaaagatcatgatcagactgctgcacgagcagatcatcaacgagggcaaggacaagatgttcctgatcgagaagctgatcaagctgcaggacatggagaagaaggccaaccccagcagcctggtgctggagagaagagaggtggagcagcagggcttcctgcacctgggcgagcacgacggcagcctggacctgagaagcagaagaagcgtgcaggagggcaaccccagagcctag

SEQ ID NO: 23098 - DNA, 3021 bp, Artificial Sequence; identical to SEQ ID NO: 23095
  Description of Artificial Sequence: Synthetic coding sequence

SEQ ID NO: 23099 - DNA, 2172 bp, Artificial Sequence
  Description of Artificial Sequence: Synthetic coding sequence
atgagcgagagcagcggcagcgccctgcagcccggcagacccagcagacagcccgccgtgcaccccgagaacctgagcctggacagcagctgcttcagcagcccccccgtgaacttcctgcaggagctgcccagctacagaagcatcgccagaagaagaaccaccgtgcacagcagagacaagcagagcggcaccctgctgaagcccaccgacagctacagcagccagctggaggacagaatcgccgagaacctgagcagccacagcctgagaaactacgccctgaacatcagcgagaagagaagactgagagacatccaggagacccagatgaagtacctgagcgagtgggaccagtggaagagatacagcagcaagagctggaagagattcctggagaaggccagagagatgaccacccacctggagctgtggagagaggacatcagaagcatcgagggcaagttcggcaccggcatccagagctacttcagcttcctgagattcctggtgctgctgaacctggtgatcttcctgatcatcttcatgctggtgctgctgcccgtgctgctgaccaagtacaagatcaccaacagcagcttcgtgctgatccccttcaaggacatggacaagcagtgcaccgtgtaccccgtgagcagcagcggcctgatctacttctacagctacatcatcgacctgctgagcggcaccggcttcctggaggagaccagcctgttctacggccactacaccatcgacggcgtgaagttccagaacttcacctacgacctgcccctggcctacctgctgagcaccatcgccagcctggccctgagcctgctgtggatcgtgaagagaagcgtggagggcttcaagatcaacctgatcagaagcgaggagcacttccagagctactgcaacaagatcttcgccggctgggacttctgcatcaccaacagaagcatggccgacctgaagcacagcagcctgagatacgagctgagagccgacctggaggaggagagaatgagacagaagatcgccgagagaaccagcgaggagaccatcagaatctacagcctgagactgttcctgaactgcatcgtgctggccgtgctgggcgcctgcttctacgccatctacgtggccaccgtgttcagccaggagcacatgaagaaggagatcgacaagatggtgttcggcgagaacctgttcatcctgtacctgcccagcatcgtgatcaccctggccaacttcatcacccccatgatcttcgccaagatcatcagatacgaggactacagccccggcttcgagatcagactgaccatcctgagatgcgtgttcatgagactggccaccatctgcgtgctggtgttcaccctgggcagcaagatcaccagctgcgacgacgacacctgcgacctgtgcggctacaaccagaagctgtacccctgctgggagacccaggtgggccaggagatgtacaagctgatgatcttcgacttcatcatcatcctggccgtgaccctgttcgtggacttccccagaaagctgctggtgacctactgcagcagctgcaagctgatccagtgctggggccagcaggagttcgccatccccgacaacgtgctgggcatcgtgtacggccagaccatctgctggatcggcgccttcttcagccccctgctgcccgccatcgccaccctgaagttcatcatcatcttctacgtgaaggagtggagcctgctgtacacctgcagacccagccccagacccttcagagccagcaacagcaacttcttcttcctgctggtgctgctgatcggcctgtgcctggccatcatccccctgaccatcagcatcagcagaatccccagcagcaaggcctgcggccccttcaccaacttcaacaccacctgggaggtgatccccaagaccgtgagcaccttccccagcagcctgcagagcttcatccacggcgtgaccagcgaggccttcgccgtgcccttcttcatgatcatctgcctgatcatgttctacttcatcgccctggccggcgcccacaagagagtggtgatccagctgagagagcagctgagcctggagagcagagacaagtgctacctgatccagaagctgaccgaggcccagagagacatgagaaactag

SEQ ID NO: 23100 - DNA, 1842 bp, Artificial Sequence
  Description of Artificial Sequence: Synthetic coding sequence
atgaagtacctgagcgagtgggaccagtggaagagatacagcagcaagagctggaagagattcctggagaaggccagagagatgaccacccacctggagctgtggagagaggacatcagaagcatcgagggcaagttcggcaccggcatccagagctacttcagcttcctgagattcctggtgctgctgaacctggtgatcttcctgatcatcttcatgctggtgctgctgcccgtgctgctgaccaagtacaagatcaccaacagcagcttcgtgctgatccccttcaaggacatggacaagcagtgcaccgtgtaccccgtgagcagcagcggcctgatctacttctacagctacatcatcgacctgctgagcggcaccggcttcctggaggagaccagcctgttctacggccactacaccatcgacggcgtgaagttccagaacttcacctacgacctgcccctggcctacctgctgagcaccatcgccagcctggccctgagcctgctgtggatcgtgaagagaagcgtggagggcttcaagatcaacctgatcagaagcgaggagcacttccagagctactgcaacaagatcttcgccggctgggacttctgcatcaccaacagaagcatggccgacctgaagcacagcagcctgagatacgagctgagagccgacctggaggaggagagaatgagacagaagatcgccgagagaaccagcgaggagaccatcagaatctacagcctgagactgttcctgaactgcatcgtgctggccgtgctgggcgcctgcttctacgccatctacgtggccaccgtgttcagccaggagcacatgaagaaggagatcgacaagatggtgttcggcgagaacctgttcatcctgtacctgcccagcatcgtgatcaccctggccaacttcatcacccccatgatcttcgccaagatcatcagatacgaggactacagccccggcttcgagatcagactgaccatcctgagatgcgtgttcatgagactggccaccatctgcgtgctggtgttcaccctgggcagcaagatcaccagctgcgacgacgacacctgcgacctgtgcggctacaaccagaagctgtacccctgctgggagacccaggtgggccaggagatgtacaagctgatgatcttcgacttcatcatcatcctggccgtgaccctgttcgtggacttccccagaaagctgctggtgacctactgcagcagctgcaagctgatccagtgctggggccagcaggagttcgccatccccgacaacgtgctgggcatcgtgtacggccagaccatctgctggatcggcgccttcttcagccccctgctgcccgccatcgccaccctgaagttcatcatcatcttctacgtgaaggagtggagcctgctgtacacctgcagacccagccccagacccttcagagccagcaacagcaacttcttcttcctgctggtgctgctgatcggcctgtgcctggccatcatccccctgaccatcagcatcagcagaatccccagcagcaaggcctgcggccccttcaccaacttcaacaccacctgggaggtgatccccaagaccgtgagcaccttccccagcagcctgcagagcttcatccacggcgtgaccagcgaggccttcgccgtgcccttcttcatgatcatctgcctgatcatgttctacttcatcgccctggccggcgcccacaagagagtggtgatccagctgagagagcagctgagcctggagagcagagacaagtgctacctgatccagaagctgaccgaggcccagagagacatgagaaactag

SEQ ID NO: 23101 - DNA, 606 bp, Artificial Sequence
  Description of Artificial Sequence: Synthetic coding sequence
atggtgaccctggccgagctgctggtgctgctggccgccctgctggccaccgtgagcggctacttcgtgagcatcgacgcccacgccgaggagtgcttcttcgagagagtgaccagcggcaccaagatgggcctgatcttcgaggtggccgagggcggcttcctggacatcgacgtggagatcaccggccccgacaacaagggcatctacaagggcgacagagagagcagcggcaagtacaccttcgccgcccacatggacggcacctacaagttctgcttcagcaacagaatgagcaccatgacccccaagatcgtgatgttcaccatcgacatcggcgaggcccccaagggccaggacatggagaccgaggcccaccagaacaagctggaggagatgatcaacgagctggccgtggccatgaccgccgtgaagcacgagcaggagtacatggaggtgagagagagaatccacagagccatcaacgacaacaccaacagcagagtggtgctgtggagcttcttcgaggccctggtgctggtggccatgaccctgggccagatctactacctgaagagattcttcgaggtgagaagagtggtgtag

SEQ ID NO: 23102 - DNA, 510 bp, Artificial Sequence
  Description of Artificial Sequence: Synthetic coding sequence
atggtgaccctggccgagctgctggtgctgctggccgccctgctggccaccgtgagcggctacttcgtgagcatcgacgtggagatcaccggccccgacaacaagggcatctacaagggcgacagagagagcagcggcaagtacaccttcgccgcccacatggacggcacctacaagttctgcttcagcaacagaatgagcaccatgacccccaagatcgtgatgttcaccatcgacatcggcgaggcccccaagggccaggacatggagaccgaggcccaccagaacaagctggaggagatgatcaacgagctggccgtggccatgaccgccgtgaagcacgagcaggagtacatggaggtgagagagagaatccacagagccatcaacgacaacaccaacagcagagtggtgctgtggagcttcttcgaggccctggtgctggtggccatgaccctgggccagatctactacctgaagagattcttcgaggtgagaagagtggtgtag

SEQ ID NO: 23103 - DNA, 456 bp, Artificial Sequence
  Description of Artificial Sequence: Synthetic coding sequence
atggtgaccctggccgagctgctggtgctgctggccgccctgctggccaccgtgagcggctacttcgtgagcatcgacgcccacgccgaggagtgcttcttcgagagagtgaccagcggcaccaagatgggcctgatcttcgaggtggccgagggcggcttcctggacatcgacgtggagatcaccggccccgacaacaagggccaggacatggagaccgaggcccaccagaacaagctggaggagatgatcaacgagctggccgtggccatgaccgccgtgaagcacgagcaggagtacatggaggtgagagagagaatccacagagccatcaacgacaacaccaacagcagagtggtgctgtggagcttcttcgaggccctggtgctggtggccatgaccctgggccagatctactacctgaagagattcttcgaggtgagaagagtggtgtag

SEQ ID NO: 23104 - DNA, 654 bp, Artificial Sequence
  Description of Artificial Sequence: Synthetic coding sequence
atgggcagcaccgtgcccagaagcgccagcgtgctgctgctgctgctgctgctgagaagagccgagcagccctgcggcgccgagctgaccttcgagctgcccgacaacgccaagcagtgcttccacgaggaggtggagcagggcgtgaagttcagcctggactaccaggtgatcaccggcggccactacgacgtggactgctacgtggaggacccccagggcaacaccatctacagagagaccaagaagcagtacgacagcttcacctacagagccgaggtgaagggcgtgtaccagttctgcttcagcaacgagttcagcaccttcagccacaagaccgtgtacttcgacttccaggtgggcgacgagccccccatcctgcccgacatgggcaacagagtgaccgccctgacccagatggagagcgcctgcgtgaccatccacgaggccctgaagaccgtgatcgacagccagacccactacagactgagagaggcccaggacagagccagagccgaggacctgaacagcagagtgagctactggagcgtgggcgagaccatcgccctgttcgtggtgagcttcagccaggtgctgctgctgaagagcttcttcaccgagaagagacccatcagcagagccgtgcacagctag

SEQ ID NO: 23105 - DNA, 522 bp, Artificial Sequence
  Description of Artificial Sequence: Synthetic coding sequence
atgggcagcaccgtgcccagaagcgccagcgtgctgctgctgctgctgctgctgagaagagccgagcagccctgcggcgccgagctgaccttcgagctgcccgacaacgccaagcagtgcttccacgaggaggtggagcagggcgtgaagttcagcctggactaccaggtgatcaccggcggccactacgacgtggactgctacgtggaggacccccagggcaacaccatctacagagagaccaagaagcagtacgacagcttcacctacagagccgaggtgaagggcgtgtaccagttctgcttcagcaacgagttcagcaccttcagccacaagaccgtgtacttcgacttccaggtgggcgacgagccccccatcctgcccgacatgggcaacagagtgaccgccctgacccagagattcagaggcgcctactggaaggaggtggacaagatggtggactacatgcagcccggcggcacccccgccaccgagggcctgggcagactggcccccagctag

SEQ ID NO: 23106 - DNA, 489 bp, Artificial Sequence
  Description of Artificial Sequence: Synthetic coding sequence
atgggcgacaagatctggctgcccttccccgtgctgctgctggccgccctgccccccgtgctgctgcccggcgccgccggcttcacccccagcctggacagcgacttcaccttcaccctgcccgccggccagaaggagtgcttctaccagcccatgcccctgaaggccagcctggagatcgagtaccaggtgctggacggcgccggcctggacatcgacttccacctggccagccccgagggcaagaccctggtgttcgagcagagaaagagcgacggcgtgcacaccgtggagaccgaggtgggcgactacatgttctgcttcgacaacaccttcagcaccatcagcgagaaggtgatcttcttcgagctgatcctggacaacatgggcgagcaggcccaggagcaggaggactggaagaagtacatcaccggcaccgacatcctggacatgaagctggaggacatcctggtgagcatggtgttctag

SEQ ID NO: 23107 - DNA, 690 bp, Artificial Sequence
  Description of Artificial Sequence: Synthetic coding sequence
atgggcgacaagatctggctgcccttccccgtgctgctgctggccgccctgccccccgtgctgctgcccggcgccgccggcttcacccccagcctggacagcgacttcaccttcaccctgcccgccggccagaaggagtgcttctaccagcccatgcccctgaaggccagcctggagatcgagtaccaggtgctggacggcgccggcctggacatcgacttccacctggccagccccgagggcaagaccctggtgttcgagcagagaaagagcgacggcgtgcacaccgtggagaccgaggtgggcgactacatgttctgcttcgacaacaccttcagcaccatcagcgagaaggtgatcttcttcgagctgatcctggacaacatgggcgagcaggcccaggagcaggaggactggaagaagtacatcaccggcaccgacatcctggacatgaagctggaggacatcctggagagcatcaacagcatcaagagcagactgagcaagagcggccacatccagaccctgctgagagccttcgaggccagagacagaaacatccaggagagcaacttcgacagagtgaacttctggagcatggtgaacctggtggtgatggtggtggtgagcgccatccaggtgtacatgctgaagagcctgttcgaggacaagagaaagagcagaacctag

SEQ ID NO: 23108 - DNA, 582 bp, Artificial Sequence
  Description of Artificial Sequence: Synthetic coding sequence
atgggcgacaagatctggctgcccttccccgtgctgctgctggccgccctgccccccgtgctgctgcccggcgccgccggcttcacccccagcctggacagcgacttcaccttcaccctgcccgccggccagaaggagtgcttctaccagcccatgcccctgaaggccagcctggagatcgagtaccaggtgctggacggcgccggcctggacatcgacttccacctggccagccccgagggcaagaccctggtgttcgagcagagaaagagcgacggcgtgcacaccgtggagaccgaggtgggcgactacatgttctgcttcgacaacaccttcagcaccatcagcgagaaggtgatcttcttcgagctgatcctggacaacatgggcgagcaggcccaggagcaggaggactggaagaagtacatcaccggcaccgacatcctggacatgaagctggaggacatcctggaccccatcatcaagatcgccagcgacgtgcagatcagactgcacctgggcatccaccagcagcaccaggtgcagaccaagcagaagtgggcccacaccaacagcgcctag

SEQ ID NO: 23109 - DNA, 537 bp, Artificial Sequence
  Description of Artificial Sequence: Synthetic coding sequence
atgcccctgaaggccagcctggagatcgagtaccaggtgctggacggcgccggcctggacatcgacttccacctggccagccccgagggcaagaccctggtgttcgagcagagaaagagcgacggcgtgcacaccgtggagaccgaggtgggcgactacatgttctgcttcgacaacaccttcagcaccatcagcgagaaggtgatcttcttcgagctgatcctggacaacatgggcgagcaggcccaggagcaggaggactggaagaagtacatcaccggcaccgacatcctggacatgaagctggaggacatcctggagagcatcaacagcatcaagagcagactgagcaagagcggccacatccagaccctgctgagagccttcgaggccagagacagaaacatccaggagagcaacttcgacagagtgaacttctggagcatggtgaacctggtggtgatggtggtggtgagcgccatccaggtgtacatgctgaagagcctgttcgaggacaagagaaagagcagaacctag

SEQ ID NO: 23110 - DNA, 723 bp, Artificial Sequence
  Description of Artificial Sequence: Synthetic coding sequence
atgagccccctgctgttcggcgccggcctggtggtgctgaacctggtgaccagcgccagaagccagaagaccgagcccctgagcggcagcggcgaccagcccctgttcagaggcgccgacagatacgacttcgccatcatgatcccccccggcggcaccgagtgcttctggcagttcgcccaccagaccggctacttctacttcagctacgaggtgcagagaaccgtgggcatgagccacgacagacacgtggccgccaccgcccacaacccccagggcttcctgatcgacaccagccagggcgtgagaggccagatcaacttcagcacccaggagaccggcttctaccagctgtgcctgagcaaccagcacaaccacttcggcagcgtgcaggtgtacctgaacttcggcgtgttctacgagggccccgagaccgaccacaagcagaaggagagaaagcagctgaacgacaccctggacgccatcgaggacggcacccagaaggtgcagaacaacatcttccacatgtggagatactacaacttcgccagaatgagaaagatggccgacttcttcctgatccagagcaactacaactacgtgaactggtggagcaccgcccagagcctggtgatcatcctgagcggcatcctgcagctgtacttcctgaagagactgttcaacgtgcccaccaccaccgacaccaagaagcccagatgctag

SEQ ID NO: 23111 - DNA, 675 bp, Artificial Sequence
  Description of Artificial Sequence: Synthetic coding sequence
atgcccagacccggcagcgcccagagatgggccgccgtggccggcagatggggctgcagactgctggccctgctgctgctggtgcccggccccggcggcgccagcgagatcaccttcgagctgcccgacaacgccaagcagtgcttctacgaggacatcgcccagggcaccaagtgcaccctggagttccaggtgatcaccggcggccactacgacgtggactgcagactggaggaccccgacggcaaggtgctgtacaaggagatgaagaagcagtacgacagcttcaccttcaccgccagcaagaacggcacctacaagttctgcttcagcaacgagttcagcaccttcacccacaagaccgtgtacttcgacttccaggtgggcgaggacccccccctgttccccagcgagaacagagtgagcgccctgacccagatggagagcgcctgcgtgagcatccacgaggccctgaagagcgtgatcgactaccagacccacttcagactgagagaggcccagggcagaagcagagccgaggacctgaacaccagagtggcctactggagcgtgggcgaggccctgatcctgctggtggtgagcatcggccaggtgttcctgctgaagagcttcttcagcgacaagagaaccaccaccaccagagtgggcagctag

SEQ ID NO: 23112 - DNA, 249 bp, Artificial Sequence
  Description of Artificial Sequence: Synthetic coding sequence
atgcccagacccggcagcgcccagagatgggccgccgtggccggcagatggggctgcagactgctggccctgctgctgctggtgcccggccccggcggcgccagcgagatcaccttcgagctgcccgacaacgccaagcagtgcttctacgaggacatcgcccagggcaccaagtgcaccctggagttccaggtgatcaccggcggccactacgacgtggactgcagactggaggaccccgacggctag

SEQ ID NO: 23113 - DNA, 651 bp, Artificial Sequence
  Description of Artificial Sequence: Synthetic coding sequence
atgcaggccggcaagcccatcctgtacagctacttcagaagcagctgcagctggagagtgagaatcgccctggccctgaagggcatcgactacgagaccgtgcccatcaacctgatcaaggacggcggccagcagttcagcaaggacttccaggccctgaaccccatgaagcaggtgcccaccctgaagatcgacggcatcaccatccaccagagcctggccatcatcgagtacctggaggagatgagacccacccccagactgctgccccaggaccccaagaagagagccagcgtgagaatgatcagcgacctgatcgccggcggcatccagcccctgcagaacctgagcgtgctgaagcaggtgggcgaggagatgcagctgacctgggcccagaacgccatcacctgcggcttcaacgccctggagcagatcctgcagagcaccgccggcatctactgcgtgggcgacgaggtgaccatggccgacctgtgcctggtgccccaggtggccaacgccgagagattcaaggtggacctgaccccctaccccaccatcagcagcatcaacaagagactgctggtgctggaggccttccaggtgagccacccctgcagacagcccgacacccccaccgagctgagagcctag

SEQ ID NO: 23114 - DNA, 708 bp, Artificial Sequence
  Description of Artificial Sequence: Synthetic coding sequence
atggccgtggagctgggcgtgctgctggtgagacccagacccggcaccggcctgggcagagtgatgagaaccctgctgctggtgctgtggctggccaccagaggcagcgccctgtacttccacatcggcgagaccgagaagaagtgcttcatcgaggagatccccgacgagaccatggtgatcggcaactacagaacccagctgtacgacaagcagagagaggagtaccagcccgccacccccggcctgggcatgttcgtggaggtgaaggaccccgaggacaaggtgatcctggccagacagtacggcagcgagggcagattcaccttcaccagccacacccccggcgagcaccagatctgcctgcacagcaacagcaccaagttcagcctgttcgccggcggcatgctgagagtgcacctggacatccaggtgggcgagcacgccaacgactacgccgagatcgccgccaaggacaagctgagcgagctgcagctgagagtgagacagctggtggagcaggtggagcagatccagaaggagcagaactaccagagatggagagaggagagattcagacagaccagcgagagcaccaaccagagagtgctgtggtggagcatcctgcagaccctgatcctggtggccatcggcgtgtggcagatgagacacctgaagagcttcttcgaggccaagaagctggtgtag

SEQ ID NO: 23115 - DNA, 822 bp, Artificial Sequence
  Description of Artificial Sequence: Synthetic coding sequence
atgatcctgaagggctgcctgctgtaccccctgtgcagccccagaaacaagcagagatgcgccagactgtggaagatcgcctacggcggcctgctgaagatcgtgaccggcagcctgctgaccttctacgtggtgctgtgcctggacggcggcatggtgctgatgagaaagcaggtgcccagcagattcatgtaccccaaggagtggcagcacctgaccatgttcatcctgctgaccctgaacggctgcgtggacttcatgagcaagaacgtgctgccccagagatgcgtgggcctggagaagggcaccctggtgctgatcatctacgagctgctgctgctgatggtgagccacgtgaaggacagcgagggcgtggagctgcacgtgtacagcctgctgatcctggtggtgttcctgctgctgctggtgctgaccgccgagctgtgggcccccaacatgtgccacctgcagctgatggagaccttcctgatcctgatgatgggcagctggctgatgcaggccggcttcatcctgtacagacccgtgagcggctacccctggcaggacgacgacatcagcgacatcatgttcgtgaccaccttcttctgctggcacgtgatgatcaacgccagcttcctgctgggcatctacggcttcagcagcttctggtaccactgcttcagacccagcctgaagctgaccggccccaaggaggccccctactacgccagcacccccggccccctgtacaagctgctgcaggaggtggagcagagcgagaaggaggaccaggccctgctgctgcccaagagcagcccctag

SEQ ID NO: 23116 - DNA, 1338 bp, Artificial Sequence
  Description of Artificial Sequence: Synthetic coding sequence
atgaacgagagcccccagaccaacgagttcaagggcaccaccgaggaggcccccgccaaggagagcccccacaccagcgagttcaagggcgccgccctggtgagccccatcagcaagagaatcttcggcgtgttcctggtgctgctggacgtgaccctgctgctggccgacctgatcttcaccgacagcaagctgtacatccccctggagtacagaagcatcagcctggccatcggcctgttcttcctgatggacgtgctgctgagagtgttcgtggagggctggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcatcctgcacgacatcgagaccgacaagatcctgatcaacgtgtacgacggcccccccctgtacgacgacgtgaaggtgcagttcttcagcagcaacctgcccaagtactacgacaactgccccttcttcttctggttcaacaccagcttcatccagaacaacagactgtgcctgcccagaaacgagctggacaacccccacaagcagaaggcctggaagatctacccccccgagttcgccgtggagatcctgttcggcgagaagtag

SEQ ID NO: 23117 - DNA, 1467 bp, Artificial Sequence
  Description of Artificial Sequence: Synthetic coding sequence
atgaacaccagcccccagaccaacgagttcaagggcaccaccgaggaggcccccgccaaggagagcccccacaccagcgagttcaagggcgccgccctggtgagccccatcagcaagagcatgctggagagactgagcaagttcgaggtggaggacgccgagaacgtggccagctacgacagcaagatcaagaagatcgtgcacagcatcgtgagcagcttcgccttcggcatcttcggcgtgttcctggtgctgctggacgtgaccctgctgctggccgacctgatcttcaccgacagcaagctgtacatccccctggagtacagaagcatcagcctggccatcggcctgttcttcctgatggacgtgctgctgagagtgttcgtggagggcagacagcagtacttcagcgacctgttcaacatcctggacaccgccatcatcgtgatccccctgctggtggacgtgatctacatcttcttcgacatcaagctgctgagaaacatccccagatggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcatcctgcacgacatcgagaccgacaagatcctgatcaacgtgtacgacggcccccccctgtacgacgacgtgaaggtgcagttcttcagcagcagagccgagaagagagccgcccacagagccaactggaagggcgagcccagcagaagacccgtgctggactag

SEQ ID NO: 23118 - DNA, 1449 bp, Artificial Sequence
  Description of Artificial Sequence: Synthetic coding sequence
atgaacgagagcccccagaccaacgagttcaagggcaccaccgaggaggcccccgccaaggagagcccccacaccagcgagttcaagggcgccgccctggtgagccccatcagcaagagcatgctggagagactgagcaagttcgaggtggaggacgccgagaacgtggccagctacgacagcaagatcaagaagatcgtgcacagcatcgtgagcagcttcgccttcggcatcttcggcgtgttcctggtgctgctggacgtgaccctgctgctggccgacctgatcttcaccgacagcaagctgtacatccccctggagtacagaagcatcagcctggccatcggcctgttcttcctgatggacgtgctgctgagagtgttcgtggagggctggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcatcctgcacgacatcgagaccgacaagatcctgatcaacgtgtacgacggcccccccctgtacgacgacgtgaaggtgcagttcttcagcagcaacctgcccaagtactacgacaactgccccttcttcttctggttcaacaccagcttcatccagaacaacagactgtgcctgcccagaaacgagctggacaacccccacaagcagaaggcctggaagatctacccccccgagttcgccgtggagatcctgttcggcgagaagtag

SEQ ID NO: 23119 - DNA, 1569 bp, Artificial Sequence
  Description of Artificial Sequence: Synthetic coding sequence
atgaacgagagcccccagaccaacgagttcaagggcaccaccgaggaggcccccgccaaggagagcccccacaccagcgagttcaagggcgccgccctggtgagccccatcagcaagagcatgctggagagactgagcaagttcgaggtggaggacgccgagaacgtggccagctacgacagcaagatcaagaagatcgtgcacagcatcgtgagcagcttcgccttcggcatcttcggcgtgttcctggtgctgctggacgtgaccctgctgctggccgacctgatcttcaccgacagcaagctgtacatccccctggagtacagaagcatcagcctggccatcggcctgttcttcctgatggacgtgctgctgagagtgttcgtggagggcagacagcagtacttcagcgacctgttcaacatcctggacaccgccatcatcgtgatccccctgctggtggacgtgatctacatcttcttcgacatcaagctgctgagaaacatccccagatggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcatcctgcacgacatcgagaccgacaagatcctgatcaacgtgtacgacggcccccccctgtacgacgacgtgaaggtgcagttcttcagcagcaacctgcccaagtactacgacaactgccccttcttcttctggttcaacaccagcttcatccagaacaacagactgtgcctgcccagaaacgagctggacaacccccacaagcagaaggcctggaagatctacccccccgagttcgccgtggagatcctgttcggcgagaagtag

SEQ ID NO: 23120 - DNA, 1338 bp, Artificial Sequence; identical to SEQ ID NO: 23116
  Description of Artificial Sequence: Synthetic coding sequence

SEQ ID NO: 23121 - DNA, 1236 bp, Artificial Sequence
  Description of Artificial Sequence: Synthetic coding sequence
atgaacgagagcccccagaccaacgagttcaagggcaccaccgaggaggcccccgccaaggagagcccccacaccagcgagttcaagggcgccgccctggtgagccccatcagcaagagcatgctggagagactgagcaagttcgaggtggaggacgccgagaacgtggccagctacgagtggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcatcctgcacgacatcgagaccgacaagatcctgatcaacgtgtacgacggcccccccctgtacgacgacgtgaaggtgcagttcttcagcagcaacctgcccaagtactacgacaactgccccttcttcttctggttcaacaccagcttcatccagaacaacagactgtgcctgcccagaaacgagctggacaacccccacaagcagaaggcctggaagatctacccccccgagttcgccgtggagatcctgttcggcgagaagtag

SEQ ID NO: 23122 - DNA, 1569 bp, Artificial Sequence; identical to SEQ ID NO: 23119
  Description of Artificial Sequence: Synthetic coding sequence

SEQ ID NO: 23123 - DNA, 975 bp, Artificial Sequence
  Description of Artificial Sequence: Synthetic coding sequence
atgaacgagagcccccagaccaacgagttcaagggcaccaccgaggaggcccccgccaaggagagcccccacaccagcgagttcaagggcgccgccctggtgagccccatcagcaagagatggacccacctggtgagactgctgagactgatcatcctgatcagaatcttccacctgctgcaccagaagagacagctggagaagctgatgagaagactggtgagcgagaacaagagaagatacaccagagacggcttcgacctggacctgacctacgtgaccgagagaatcatcgccatgagcttccccagcagcggcagacagagcttctacagaaaccccatcgaggaggtggtgagattcctggacaagaagcacagaaaccactacagagtgtacaacctgtgcagcgagagagcctacgaccccaagcacttccacaacagagtgagcagaatcatgatcgacgaccacaacgtgcccaccctgcacgagatggtggtgttcaccaaggaggtgaacgagtggatggcccaggacctggagaacatcgtggccatccactgcaagggcggcaagggcagaaccggcaccatggtgtgcgccctgctgatcgccagcgagatcttcctgaccgccgaggagagcctgtactacttcggcgagagaagaaccaacaagacccacagcaacaagttccagggcgtggagacccccagccagaacagatacgtgggctacttcgcccaggtgaagcacctgtacaactggaacctgccccccagaagaatcctgttcatcaagagattcatcatctacagcatcagaggcgacgtgtgcgacctgaaggtgcaggtggtgatggagaagaaggtggtgttcagcagcaccagcctgggcaactgcagcagagaggagggcagcaccagagccaactggaagggcgagcccagcagaagacccgtgctggactag

SEQ ID NO: 23124 - DNA, 1236 bp, Artificial Sequence; identical to SEQ ID NO: 23121
  Description of Artificial Sequence: Synthetic coding sequence

SEQ ID NO: 23125 - DNA, 1257 bp, Artificial Sequence
  Description of Artificial Sequence: Synthetic coding sequence
atgtacagacccgccagagtgaccagcaccagcagattcctgaacccctacgtggtgtgcttcatcgtggtggccggcgtggtgatcctggccgtgaccatcgccctgctggtgtacttcctggccttcgaccagaagagctacttctacagaagcagcttccagctgctgaacgtggagtacaacagccagctgaacagccccgccacccaggagtacagaaccctgagcggcagaatcgagagcctgatcaccaagaccttcaaggagagcaacctgagaaaccagttcatcagagcccacgtggccaagctgagacaggacggcagcggcgtgagagccgacgtggtgatgaagttccagttcaccagaaacaacaacggcgccagcatgaagagcagaatcgagagcgtgctgagacagatgctgaacaacagcggcaacctggagatcaaccccagcaccgagatcaccagcctgaccgaccaggccgccgccaactggctgatcaacgagtgcggcgccggccccgacctgatcaccctgagcgagcagagaatcctgggcggcaccgaggccgaggagggcagctggccctggcaggtgagcctgagactgaacaacgcccaccactgcggcggcagcctgatcaacaacatgtggatcctgaccgccgcccactgcttcagaagcaacagcaaccccagagactggatcgccaccagcggcatcagcaccaccttccccaagctgagaatgagagtgagaaacatcctgatccacaacaactacaagagcgccacccacgagaacgacatcgccctggtgagactggagaacagcgtgaccttcaccaaggacatccacagcgtgtgcctgcccgccgccacccagaacatcccccccggcagcaccgcctacgtgaccggctggggcgcccaggagtacgccggccacaccgtgcccgagctgagacagggccaggtgagaatcatcagcaacgacgtgtgcaacgccccccacagctacaacggcgccatcctgagcggcatgctgtgcgccggcgtgccccagggcggcgtggacgcctgccagggcgacagcggcggccccctggtgcaggaggacagcagaagactgtggttcatcgtgggcatcgtgagctggggcgaccagtgcggcctgcccgacaagcccggcgtgtacaccagagtgaccgcctacctggactggatcagacagcagaccggcatctag

SEQ ID NO: 23126 - DNA, 906 bp, Artificial Sequence
  Description of Artificial Sequence: Synthetic coding sequence
atgaagttccagttcaccagaaacaacaacggcgccagcatgaagagcagaatcgagagcgtgctgagacagatgctgaacaacagcggcaacctggagatcaaccccagcaccgagatcaccagcctgaccgaccaggccgccgccaactggctgatcaacgagtgcggcgccggccccgacctgatcaccctgagcgagcagagaatcctgggcggcaccgaggccgaggagggcagctggccctggcaggtgagcctgagactgaacaacgcccaccactgcggcggcagcctgatcaacaacatgtggatcctgaccgccgcccactgcttcagaagcaacagcaaccccagagactggatcgccaccagcggcatcagcaccaccttccccaagctgagaatgagagtgagaaacatcctgatccacaacaactacaagagcgccacccacgagaacgacatcgccctggtgagactggagaacagcgtgaccttcaccaaggacatccacagcgtgtgcctgcccgccgccacccagaacatcccccccggcagcaccgcctacgtgaccggctggggcgcccaggagtacgccggccacaccgtgcccgagctgagacagggccaggtgagaatcatcagcaacgacgtgtgcaacgccccccacagctacaacggcgccatcctgagcggcatgctgtgcgccggcgtgccccagggcggcgtggacgcctgccagggcgacagcggcggccccctggtgcaggaggacagcagaagactgtggttcatcgtgggcatcgtgagctggggcgaccagtgcggcctgcccgacaagcccggcgtgtacaccagagtgaccgcctacctggactggatcagacagcagaccggcatctag

SEQ ID NO: 23127 - DNA, 3060 bp, Artificial Sequence
  Description of Artificial Sequence: Synthetic coding sequence
atgggcagcaagagaggcatcagcagcagacaccacagcctgagcagctacgagatcatgttcgccgccctgttcgccatcctggtggtgctgtgcgccggcctgatcgccgtgagctgcctgaccatcaaggagagccagagaggcgccgccctgggccagagccacgaggccagagccaccttcaagatcaccagcggcgtgacctacaaccccaacctgcaggacaagctgagcgtggacttcaaggtgctggccttcgacctgcagcagatgatcgacgagatcttcctgagcagcaacctgaagaacgagtacaagaacagcagagtgctgcagttcgagaacggcagcatcatcgtggtgttcgacctgttcttcgcccagtgggtgagcgacgagaacgtgaaggaggagctgatccagggcctggaggccaacaagagcagccagctggtgaccttccacatcgacctgaacagcgtggacatcctggacaagctgaccaccaccagccacctggccacccccggcaacgtgagcatcgagtgcctgcccggcagcagcccctgcaccgacgccctgacctgcatcaaggccgacctgttctgcgacggcgaggtgaactgccccgacggcagcgacgaggacaacaagatgtgcgccaccgtgtgcgacggcagattcctgctgaccggcagcagcggcagcttccaggccacccactaccccaagcccagcgagaccagcgtggtgtgccagtggatcatcagagtgaaccagggcctgagcatcaagctgagcttcgacgacttcaacacctactacaccgacatcctggacatctacgagggcgtgggcagcagcaagatcctgagagccagcatctgggagaccaaccccggcaccatcagaatcttcagcaaccaggtgaccgccaccttcctgatcgagagcgacgagagcgactacgtgggcttcaacgccacctacaccgccttcaacagcagcgagctgaacaactacgagaagatcaactgcaacttcgaggacggcttctgcttctgggtgcaggacctgaacgacgacaacgagtgggagagaatccagggcagcaccttcagccccttcaccggccccaacttcgaccacaccttcggcaacgccagcggcttctacatcagcacccccaccggccccggcggcagacaggagagagtgggcctgctgagcctgcccctggaccccaccctggagcccgcctgcctgagcttctggtaccacatgtacggcgagaacgtgcacaagctgagcatcaacatcagcaacgaccagaacatggagaagaccgtgttccagaaggagggcaactacggcgacaactggaactacggccaggtgaccctgaacgagaccgtgaagttcaaggtggccttcaacgccttcaagaacaagatcctgagcgacatcgccctggacgacatcagcctgacctacggcatctgcaacggcagcctgtaccccgagcccaccctggtgcccacccccccccccgagctgcccaccgactgcggcggccccttcgagctgtgggagcccaacaccaccttcagcagcaccaacttccccaacagctaccccaacctggccttctgcgtgtggatcctgaacgcccagaagggcaagaacatccagctgcacttccaggagttcgacctggagaacatcaacgacgtggtggagatcagagacggcgaggaggccgacagcctgctgctggccgtgtacaccggccccggccccgtgaaggacgtgttcagcaccaccaacagaatgaccgtgctgctgatcaccaacgacgtgctggccagaggcggcttcaaggccaacttcaccaccggctaccacctgggcatccccgagccctgcaaggccgaccacttccagtgcaagaacggcgagtgcgtgcccctggtgaacctgtgcgacggccacctgcactgcgaggacggcagcgacgaggccgactgcgtgagattcttcaacggcaccaccaacaacaacggcctggtgagattcagaatccagagcatctggcacaccgcctgcgccgagaactggaccacccagatcagcaacgacgtgtgccagctgctgggcctgggcagcggcaacagcagcaagcccatcttccccaccgacggcggccccttcgtgaagctgaacaccgcccccgacggccacctgatcctgacccccagccagcagtgcctgcaggacagcctgatcagactgcagtgcaaccacaagagctgcggcaagaagctggccgcccaggacatcacccccaagatcgtgggcggcagcaacgccaaggagggcgcctggccctgggtggtgggcctgtactacggcggcagactgctgtgcggcgccagcctggtgagcagcgactggctggtgagcgccgcccactgcgtgtacggcagaaacctggagcccagcaagtggaccgccatcctgggcctgcacatgaagagcaacctgaccagcccccagaccgtgcccagactgatcgacgagatcgtgatcaacccccactacaacagaagaagaaaggacaacgacatcgccatgatgcacctggagttcaaggtgaactacaccgactacatccagcccatctgcctgcccgaggagaaccaggtgttcccccccggcagaaactgcagcatcgccggctggggcaccgtggtgtaccagggcaccaccgccaacatcctgcaggaggccgacgtgcccctgctgagcaacgagagatgccagcagcagatgcccgagtacaacatcaccgagaacatgatctgcgccggctacgaggagggcggcatcgacagctgccagggcgacagcggcggccccctgatgtgccaggagaacaacagatggttcctggccggcgtgaccagcttcggctacaagtgcgccctgcccaacagacccggcgtgtacgccagagtgagcagattcaccgagtggatccagagcttcctgcactag

SEQ ID NO: 23128 - DNA, 2154 bp, Artificial Sequence
  Description of Artificial Sequence: Synthetic coding sequence
atgttcagaatcaccaacatcgagttcctgcccgagtacagacagaaggagagcagagagttcctgagcgtgagcagaaccgtgcagcaggtgatcaacctggtgtacaccaccagcgccttcagcaagttctacgagcagagcgtggtggccgacgtgagcaacaacaagggcggcctgctggtgcacttctggatcgtgttcgtgatgcccagagccaagggccacatcttctgcgaggactgcgtggccgccatcctgaaggacagcatccagaccagcatcatcaacagaaccagcgtgggcagcctgcagggcctggccgtggacatggacagcgtggtgctgaacgacaagggctgcagccagtacttctacgccgagcacctgagcctgcactaccccctggagatcagcgccgccagcggcagactgatgtgccacttcaagctggtggccatcgtgggctacctgatcagactgagcatcaagagcatccagatcgaggccgacaactgcgtgaccgacagcctgaccatctacgacagcctgctgcccatcagaagcagcatcctgtacagaatctgcgagcccaccagaaccctgatgagcttcgtgagcaccaacaacctgatgctggtgaccttcaagagcccccacatcagaagactgagcggcatcagagcctacttcgaggtgatccccgagcagaagtgcgagaacaccgtgctggtgaaggacatcaccggcttcgagggcaagatcagcagcccctactaccccagctactacccccccaagtgcaagtgcacctggaagttccagaccagcctgagcaccctgggcatcgccctgaagttctacaactacagcatcaccaagaagagcatgaagggctgcgagcacggctggtgggagatcaacgagcacatgtactgcggcagctacatggaccaccagaccatcttcagagtgcccagccccctggtgcacatccagctgcagtgcagcagcagactgagcgacaagcccctgctggccgagtacggcagctacaacatcagccagccctgccccgtgggcagcttcagatgcagcagcggcctgtgcgtgccccaggcccagagatgcgacggcgtgaacgactgcttcgacgagagcgacgagctgttctgcgtgagcccccagcccgcctgcaacaccagcagcttcagacagcacggccccctgatctgcgacggcttcagagactgcgagaacggcagagacgagcagaactgcacccagagcatcccctgcaacaacagaaccttcaagtgcggcaacgacatctgcttcagaaagcagaacgccaagtgcgacggcaccgtggactgccccgacggcagcgacgaggagggctgcacctgcagcagaagcagcagcgccctgcacagaatcatcggcggcaccgacaccctggagggcggctggccctggcaggtgagcctgcacttcgtgggcagcgcctactgcggcgccagcgtgatcagcagagagtggctgctgagcgccgcccactgcttccacggcaacagactgagcgaccccaccccctggaccgcccacctgggcatgtacgtgcagggcaacgccaagttcgtgagccccgtgagaagaatcgtggtgcacgagtactacaacagccagaccttcgactacgacatcgccctgctgcagctgagcatcgcctggcccgagaccctgaagcagctgatccagcccatctgcatcccccccaccggccagagagtgagaagcggcgagaagtgctgggtgaccggctggggcagaagacacgaggccgacaacaagggcagcctggtgctgcagcaggccgaggtggagctgatcgaccagaccctgtgcgtgagcacctacggcatcatcaccagcagaatgctgtgcgccggcatcatgagcggcaagagagacgcctgcaagggcgacagcggcggccccctgagctgcagaagaaagagcgacggcaagtggatcctgaccggcatcgtgagctggggccacggcagcggcagacccaacttccccggcgtgtacaccagagtgagcaacttcgtgccctggatccacaagtacgtgcccagcctgctgtag

SEQ ID NO: 23129 - DNA, 2454 bp, Artificial Sequence
  Description of Artificial Sequence: Synthetic coding sequence
atggacaaggagaacagcgacgtgagcgccgcccccgccgacctgaagatcagcaacatcagcgtgcaggtggtgagcgcccagaagaagctgccccccggcagaagacccccccagagacccatcggcaaggccaagcccaagaagcagagcaagaagaaggtgcccttctggaacgtgcagaacaagatcatcctgttcaccgtgttcctgttcatcctggccgtgatcgcctggaccctgctgtggctgtacatcagcaagaccgagagcaaggacgccttctacttcgccggcatgttcagaatcaccaacatcgagttcctgcccgagtacagacagaaggagagcagagagttcctgagcgtgagcagaaccgtgcagcaggtgatcaacctggtgtacaccaccagcgccttcagcaagttctacgagcagagcgtggtggccgacgtgagcagcaacaacaagggcggcctgctggtgcacttctggatcgtgttcgtgatgcccagagccaagggccacatcttctgcgaggactgcgtggccgccatcctgaaggacagcatccagaccagcatcatcaacagaaccagcgtgggcagcctgcagggcctggccgtggacatggacagcgtggtgctgaacgacaagggctgcagccagtacttctacgccgagcacctgagcctgcactaccccctggagatcagcgccgccagcggcagactgatgtgccacttcaagctggtggccatcgtgggctacctgatcagactgagcatcaagagcatccagatcgaggccgacaactgcgtgaccgacagcctgaccatctacgacagcctgctgcccatcagaagcagcatcctgtacagaatctgcgagcccaccagaaccctgatgagcttcgtgagcaccaacaacctgatgctggtgaccttcaagagcccccacatcagaagactgagcggcatcagagcctacttcgaggtgatccccgagcagaagtgcgagaacaccgtgctggtgaaggacatcaccggcttcgagggcaagatcagcagcccctactaccccagctactacccccccaagtgcaagtgcacctggaagttccagaccagcctgagcaccctgggcatcgccctgaagttctacaactacagcatcaccaagaagagcatgaagggctgcgagcacggctggtgggagatcaacgagcacatgtactgcggcagctacatggaccaccagaccatcttcagagtgcccagccccctggtgcacatccagctgcagtgcagcagcagactgagcgacaagcccctgctggccgagtacggcagctacaacatcagccagccctgccccgtgggcagcttcagatgcagcagcggcctgtgcgtgccccaggcccagagatgcgacggcgtgaacgactgcttcgacgagagcgacgagctgttctgcgtgagcccccagcccgcctgcaacaccagcagcttcagacagcacggccccctgatctgcgacggcttcagagactgcgagaacggcagagacgagcagaactgcacccagagcatcccctgcaacaacagaaccttcaagtgcggcaacgacatctgcttcagaaagcagaacgccaagtgcgacggcaccgtggactgccccgacggcagcgacgaggagggctgcacctgcagcagaagcagcagcgccctgcacagaatcatcggcggcaccgacaccctggagggcggctggccctggcaggtgagcctgcacttcgtgggcagcgcctactgcggcgccagcgtgatcagcagagagtggctgctgagcgccgcccactgcttccacggcaacagactgagcgaccccaccccctggaccgcccacctgggcatgtacgtgcagggcaacgccaagttcgtgagccccgtgagaagaatcgtggtgcacgagtactacaacagccagaccttcgactacgacatcgccctgctgcagctgagcatcgcctggcccgagaccctgaagcagctgatccagcccatctgcatcccccccaccggccagagagtgagaagcggcgagaagtgctgggtgaccggctggggcagaagacacgaggccgacaacaagggcagcctggtgctgcagcaggccgaggtggagctgatcgaccagaccctgtgcgtgagcacctacggcatcatcaccagcagaatgctgtgcgccggcatcatgagcggcaagagagacgcctgcaagggcgacagcggcggccccctgagctgcagaagaaagagcgacggcaagtggatcctgaccggcatcgtgagctggggccacggcagcggcagacccaacttccccggcgtgtacaccagagtgagcaacttcgtgccctggatccacaagtacgtgcccagcctgctgtag

SEQ ID NO: 23130 - DNA, 2496 bp, Artificial Sequence
  Description of Artificial Sequence: Synthetic coding sequence
atggacaaggagaacagcgacgtgagcgccgcccccgccgacctgaagatcagcaacatcagcgtgcaggtggtgagcgcccagaagaagctgccccccggcagaagacccccccagagacccatcggcaaggccaagcccaagaagcagagcaagaagaaggtgcccttctggaacgtgcagaacaagatcatcctgttcaccgtgttcctgttcatcctggccgtgatcgcctggaccctgctgtggctgtacatcagcaagaccgagagcaaggacgccttctacttcgccggcatgttcagaatcaccaacatcgagttcctgcccgagtacagacagaaggagagcagagagttcctgagcgtgagcagaaccgtgcagcaggtgatcaacctggtgtacaccaccagcgccttcagcaagttctacgagcagagcgtggtggccgacgtgagcagcaacaacaagggcggcctgctggtgcacttctggatcgtgttcgtgatgcccagagccaagggccacatcttctgcgaggactgcgtggccgccatcctgaaggacagcatccagaccagcatcatcaacagaaccagcgtgggcagcctgcagggcctggccgtggacatggacagcgtggtgaacgccgccggcctgagaagcgactacagcagcaccatcggcagcgccgacaagggctgcagccagtacttctacgccgagcacctgagcctgcactaccccctggagatcagcgccgccagcggcagactgatgtgccacttcaagctggtggccatcgtgggctacctgatcagactgagcatcaagagcatccagatcgaggccgacaactgcgtgaccgacagcctgaccatctacgacagcctgctgcccatcagaagcagcatcctgtacagaatctgcgagcccaccagaaccctgatgagcttcgtgagcaccaacaacctgatgctggtgaccttcaagagcccccacatcagaagactgagcggcatcagagcctacttcgaggtgatccccgagcagaagtgcgagaacaccgtgctggtgaaggacatcaccggcttcgagggcaagatcagcagcccctactaccccagctactacccccccaagtgcaagtgcacctggaagttccagaccagcctgagcaccctgggcatcgccctgaagttctacaactacagcatcaccaagaagagcatgaagggctgcgagcacggctggtgggagatcaacgagcacatgtactgcggcagctacatggaccaccagaccatcttcagagtgcccagccccctggtgcacatccagctgcagtgcagcagcagactgagcgacaagcccctgctggccgagtacggcagctacaacatcagccagccctgccccgtgggcagcttcagatgcagcagcggcctgtgcgtgccccaggcccagagatgcgacggcgtgaacgactgcttcgacgagagcgacgagctgttctgcgtgagcccccagcccgcctgcaacaccagcagcttcagacagcacggccccctgatctgcgacggcttcagagactgcgagaacggcagagacgagcagaactgcacccagagcatcccctgcaacaacagaaccttcaagtgcggcaacgacatctgcttcagaaagcagaacgccaagtgcgacggcaccgtggactgccccgacggcagcgacgaggagggctgcacctgcagcagaagcagcagcgccctgcacagaatcatcggcggcaccgacaccctggagggcggctggccctggcaggtgagcctgcacttcgtgggcagcgcctactgcggcgccagcgtgatcagcagagagtggctgctgagcgccgcccactgcttccacggcaacagactgagcgaccccaccccctggaccgcccacctgggcatgtacgtgcagggcaacgccaagttcgtgagccccgtgagaagaatcgtggtgcacgagtactacaacagccagaccttcgactacgacatcgccctgctgcagctgagcatcgcctggcccgagaccctgaagcagctgatccagcccatctgcatcccccccaccggccagagagtgagaagcggcgagaagtgctgggtgaccggctggggcagaagacacgaggccgacaacaagggcagcctggtgctgcagcaggccgaggtggagctgatcgaccagaccctgtgcgtgagcacctacggcatcatcaccagcagaatgctgtgcgccggcatcatgagcggcaagagagacgcctgcaagggcgacagcggcggccccctgagctgcagaagaaagagcgacggcaagtggatcctgaccggcatcgtgagctggggccacggcagcggcagacccaacttccccggcgtgtacaccagagtgagcaacttcgtgccctggatccacaagtacgtgcccagcctgctgtag

SEQ ID NO: 23131 - DNA, 2532 bp, Artificial Sequence
  Description of Artificial Sequence: Synthetic coding sequence
atggacaaggagaacagcgacgtgagcgccgcccccgccgacctgaagatcagcaacatcagcgtgcaggtggtgagcgcccagaagaagctgcccgtgagaagaccccccctgcccggcagaagactgcccctgcccggcagaagacccccccagagacccatcggcaaggccaagcccaagaagcagagcaagaagaaggtgcccttctggaacgtgcagaacaagatcatcctgttcaccgtgttcctgttcatcctggccgtgatcgcctggaccctgctgtggctgtacatcagcaagaccgagagcaaggacgccttctacttcgccggcatgttcagaatcaccaacatcgagttcctgcccgagtacagacagaaggagagcagagagttcctgagcgtgagcagaaccgtgcagcaggtgatcaacctggtgtacaccaccagcgccttcagcaagttctacgagcagagcgtggtggccgacgtgagcagcaacaacaagggcggcctgctggtgcacttctggatcgtgttcgtgatgcccagagccaagggccacatcttctgcgaggactgcgtggccgccatcctgaaggacagcatccagaccagcatcatcaacagaaccagcgtgggcagcctgcagggcctggccgtggacatggacagcgtggtgctgaacgccggcctgagaagcgactacagcagcaccatcggcagcgacaagggctgcagccagtacttctacgccgagcacctgagcctgcactaccccctggagatcagcgccgccagcggcagactgatgtgccacttcaagctggtggccatcgtgggctacctgatcagactgagcatcaagagcatccagatcgaggccgacaactgcgtgaccgacagcctgaccatctacgacagcctgctgcccatcagaagcagcatcctgtacagaatctgcgagcccaccagaaccctgatgagcttcgtgagcaccaacaacctgatgctggtgaccttcaagagcccccacatcagaagactgagcggcatcagagcctacttcgaggtgatccccgagcagaagtgcgagaacaccgtgctggtgaaggacatcaccggcttcgagggcaagatcagcagcccctactaccccagctactacccccccaagtgcaagtgcacctggaagttccagaccagcctgagcaccctgggcatcgccctgaagttctacaactacagcatcaccaagaagagcatgaagggctgcgagcacggctggtgggagatcaacgagcacatgtactgcggcagctacatggaccaccagaccatcttcagagtgcccagccccctggtgcacatccagctgcagtgcagcagcagactgagcgacaagcccctgctggccgagtacggcagctacaacatcagccagccctgccccgtgggcagcttcagatgcagcagcggcctgtgcgtgccccaggcccagagatgcgacggcgtgaacgactgcttcgacgagagcgacgagctgttctgcgtgagcccccagcccgcctgcaacaccagcagcttcagacagcacggccccctgatctgcgacggcttcagagactgcgagaacggcagagacgagcagaactgcacccagagcatcccctgcaacaacagaaccttcaagtgcggcaacgacatctgcttcagaaagcagaacgccaagtgcgacggcaccgtggactgccccgacggcagcgacgaggagggctgcacctgcagcagaagcagcagcgccctgcacagaatcatcggcggcaccgacaccctggagggcggctggccctggcaggtgagcctgcacttcgtgggcagcgcctactgcggcgccagcgtgatcagcagagagtggctgctgagcgccgcccactgcttccacggcaacagactgagcgaccccaccccctggaccgcccacctgggcatgtacgtgcagggcaacgccaagttcgtgagccccgtgagaagaatcgtggtgcacgagtactacaacagccagaccttcgactacgacatcgccctgctgcagctgagcatcgcctggcccgagaccctgaagcagctgatccagcccatctgcatcccccccaccggccagagagtgagaagcggcgagaagtgctgggtgaccggctggggcagaagacacgaggccgacaacaagggcagcctggtgctgcagcaggccgaggtggagctgatcgaccagaccctgtgcgtgagcacctacggcatcatcaccagcagaatgctgtgcgccggcatcatgagcggcaagagagacgcctgcaagggcgacagcggcggccccctgagctgcagaagaaagagcgacggcaagtggatcctgaccggcatcgtgagctggggccacggcagcggcagacccaacttccccggcgtgtacaccagagtgagcaacttcgtgccctggatccacaagtacgtgcccagcctgctgtag

SEQ ID NO: 23132 - DNA, 3180 bp, Artificial Sequence
  Description of Artificial Sequence: Synthetic coding sequence
atggagcccaccgtggccgacgtgcacctggtgcccagaaccaccaaggaggtgcccgccctggacgccgcctgctgcagagccgccagcatcggcgtggtggccaccagcctggtggtgctgaccctgggcgtgctgctggccttcctgagcacccagggcttccacgtggaccacaccgccgagctgagaggcatcagatggaccagcagcctgagaagagagaccagcgactaccacagaaccctgacccccaccctggaggccctgctgcacttcctgctgagacccctgcagaccctgagcctgggcctggaggaggagctgctgcagagaggcatcagagccagactgagagagcacggcatcagcctggccgcctacggcaccatcgtgagcgccgagctgaccggcagacacaagggccccctggccgagagagacttcaagagcggcagatgccccggcaacagcttcagctgcggcaacagccagtgcgtgaccaaggtgaaccccgagtgcgacgaccaggaggactgcagcgacggcagcgacgaggcccactgcgagtgcggcctgcagcccgcctggagaatggccggcagaatcgtgggcggcatggaggccagccccggcgagttcccctggcaggccagcctgagagagaacaaggagcacttctgcggcgccgccatcatcaacgccagatggctggtgagcgccgcccactgcttcaacgagttccaggaccccaccaagtgggtggcctacgtgggcgccacctacctgagcggcagcgaggccagcaccgtgagagcccaggtggtgcagatcgtgaagcaccccctgtacaacgccgacaccgccgacttcgacgtggccgtgctggagctgaccagccccctgcccttcggcagacacatccagcccgtgtgcctgcccgccgccacccacatcttcccccccagcaagaagtgcctgatcagcggctggggctacctgaaggaggacttcctggtgaagcccgaggtgctgcagaaggccaccgtggagctgctggaccaggccctgtgcgccagcctgtacggccacagcctgaccgacagaatggtgtgcgccggctacctggacggcaaggtggacagctgccagggcgacagcggcggccccctggtgtgcgaggagcccagcggcagattcttcctggccggcatcgtgagctggggcatcggctgcgccgaggccagaagacccggcgtgtacgccagagtgaccagactgagagactggatcctggaggccaccaccaaggccagcatgcccctggcccccaccatggcccccgcccccgccgcccccagcaccgcctggcccaccagccccgagagccccgtggtgagcacccccaccaagagcatgcaggccctgagcaccgtgcccctggactgggtgaccgtgcccaagctgcaggagtgcggcgccagacccgccatggagaagcccaccagagtggtgggcggcttcggcgccgccagcggcgaggtgccctggcaggtgagcctgaaggagggcagcagacacttctgcggcgccaccgtggtgggcgacagatggctgctgagcgccgcccactgcttcaaccacaccaaggtggagcaggtgagagcccacctgggcaccgccagcctgctgggcctgggcggcagccccgtgaagatcggcctgagaagagtggtgctgcaccccctgtacaaccccggcatcctggacttcgacctggccgtgctggagctggccagccccctggccttcaacaagtacatccagcccgtgtgcctgcccctggccatccagaagttccccgtgggcagaaagtgcatgatcagcggctggggcaacacccaggagggcaacgccaccaagcccgagctgctgcagaaggccagcgtgggcatcatcgaccagaagacctgcagcgtgctgtacaacttcagcctgaccgacagaatgatctgcgccggcttcctggagggcaaggtggacagctgccagggcgacagcggcggccccctggcctgcgaggaggcccccggcgtgttctacctggccggcatcgtgagctggggcatcggctgcgcccaggtgaagaagcccggcgtgtacaccagaatcaccagactgaagggctggatcctggagatcatgagcagccagcccctgcccatgagcccccccagcaccaccagaatgctggccaccaccagccccagaaccaccgccggcctgaccgtgcccggcgccacccccagcagacccacccccggcgccgccagcagagtgaccggccagcccgccaacagcaccctgagcgccgtgagcaccaccgccagaggccagacccccttccccgacgcccccgaggccaccacccacacccagctgcccgactgcggcctggcccccgccgccctgaccagaatcgtgggcggcagcgccgccggcagaggcgagtggccctggcaggtgagcctgtggctgagaagaagagagcacagatgcggcgccgtgctggtggccgagagatggctgctgagcgccgcccactgcttcgacgtgtacggcgaccccaagcagtgggccgccttcctgggcacccccttcctgagcggcgccgagggccagctggagagagtggccagaatctacaagcaccccttctacaacctgtacaccctggactacgacgtggccctgctggagctggccggccccgtgagaagaagcagactggtgagacccatctgcctgcccgagcccgcccccagaccccccgacggcaccagatgcgtgatcaccggctggggcagcgtgagagagggcggcagcatggccagacagctgcagaaggccgccgtgagactgctgagcgagcagacctgcagaagattctaccccgtgcagatcagcagcagaatgctgtgcgccggcttcccccagggcggcgtggacagctgcagcggcgacgccggcggccccctggcctgcagagagcccagcggcagatgggtgctgaccggcgtgaccagctggggctacggctgcggcagaccccacttccccggcgtgtacaccagagtggccgccgtgagaggctggatcggccagcacatccaggagtag

SEQ ID NO: 23133 - DNA, 1596 bp, Artificial Sequence
  Description of Artificial Sequence: Synthetic coding sequence
atggagcccaccgtggccgacgtgcacctggtgcccagaaccaccaaggaggtgcccgccctggacgccgcctgctgcagagccgccagcatcggcgtggtggccaccagcctggtggtgctgaccctgggcgtgctgctggccttcctgagcacccagggcttccacgtggaccacaccgccgagctgagaggcatcagatggaccagcagcctgagaagagagaccagcgactaccacagaaccctgacccccaccctggaggccctgttcgtgagcagcttccagaagaccgagctggaggccagctgcgtgggctgcagcgtgctgaactacagagacggcaacagcagcgtgctggtgcacttccagctgcacttcctgctgagacccctgcagaccctgagcctgggcctggaggaggagctgctgcagagaggcatcagagccagactgagagagcacggcatcagcctggccgcctacggcaccatcgtgagcgccgagctgaccggcagacacaagggccccctggccgagagagacttcaagagcggcagatgccccggcaacagcttcagctgcggcaacagccagtgcgtgaccaaggtgaaccccgagtgcgacgaccaggaggactgcagcgacggcagcgacgaggcccactgcgagtgcggcctgcagcccgcctggagaatggccggcagaatcgtgggcggcatggaggccagccccggcgagttcccctggcaggccagcctgagagagaacaaggagcacttctgcggcgccgccatcatcaacgccagatggctggtgagcgccgcccactgcttcaacgagttccaggaccccaccaagtgggtggcctacgtgggcgccacctacctgagcggcagcgaggccagcaccgtgagagcccaggtggtgcagatcgtgaagcaccccctgtacaacgccgacaccgccgacttcgacgtggccgtgctggagctgaccagccccctgcccttcggcagacacatccagcccgtgtgcctgcccgccgccacccacatcttcccccccagcaagaagtgcctgatcagcggctggggctacctgaaggaggacttcctggtgaagcccgaggtgctgcagaaggccaccgtggagctgctggaccaggccctgtgcgccagcctgtacggccacagcctgaccgacagaatggtgtgcgccggctacctggacggcaaggtggacagctgccagggcgacagcggcggccccctggtgtgcgaggagcccagcggcagattcttcctggccggcatcgtgagctggggcatcggctgcgccgaggccagaagacccggcgtgtacgccagagtgaccagactgagagactggatcctggaggccaccaccaaggccagcatgcccctggcccccaccatggcccccgcccccgccgcccccagcaccgcctggcccaccagccccgagagccccgtggtgagcacccccaccaagagcatgcaggccctgagcaccgtgcccctggactgggtgaccgtgcccaagctgcagggcatcttcggcgccgagagatag

SEQ ID NO: 23134 - DNA, 405 bp, Artificial Sequence
  Description of Artificial Sequence: Synthetic coding sequence
atgaccgaggagcccatcaaggagatcctgggcgcccccaaggcccacatggccgccaccatggagaagagccccaagagcgaggtggtgatcaccaccgtgcccctggtgagcgagatccagctgatggccgccaccggcggcaccgagctgagctgctacagatgcatcatccccttcgccgtggtggtgttcatcgccggcatcgtggtgaccgccgtggcctacagcttcaacagccacggcagcatcatcagcatcttcggcctggtggtgctgagcagcggcctgttcctgctggccagcagcgccctgtgctggaaggtgagacagagaagcaagaaggccaagagaagagagagccagaccgccctggtggccaaccagagaagcctgttcgcctag

SEQ ID NO: 23135 - DNA, 405 bp, Artificial Sequence; identical to SEQ ID NO: 23134
  Description of Artificial Sequence: Synthetic coding sequence

SEQ ID NO: 23136 - DNA, 405 bp, Artificial Sequence; identical to SEQ ID NO: 23134
  Description of Artificial Sequence: Synthetic coding sequence

SEQ ID NO: 23137 - DNA, 633 bp, Artificial Sequence; identical to SEQ ID NO: 21503
  Description of Artificial Sequence: Synthetic coding sequence

SEQ ID NO: 23138 - DNA, 600 bp, Artificial Sequence
  Description of Artificial Sequence: Synthetic coding sequence
atgggcgccgccgtgctgtgcgccagcttcatgagcttcggcgtgaagagaagatggttcgccctgggcgccgccctgcagctggccatcagcacctacgccgcctacatcggcggctacgtgcactacggcgactggctgaaggtgagaatgtacagcagaaccgtggccatcatcggcggcttcctggtgctggccagcggcgccggcgagctgtacagaagaaagcccagaagcagaagcctgcagagcaccggccaggtgttcctgggcatctacctgatctgcgtggcctacagcctgcagcacagcaaggaggacagactggcctacctgaaccacctgcccggcggcgagctgatgatccagctgttcttcgtgctgtacggcatcctggccctggccttcctgagcggctactacgtgaccctggccgcccagatcctggccgtgctgctgccccccgtgatgctgctgatcgacggcaacgtggcctactggcacaacaccagaagagtggagttctggaaccagatgaagctgctgggcgagagcgtgggcatcttcggcaccgccgtgatcctggccaccgacggctag

SEQ ID NO: 23139 - DNA, 774 bp, Artificial Sequence
  Description of Artificial Sequence: Synthetic coding sequence
atggccagcaagatcggcagcagaagatggatgctgcagctgatcatgcagctgggcagcgtgctgctgaccagatgccccttctggggctgcttcagccagctgatgctgtacgccgagagagccgaggccagaagaaagcccgacatccccgtgccctacctgtacttcgacatgggcgccgccgtgctgtgcgccagcttcatgagcttcggcgtgaagagaagatggttcgccctgggcgccgccctgcagctggccatcagcacctacgccgcctacatcggcggctacgtgcactacggcgactggctgaaggtgagaatgtacagcagaaccgtggccatcatcggcggcttcctggtgctggccagcggcgccggcgagctgtacagaagaaagcccagaagcagaagcctgcagagcaccggccaggtgttcctgggcatctacctgatctgcgtggcctacagcctgcagcacagcaaggaggacagactggcctacctgaaccacctgcccggcggcgagctgatgatccagctgttcttcgtgctgtacggcatcctggccctggccttcctgagcggctactacgtgaccctggccgcccagatcctggccgtgctgctgccccccgtgatgctgctgatcgacggcaacgtggcctactggcacaacaccagaagagtggagttctggaaccagatgaagctgctgggcgagagcgtgggcatcttcggcaccgccgtgatcctggccaccgacggctag

SEQ ID NO: 23140 - DNA, 1491 bp, Artificial Sequence
  Description of Artificial Sequence: Synthetic coding sequence
atggccggcgagatcaccgagaccggcgagctgtacagcagctacgtgggcctggtgtacatgttcaacctgatcgtgggcaccggcgccctgaccatgcccaaggccttcgccaccgccggctggctggtgagcctggtgctgctggtgttcctgggcttcatgagcttcgtgaccaccaccttcgtgatcgaggccatggccgccgccaacgcccagctgcactggaagagaatggagaacctgaaggaggaggaggacgacgacagcagcaccgccagcgacagcgacgtgctgatcagagacaactacgagagagccgagaagagacccatcctgagcgtgcagagaagaggcagccccaaccccttcgagatcaccgacagagtggagatgggccagatggccagcatgttcttcaacaaggtgggcgtgaacctgttctacttctgcatcatcgtgtacctgtacggcgacctggccatctacgccgccgccgtgcccttcagcctgatgcaggtgacctgcagcgccaccggcaacgacagctgcggcgtggaggccgacaccaagtacaacgacaccgacagatgctggggccccctgagaagagtggacgcctacagaatctacctggccatcttcaccctgctgctgggccccttcaccttcttcgacgtgcagaagaccaagtacctgcagatcctgaccagcctgatgagatggatcgccttcgccgtgatgatcgtgctggccctgatcagaatcggccacggccagggcgagggccacccccccctggccgacttcagcggcgtgagaaacctgttcggcgtgtgcgtgtacagcttcatgtgccagcacagcctgcccagcctgatcacccccgtgagcagcaagagacacctgaccagactggtgttcctggactacgtgctgatcctggccttctacggcctgctgagcttcaccgccatcttctgcttcagaggcgacagcctgatggacatgtacaccctgaacttcgccagatgcgacgtggtgggcctggccgccgtgagattcttcctgggcctgttccccgtgttcaccatcagcaccaacttccccatcatcgccgtgaccctgagaaacaactggaagaccctgttccacagagagggcggcacctacccctgggtggtggacagagtggtgttccccaccatcaccctggtgccccccgtgctggtggccttctgcacccacgacctggagagcctggtgggcatcaccggcgcctacgccggcaccggcatccagtacgtgatccccgccttcctggtgtaccactgcagaagagacacccagctggccttcggctgcggcgtgagcaacaagcacagaagccccttcagacacaccttctgggtgggcttcgtgctgctgtgggccttcagctgcttcatcttcgtgaccgccaacatcatcctgagcgagaccaagctgtag

SEQ ID NO: 23141 - DNA, 984 bp, Artificial Sequence
  Description of Artificial Sequence: Synthetic coding sequence
atggccggcgagatcaccgagaccggcgagctgtacagcagctacgtgttcgtgagagtggtgaagcccaacaagatcgccatgctgttcatcatgctgatccccggctgggccagatggctgacccccgtgatccccgccctgtgggaggccgaggccggcagaagccccgaggtgagaagcagcagacccgcctggcccacctgcttcgtgaccaccaccttcgtgatcgaggccatggccgccgccaacgcccagctgcactggaagagaatggagaacctgaaggaggaggaggacgacgacagcagcaccgccagcgacagcgacgtgctgatcagagacaactacgagagagccgagaagagacccatcctgagcgtgcagagaagaggcagccccaaccccttcgagatcaccgacagagtggagatgggccagatggccagcatgttcttcaacaaggtgggcgtgaacctgttctacttctgcatcatcgtgtacctgtacggcgacctggccatctacgccgccgccgtgcccttcagcctgatgcaggtgacctgcagcgccaccggcaacgacagctgcggcgtggaggccgacaccaagtacaacgacaccgacagatgctggggccccctgagaagagtggacgcctacagaatctacctggccatcttcaccctgctgctgggccccttcaccttcttcgacgtgcagaagaccaagtacctgcagatcctgaccagcctgatgagatggatcgacggcccccccggcagcgtgatgggcagagccgaggaggacgccagccccgcctggcccagaagcagatgcagatgcggcggcaagctgaagctgaacagcctgtaccccaccagcgccacctgcatggcccccgacgcccccggcgccggccaggtgaaggtgggcgtgaacttcctgtgcctgcccccccacagaagcaccagacccacctag

SEQ ID NO: 23142 - DNA, 390 bp, Artificial Sequence
  Description of Artificial Sequence: Synthetic coding sequence
atgctgctgaaggtgagaagagccagcctgaagccccccgccaccccccaccagggcgccttcagagccggcaacgtgatcggccagctgatctacctgctgacctggagcctgttcaccgcctggctgagaccccccaccctgctgcagggccccagaaccagcccccagggcagcccccccagaagcccctggggcgactgcgccgagcccagctgcctgtgcgagatgaagatcagaagaagaagacacgagggccccgcctggggccagagcggcttcctggccggcggcctgcacctggtgcccagcagcctgagcctggccgcctgcggcgtggtgagaatgaagggcctgtggggcagaggcgccggcatcagaggcagatag

SEQ ID NO: 23143 - DNA, 789 bp, Artificial Sequence
  Description of Artificial Sequence: Synthetic coding sequence
atgggcaagaccttcagccagctgggcagctggagagaggacgagaacaagagcatcctgagcagcaagcccgccatcggcagcaaggccgtgaactacagcagcaccggcagcagcaagagcttctgcagctgcgtgccctgcgagggcaccgccgacgccagcttcgtgacctgccccacctgccagggcagcggcaagatcccccaggagctggagaagcagctggtggccctgatcccctacggcgaccagagactgaagcccaagcacaccaagctgttcgtgttcctggccgtgctgatctgcctggtgaccagcagcttcatcgtgttcttcctgttccccagaagcgtgatcgtgcagcccgccggcctgaacagcagcaccgtggccttcgacgaggccgacatctacctgaacatcaccaacatcctgaacatcagcaacggcaactactaccccatcatggtgacccagctgaccctggaggtgctgcacctgagcctggtggtgggccaggtgagcaacaacctgctgctgcacatcggccccctggccagcgagcagatgttctacgccgtggccaccaagatcagagacgagaacacctacaagatctgcacctggctggagatcaaggtgcaccacgtgctgctgcacatccagggcaccctgacctgcagctacctgagccacagcgagcagctggtgttccagagctacgagtacgtggactgcagaggcaacgccagcgtgccccaccagctgaccccccaccccccctag

SEQ ID NO: 23144 - DNA, 648 bp, Artificial Sequence
  Description of Artificial Sequence: Synthetic coding sequence
atgggcaagaccttcagccagctgggcagctggagagaggacgagaacaagagcatcctgagcagcaagcccgccatcggcagcaaggccgtgaactacagcagcaccggcagcagcaagagcttctgcagctgcgtgccctgcgagggcaccgccgacgccagcttcgtgacctgccccacctgccagggcagcggcaagatcccccaggagctggagaagcagctggtggccctgatcccctacggcgaccagagactgaagcccaagcacaccaagctgttcgtgttcctggccgtgctgatctgcctggtgaccagcagcttcatcgtgttcttcctgttccccagaagcgtgatcgtgcagcccgccggcctgaacagcagcaccgtggccttcgacgaggccgacatctacctgaacatcaccatgttctacgccgtggccaccaagatcagagacgagaacacctacaagatctgcacctggctggagatcaaggtgcaccacgtgctgctgcacatccagggcaccctgacctgcagctacctgagccacagcgagcagctggtgttccagagctacgagtacgtggactgcagaggcaacgccagcgtgccccaccagctgaccccccaccccccctag

SEQ ID NO: 23145 - DNA, 645 bp, Artificial Sequence
  Description of Artificial Sequence: Synthetic coding sequence
atgggcaccgccgacgccagcttcgtgacctgccccacctgccagggcagcggcaagatcccccaggagctggagaagcagctggtggccctgatcccctacggcgaccagagactgaagcccaagcacaccaagctgttcgtgttcctggccgtgctgatctgcctggtgaccagcagcttcatcgtgttcttcctgttccccagaagcgtgatcgtgcagcccgccggcctgaacagcagcaccgtggccttcgacgaggccgacatctacctgaacatcaccaacatcctgaacatcagcaacggcaactactaccccatcatggtgacccagctgaccctggaggtgctgcacctgagcctggtggtgggccaggtgagcaacaacctgctgctgcacatcggccccctggccagcgagcagatgttctacgccgtggccaccaagatcagagacgagaacacctacaagatctgcacctggctggagatcaaggtgcaccacgtgctgctgcacatccagggcaccctgacctgcagctacctgagccacagcgagcagctggtgttccagagctacgagtacgtggactgcagaggcaacgccagcgtgccccaccagctgaccccccaccccccctag

SEQ ID NO: 23146 - DNA, 696 bp, Artificial Sequence
  Description of Artificial Sequence: Synthetic coding sequence
atgggcagccagcacagcgccgccgccagacccagcagctgcagaagaaagcaggaggacgacagagacggcctgctggccgagagagagcaggaggaggccatcgcccagttcccctacgtggagttcaccggcagagacagcatcacctgcctgacctgccagggcaccggctacatccccaccgagcaggtgaacgagctggtggccctgatcccccacagcgaccagagactgagaccccagagaaccaagcagtacgtgctgctgagcatcctgctgtgcctgctggccagcggcctggtggtgttcttcctgttcccccacagcgtgctggtggacgacgacggcatcaaggtggtgaaggtgaccttcaacaagcaggacagcctggtgatcctgaccatcatggccaccctgaagatcagaaacagcaacttctacaccgtggccgtgaccagcctgagcagccagatccagtacatgaacaccgtggtgaacttcaccggcaaggccgagatgggcggccccttcagctacgtgtacttcttctgcaccgtgcccgagatcctggtgcacaacatcgtgatcttcatgagaaccagcgtgaagatcagctacatcggcctgatgacccagagcagcctggagacccaccactacgtggactgcggcggcaacagcaccgccatctag

SEQ ID NO: 23147 - DNA, 753 bp, Artificial Sequence
  Description of Artificial Sequence: Synthetic coding sequence
atgggcagccagcacagcgccgccgccagacccagcagctgcagaagaaagcaggaggacgacagagacggcctgctggccgagagagagcaggaggaggccatcgcccagttcccctacgtggagttcaccggcagagacagcatcacctgcctgacctgccagggcaccggctacatccccaccgagcaggtgaacgagctggtggccctgatcccccacagcgaccagagactgagaccccagagaaccaagcagtacgtgctgctgagcatcctgctgtgcctgctggccagcggcctggtggtgttcttcctgttcccccacagcgtgctggtggacgacgacggcatcaaggtggtgaaggtgaccttcaacaagcaggacagcctggtgatcctgaccatcatggccaccctgaagatcagaaacagcaacttctacaccgtggccgtgaccagcctgagcagccagatccagtacatgaacaccgtggtgagcacctacgtgaccaccaacgtgagcctgatcccccccagaagcgagcagctggtgaacttcaccggcaaggccgagatgggcggccccttcagctacgtgtacttcttctgcaccgtgcccgagatcctggtgcacaacatcgtgatcttcatgagaaccagcgtgaagatcagctacatcggcctgatgacccagagcagcctggagacccaccactacgtggactgcggcggcaacagcaccgccatctag

SEQ ID NO: 23148 - DNA, 696 bp, Artificial Sequence; identical to SEQ ID NO: 23146
  Description of Artificial Sequence: Synthetic coding sequence

SEQ ID NO: 23149 - DNA, 753 bp, Artificial Sequence; identical to SEQ ID NO: 23147
  Description of Artificial Sequence: Synthetic coding sequence

SEQ ID NO: 23150 - DNA, 441 bp, Artificial Sequence
  Description of Artificial Sequence: Synthetic coding sequence
atgggcagagtgagcggcctggtgcccagcagattcctgaccctgctggcccacctggtggtggtgatcaccctgttctggagcagagacagcaacatccaggcctgcctgcccctgaccttcacccccgaggagtacgacaagcaggacatccaccccctgcccctgtgcagactggtggccgccctgagcgtgaccctgggcctgttcgccgtggagctggccggcttcctgagcggcgtgagcatgttcaacagcacccagagcctgatcagcatcggcgcccactgcagcgccagcgtggccctgagcttcttcatcttcgagagatgggagtgcaccacctactggtacatcttcgtgttctgcagcgccctgcccgccgtgaccgagatggccctgttcgtgaccgtgttcggcctgaagaagaagcccttctag

SEQ ID NO: 23151 - DNA, 492 bp, Artificial Sequence
  Description of Artificial Sequence: Synthetic coding sequence
atgggcagagtgagcggcctggtgcccagcagattcctgaccctgctggcccacctggtggtggtgatcaccctgttctggagcagagtgagacccaccgccgccctgaaccccagccccttccccagcctgagcggccccagccccaccctgcccccccccagcgtgctgcccagctgggtgttcctgttccccgccgcccccagacccgccctgcagcccgcccccttcagcctgctgagcgccggctggtggcccagaagcctgagcccctgggccagcctgcagtggagctggcccgtgagcagccaggagagcccctgcagcaccgcccccagagccagcagcgtgagcttcctgcccgcccacctgagccacaccacccacttctaccaggacagcctgcagccccccgacaccatcgtgagcgccgtggccaaccccagcagcagcaagatcttcaacgacgtgctgaaccccgccgtgtactag

SEQ ID NO: 23152 - DNA, 423 bp, Artificial Sequence
  Description of Artificial Sequence: Synthetic coding sequence
atgggcagagtgagcggcctggtgcccagcagattcctgaccctgctggcccacctggtggtggtgatcaccctgttctggagcagagacagcaacatccaggcctgcctgcccctgaccttcacccccgaggagtacgacaagcaggacatccagctggtggccgccctgagcgtgaccctgggcctgttcgccgtggagctggccggcttcctgagcggcgtgagcatgttcaacagcacccagagcctgatcagcatcggcgcccactgcagcgccagcgtggccctgagcttcttcatcttcgagagatgggagtgcaccacctactggtacatcttcgtgttctgcagcgccctgcccgccgtgaccgagatggccctgttcgtgaccgtgttcggcctgaagaagaagcccttctag

SEQ ID NO: 23153 - DNA, 420 bp, Artificial Sequence
  Description of Artificial Sequence: Synthetic coding sequence
atgggcagagtgagcggcctggtgcccagcagattcctgaccctgctggcccacctggtggtggtgatcaccctgttctggagcagagacagcaacatccaggcctgcctgcccctgaccttcacccccgaggagtacgacaagcaggacatccaccccctgcccctgtgcagactggtggccgccctgagcgtgaccctgggcctgttcgccgtggagctggccggcttcctgagcggcgtgagcatgttcaacagcacccagagcctgatcagcatcggcgcccactgcagcgccagcgtggccctgagcttcttcatcttcgagagatgggagtgcaccacctactgcgccctgcccgccgtgaccgagatggccctgttcgtgaccgtgttcggcctgaagaagaagcccttctag

SEQ ID NO: 23154 - DNA, 1728 bp, Artificial Sequence
  Description of Artificial Sequence: Synthetic coding sequence
atgaagagaagcctgcaggccctgtactgccagctgctgagcttcctgctgatcctggccctgaccgaggccctggccttcgccatccaggagcccagccccagagagagcctgcaggtgctgcccagcggcaccccccccggcaccatggtgaccgccccccacagcagcaccagacacaccagcgtggtgatgctgacccccaaccccgacggcccccccagccaggccgccgcccccatggccacccccacccccagagccgagggccacccccccacccacaccatcagcaccatcgccgccaccgtgaccgccccccacagcgagagcagcctgagcaccggccccgcccccgccgccatggccaccaccagcagcaagcccgagggcagacccagaggccaggccgcccccaccatcctgctgaccaagccccccggcgccaccagcagacccaccaccgccccccccagaaccaccaccagaagaccccccagaccccccggcagcagcagaaagggcgccggcaacagcagcagacccgtgccccccgcccccggcggccacagcagaagcaaggagggccagagaggcagaaaccccagcagcacccccctgggccagaagagacccctgggcaagatcttccagatctacaagggcaacttcaccggcagcgtggagcccgagcccagcaccctgacccccagaacccccctgtggggctacagcagcagcccccagccccagaccgtggccgccaccaccgtgcccagcaacaccagctgggcccccaccaccaccagcctgggccccgccaaggacaagcccggcctgagaagagccgcccagggcggcggcagcaccttcaccagccagggcggcacccccgacgccaccgccgccagcggcgcccccgtgagcccccaggccgcccccgtgcccagccagagaccccaccacggcgacccccaggacggccccagccacagcgacagctggctgaccgtgacccccggcaccagcagacccctgagcaccagcagcggcgtgttcaccgccgccaccggccccacccccgccgccttcgacaccagcgtgagcgcccccagccagggcatcccccagggcgccagcaccaccccccaggcccccacccaccccagcagagtgagcgagagcaccatcagcggcgccaaggaggagaccgtggccaccctgaccatgaccgacagagtgcccagccccctgagcaccgtggtgagcaccgccaccggcaacttcctgaacagactggtgcccgccggcacctggaagcccggcaccgccggcaacatcagccacgtggccgagggcgacaagccccagcacagagccaccatctgcctgagcaagatggacatcgcctgggtgatcctggccatcagcgtgcccatcagcagctgcagcgtgctgctgaccgtgtgctgcatgaagagaaagaagaagaccgccaaccccgagaacaacctgagctactggaacaacaccatcaccatggactacttcaacagacacgccgtggagctgcccagagagatccagagcctggagaccagcgaggaccagctgagcgagcccagaagccccgccaacggcgactacagagacaccggcatggtgctggtgaaccccttctgccaggagaccctgttcgtgggcaacgaccaggtgagcgagatctag

SEQ ID NO: 23155 - DNA, 1728 bp, Artificial Sequence; identical to SEQ ID NO: 23154
  Description of Artificial Sequence: Synthetic coding sequence

SEQ ID NO: 23156 - DNA, 318 bp, Artificial Sequence
  Description of Artificial Sequence: Synthetic coding sequence
atgaagagaagcctgcaggccctgtactgccagctgctgaccgtgctgctgaccgtgtgctgcatgaagagaaagaagaagaccgccaaccccgagaacaacctgagctactggaacaacaccatcaccatggactacttcaacagacacgccgtggagctgcccagagagatccagagcctggagaccagcgaggaccagctgagcgagcccagaagccccgccaacggcgactacagagacaccggcatggtgctggtgaaccccttctgccaggagaccctgttcgtgggcaacgaccaggtgagcgagatctag

SEQ ID NO: 23157 - DNA, 462 bp, Artificial Sequence
  Description of Artificial Sequence: Synthetic coding sequence
atgaagagaagcctgcaggccctgtactgccagctgctgagcttcctgctgatcctggccctgaccgaggccctggccttcgccatccaggagcccagccccagagagagcctgcaggtgctgcccagcggcaccccccccggcaccatggtgaccgccccccacagcagcaccagacacaccagcgtggtgatgctgacccccaaccccgacggcccccccagccaggccgccgcccccatggccacccccacccccagagccgagggccacccccccacccacaccatcagcaccatcgccgccaccgtgaccgccccccacagcgagagcagcctgagcaccggccccgcccccgccgccatggccaccaccagcagcaagcccgagggcagacccagaggccaggccgcccccaccatcctgctgaccaagccccccggcgccaccagcagaccctag

SEQ ID NO: 23158 - DNA, 219 bp, Artificial Sequence
  Description of Artificial Sequence: Synthetic coding sequence
atgaagagaagcctgcaggccctgtactgccagctgctgagcttcctgctgatcctggccctgaccgaggccctggccttcgccatccaggagcccagccccagagagagcctgcaggtgctgcccagcggcaccccccccggcaccatggtgaccgccccccacagcagcaccagacacaccagcgtggtgatgctgacccccaaccccgacggctag

SEQ ID NO: 23159 - DNA, 450 bp, Artificial Sequence
  Description of Artificial Sequence: Synthetic coding sequence
atgaagagaagcctgcaggccctgtactgccagctgctgagcttcctgctgatcctggccctgaccgaggccctggccttcgccatccaggagcccagccccagagagagcctgcaggtgctgcccagcggcaccccccccggcaccatggtgaccgccccccacagcagcaccagacacaccagcgtggtgatgctgacccccaaccccgacggcccccccagccaggccgccgcccccatggccacccccacccccagagccgagggccacccccccacccacaccatcagcaccatcgccgccaccgtgaccgccccccacagcgagagcagcctgagcaccggccccgcccccgccgccatggccaccaccagcagcaagcccgagggcagacccagaggccaggccgcccccaccatcctgctgaccaagccccccggcgcctag

SEQ ID NO: 23160 - DNA, 1467 bp, Artificial Sequence
  Description of Artificial Sequence: Synthetic coding sequence
atgaagagaagcctgcaggccctgtactgccagctgctgagcttcctgctgatcctggccctgaccgaggccctggccttcgccatccaggagcccagccccagagagagcctgcaggtgctgcccagcggcaccccccccggcaccatggtgaccgccccccacagcagcaccagacacaccagcgtggtgatgctgacccccaaccccgacggcccccccagccaggccgccgcccccatggccacccccacccccagagccgagggccacccccccacccacaccatcagcaccatcgccgccaccgtgaccgccccccacagcgagagcagcctgagcaccggccccgcccccgccgccatggccaccaccagcagcaagcccgagggcagacccagaggccaggccgcccccaccatcctgctgaccaagccccccggcgccaccagcagacccaccaccgccccccccagaaccaccaccagaagaccccccagaccccccggcagcagcagaaagggcgccggcaacagcagcagacccgtgccccccgcccccggcggccacagcagaagcaaggagggccagagaggcagaaaccccagcagcacccccctgggccagaagagacccctgggcaagatcttccagatctacaagggcaacttcaccggcagcgtggagcccgagcccagcaccctgacccccagaacccccctgtggggctacagcagcagcccccagccccagaccgtggccgccaccaccgtgcccagcaacaccagctgggcccccaccaccaccagcctgggccccgccaaggacaagcccggcctgagaagagccgcccagggcggcggcagcaccttcaccagccagggcggcacccccgacgccaccgccgccagcggcgcccccgtgagcccccaggccgcccccgtgcccagccagagaccccaccacggcgacccccaggacggccccagccacagcgacagctggctgaccgtgacccccggcaccagcagacccctgagcaccagcagcggcgtgttcaccgccgccaccggccccacccccgccgccttcgacaccagcgtgagcgcccccagccagggcatcccccagggcgccagcaccaccccccaggcccccacccaccccagcagagtgagcgagagcaccatcagcggcgccaaggaggagaccgtggccaccctgaccatgaccgacagagtgcccagccccctgagcaccgtggtgagcaccgccaccggcaacttcctgaacagactggtgcccgccggcacctggaagcccggcaccgccggcaacatcagccacgtggccgagggcgacaagccccagcacagagccaccatctgcctgagcaagatggacatcgcctgggtgatcctggccatcagcgtgcccatcagcagctgcagcgaccccatcacctag

SEQ ID NO: 23161 - DNA, 1515 bp, Artificial Sequence
  Description of Artificial Sequence: Synthetic coding sequence
atgagcctgatctgcagcatcagcaacgaggtgcccgagcacccctgcgtgagccccgtgagcaaccacgtgtacgagagaagactgatcgagaagtacatcgccgagaacggcaccgaccccatcaacaaccagcccctgagcgaggagcagctgatcgacatcaaggtggcccaccccatcagacccaagccccccagcgccaccagcatccccgccatcctgaaggccctgcaggacgagtgggacgccgtgatgctgcacagcttcaccctgagacagcagctgcagaccaccagacaggagctgagccacgccctgtaccagcacgacgccgcctgcagagtgatcgccagactgaccaaggaggtgaccgccgccagagaggccctggccaccctgaagccccaggccggcctgatcgtgccccaggccgtgcccagcagccagcccagcgtggtgggcgccggcgagcccatggacctgggcgagctggtgggcatgacccccgagatcatccagaagctgcaggacaaggccaccgtgctgaccaccgagagaaagaagagaggcaagaccgtgcccgaggagctggtgaagcccgaggagctgagcaagtacagacaggtggccagccacgtgggcctgcacagcgccagcatccccggcatcctggccctggacctgtgccccagcgacaccaacaagatcctgaccggcggcgccgacaagaacgtggtggtgttcgacaagagcagcgagcagatcctggccaccctgaagggccacaccaagaaggtgaccagcgtggtgttccaccccagccaggacctggtgttcagcgccagccccgacgccaccatcagaatctggagcgtgcccaacgccagctgcgtgcaggtggtgagagcccacgagagcgccgtgaccggcctgagcctgcacgccaccggcgactacctgctgagcagcagcgacgaccagtactgggccttcagcgacatccagaccggcagagtgctgaccaaggtgaccgacgagaccagcggctgcagcctgacctgcgcccagttccaccccgacggcctgatcttcggcaccggcaccatggacagccagatcaagatctgggacctgaaggagagaaccaacgtggccaacttccccggccacagcggccccatcaccagcatcgccttcagcgagaacggctactacctggccaccgccgccgacgacagcagcgtgaagctgtgggacctgagaaagctgaagaacttcaagaccctgcagctggacaacaacttcgaggtgaagagcctgatcttcgaccagagcggcacctacctggccctgggcggcaccgacgtgcagatctacatctgcaagcagtggaccgagatcctgcacttcaccgagcacagcggcctgaccaccggcgtggccttcggccaccacgccaagttcatcgccagcaccggcatggacagaagcctgaagttctacagcctgtag

SEQ ID NO: 23162 - DNA, 705 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagcagaagagacttcgccccccccggccagcagaagagagaggcccccgtggacgtgctgacccagatcggcagaagcgtgagaggcaccctggacgcctggatcggccccgagaccatgcacctggtgagcgagagcagcagccaggtgctgtgggccatcagcagcgccatcagcgtggccttcttcgccctgagcggcatcgccgcccagctgctgaacgccctgggcctggccggcgactacctggcccagggcctgaagctgagccccggccaggtgcagaccttcctgctgtggggcgccggcgccctggtggtgtactggctgctgagcctgctgctgggcctggtgctggccctgctgggcagaatcctgtggggcctgaagctggtgatcttcctggccggcttcgtggccctgatgagaagcgtgcccgaccccagcaccagagccctgctgctgctggccctgctgaccccctgccccttcctggccctgagcctgaacctgcagaacatcgacccctgcagaagccccaccagccaggagaagcagagaaagaccatcccccccgcctgcccctgcggccccgtgttctag

SEQ ID NO: 23163 - DNA, 732 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagcagaagagacttcgccccccccggccagcagaagagagaggcccccgtggacgtgctgacccagatcggcagaagcgtgagaggcaccctggacgcctggatcggccccgagaccatgcacctggtgagcgagagcagcagccaggtgctgtgggccatcagcagcgccatcagcgtggccttcttcgccctgagcggcatcgccgcccagctgctgaacgccctgggcctggccggcgactacctggcccagggcctgaagctgagccccggccaggtgcagaccttcctgctgtggggcgccggcgccctggtggtgtactggctgctgagcctgctgctgggcctggtgctggccctgctgggcagaatcctgtggggcctgaagctggtgatcttcctggccggcttcgtggccctgatgagaagcgtgcccgaccccagcaccagagccctgctgctgctggccctgctgatcctgtacgccctgctgagcagactgaccggcagcagagccagcggcgcccagctggaggccaaggtgagaggcctggagagacaggtggaggagctgagatggagacagagaagagccgccaagggcgccagaagcgtggaggaggagtag

SEQ ID NO: 23164 - DNA, 579 bp, Artificial Sequence
  Description of Artificial Sequence: Synthetic coding sequence
atggccgcctggggcagaagaagactgggccccggcagcagcggcggcagcgccagagagagagtgagcctgagcgccaccgactgctacatcgtgcacgagatctacaacggcgagaacgcccaggaccagttcgagtacgagctggagcaggccctggaggcccagtacaagtacatcgtgatcgagcccaccagaatcggcgacgagaccgccagatggatcaccgtgggcaactgcctgcacaagaccgccgtgctggccggcaccgcctgcctgttcacccccctggccctgcccctggactacagccactacatcagcctgcccgccggcgtgctgagcctggcctgctgcaccctgtacggcatcagctggcagttcgacccctgctgcaagtaccaggtggagtacgacgcctacaagctgagcagactgcccctgcacaccctgaccagcagcacccccgtggtgctggtgagaaaggacgacctgcacagaaagagactgcacaacaccatcgccctggccgccctggtgtactgcgtgaagaagatctacgagctgtacgccgtgtag

SEQ ID NO: 23165 - DNA, 885 bp, Artificial Sequence
  Description of Artificial Sequence: Synthetic coding sequence
atgcagggccccgccggcaacgccagcagaggcctgcccggcggcccccccagcaccgtggccagcggcgccggcagatgcgagagcggcgccctgatgcacagcttcggcatcttcctgcagggcctgctgggcgtggtggccttcagcaccctgatgctgaagagattcagagagcccaagcacgagagaagaccctggagaatctggttcctggacaccagcaagcaggccatcggcatgctgttcatccacttcgccaacgtgtacctggccgacctgaccgaggaggacccctgcagcctgtacctgatcaacttcctgctggacgccaccgtgggcatgctgctgatctacgtgggcgtgagagccgtgagcgtgctggtggagtggcagcagtgggagagcctgagattcggcgagtacggcgaccccctgcagtgcggcgcctgggtgggccagtgcgccctgtacatcgtgatcatgatcttcgagaagagcgtggtgttcatcgtgctgctgatcctgcagtggaagaaggtggccctgctgaaccccatcgagaaccccgacctgaagctggccatcgtgatgctgatcgtgcccttcttcgtgaacgccctgatgttctgggtggtggacaacttcctgatgagaaagggcaagaccaaggccaagctggaggagagaggcgccaaccaggacagcagaaacggcagcaaggtgagatacagaagagccgccagccacgaggagagcgagagcgagatcctgatcagcgccgacgacgagatggaggagagcgacgtggaggaggacctgagaagactgacccccctgaagcccgtgaagaagaagaagcacagattcggcctgcccgtgtag

SEQ ID NO: 23166 - DNA, 786 bp, Artificial Sequence
  Description of Artificial Sequence: Synthetic coding sequence
atggccggccccgagctgctgctggacagcaacatcagactgtgggtggtgctgcccatcgtgatcatcaccttcttcgtgggcatgatcagacactacgtgagcatcctgctgcagagcgacaagaagctgacccaggagcaggtgagcgacagccaggtgctgatcagaagcagagtgctgagagagaacggcaagtacatccccaagcagagcttcctgaccagaaagtactacttcaacaaccccgaggacggcttcttcaagaagaccaagagaaaggtggtgccccccagccccatgaccgaccccaccatgctgaccgacatgatgaagggcaacgtgaccaacgtgctgcccatgatcctgatcggcggctggatcaacatgaccttcagcggcttcgtgaccaccaaggtgcccttccccctgaccctgagattcaagcccatgctgcagcagggcatcgagctgctgaccctggacgccagctgggtgagcagcgccagctggtacttcctgaacgtgttcggcctgagaagcatctacagcctgatcctgggccaggacaacgccgccgaccagagcagaatgatgcaggagcagatgaccggcgccgccatggccatgcccgccgacaccaacaaggccttcaagaccgagtgggaggccctggagctgaccgaccaccagtgggccctggacgacgtggaggaggagctgatggccaaggacctgcacttcgagggcatgttcaagaaggagctgcagaccagcatcttctag

SEQ ID NO: 23167 - DNA, 612 bp, Artificial Sequence
  Description of Artificial Sequence: Synthetic coding sequence
atggccggccccgagctgctgctggacagcaacatcagactgtgggtggtgctgcccatcgtgatcatcaccttcttcgtgggcatgatcagacactacgtgagcatcctgctgcagagcgacaagaagctgacccaggagcaggtgagcgacagaaagtacctgagcggcctggtgcagtggctgacccccatcatccccgccctgtggggcgccgagatgggcggcagcctggagcccagaaacctgagacccaccctggccgcctgccaggtgctgatcagaagcagagtgctgagagagaacggcaagtacatccccaagcagagcttcctgaccagaaagtactacttcaacaaccccgaggacggcttcttcaagaagaccaagagaaaggtggtgccccccagccccatgaccgaccccaccatgctgaccgacatgatgaagggcaacgtgaccaacgtgctgcccatgatcctgatcggcggctggatcaacatgaccttcagcggcttcgtgaccaccaaggtgcccttccccctgaccctgagattcaagcccatgctgcagcagggcatcgagctgctgaccctggacgccagctggtag

SEQ ID NO: 23168 - DNA, 1056 bp, Artificial Sequence
  Description of Artificial Sequence: Synthetic coding sequence
atgcagagagccctgcccggcgccagacagcacctgggcgccatcctggccagcgccagcgtggtggtgaaggccctgtgcgccgccgtgctgttcctgtacctgctgagcttcgccgtggacaccggctgcctggccgtgacccccggctacctgttcccccccaacttctggatctggaccctggccacccacggcctgatggagcagcacgtgtgggacgtggccatcagcctgaccaccgtggtggtggccggcagactgctggagcccctgtggggcgccctggagctgctgatcttcttcagcgtggtgaacgtgagcgtgggcctgctgggcgccttcgcctacctgctgacctacatggccagcttcaacctggtgtacctgttcaccgtgagaatccacggcgccctgggcttcctgggcggcgtgctggtggccctgaagcagaccatgggcgactgcgtggtgctgagagtgccccaggtgagagtgagcgtgatgcccatgctgctgctggccctgctgctgctgctgagactggccaccctgctgcagagccccgccctggccagctacggcttcggcctgctgagcagctgggtgtacctgagattctaccagagacacagcagaggcagaggcgacatggccgaccacttcgccttcgccaccttcttccccgagatcctgcagcccgtggtgggcctgctggccaacctggtgcacagcctgctggtgaaggtgaagatctgccagaagaccgtgaagagatacgacgtgggcgcccccagcagcatcaccatcagcctgcccggcaccgacccccaggacgccgagagaagaagacagctggccctgaaggccctgaacgagagactgaagagagtggaggaccagagcatctggcccagcatggacgacgacgaggaggagagcggcgccaaggtggacagccccctgcccagcgacaaggcccccaccccccccggcaagggcgccgcccccgagagcagcctgatcaccttcgaggccgccccccccaccctgtag

SEQ ID NO: 23169 - DNA, 738 bp, Artificial Sequence
  Description of Artificial Sequence: Synthetic coding sequence
atgaagcacacccagagcggccagagcaccagccccctggtgatcgactacacctgcagagtgtgccagatggccttcgtgttcagcagcctgatccccctgctgctgatgacccccgtgttctgcctgggcaacaccagcgagtgcttccagaacttcagccagagccacaagtgcatcctgatgcacagcccccccagcgccatggccgagctgccccccagcgccaacaccagcgtgtgcagcaccctgtacttctacggcatcgccatcttcctgggcagcttcgtgctgagcctgctgaccatcatggtgctgctgatcagagcccagaccctgtacaagaagttcgtgaagagcaccggcttcctgggcagcgagcagtgggccgtgatccacatcgtggaccagagagtgagattctaccccgtggccttcttctgctgctggggccccgccgtgatcctgatgatcatcaagctgaccaagccccaggacaccaagctgcacatggccctgtacgtgctgcaggccctgaccgccaccagccagggcctgctgaactgcggcgtgtacggctggacccagcacaagttccaccagctgaagcaggaggccagaagagacgccgacacccagacccccctgctgtgcagccagaagagattctacagcagaggcctgaacagcctggagagcaccctgaccttccccgccagcaccagcaccatcttctag

SEQ ID NO: 23170 - DNA, 738 bp, Artificial Sequence; identical to SEQ ID NO: 23169
  Description of Artificial Sequence: Synthetic coding sequence

SEQ ID NO: 23171 - DNA, 225 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtacggcgccagcgtggccaacaaggacatcatctgctacaacctgcaggccgtgggccaggtgagcgccacctag

SEQ ID NO: 23172 - DNA, 321 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtacggcgccagcgtggccaacaaggacatcatctgctacaacctgcaggccgtgggccagatcttctacatcagcagcttcctgtacaccgtgaactacatctggtacctgtacaccgagctgagaatgaagcacacccagagcggccagagcaccagccccctggtgtag

SEQ ID NO: 23173 - DNA, 528 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtacggcgccagcgtggccaacaaggacatcatctgctacaacctgcaggccgtgggccagatcttctacatcagcagcttcctgtacaccgtgaactacatctggtacctgtacaccgagctgagaatgaagcacacccagagcggccagagcaccagccccctggtgatcgactacacctgcagagtgtgccagatggccttcgtgttcagcagcctgatccccctgctgctgatgacccccgtgttctgcctgggcaacaccagcgagtgcttccagaacttcagccagagccacaagtgcatcctgatgcacagcccccccagcgccatggccgagctgccccccagcgccaacaccagcgtgtgcagcacctag

SEQ ID NO: 23174 - DNA, 156 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtactag

SEQ ID NO: 23175 - DNA, 738 bp, Artificial Sequence; identical to SEQ ID NO: 23169
  Description of Artificial Sequence: Synthetic coding sequence

SEQ ID NO: 23176 - DNA, 1014 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtacggcgccagcgtggccaacaaggacatcatctgctacaacctgcaggccgtgggccagatcttctacatcagcagcttcctgtacaccgtgaactacatctggtacctgtacaccgagctgagaatgaagcacacccagagcggccagagcaccagccccctggtgatcgactacacctgcagagtgtgccagatggccttcgtgttcagcagcctgatccccctgctgctgatgacccccgtgttctgcctgggcaacaccagcgagtgcttccagaacttcagccagagccacaagtgcatcctgatgcacagcccccccagcgccatggccgagctgccccccagcgccaacaccagcgtgtgcagcaccctgtacttctacggcatcgccatcttcctgggcagcttcgtgctgagcctgctgaccatcatggtgctgctgatcagagcccagaccctgtacaagaagttcgtgaagagcaccggcttcctgggcagcgagcagtgggccgtgatccacatcgtggaccagagagtgagattctaccccgtggccttcttctgctgctggggccccgccgtgatcctgatgatcatcaagctgaccaagccccaggacaccaagctgcacatggccctgtacgtgctgcaggccctgaccgccaccagccagggcctgctgaactgcggcgtgtacggctggacccagcacaagttccaccagctgaagcaggaggccagaagagacgccgacacccagacccccctgctgtgcagccagaagagattctacagcagaggcctgaacagcctggagagcaccctgaccttccccgccagcaccagcaccatcttctag

SEQ ID NO: 23177 - DNA, 909 bp, Artificial Sequence
  Description of Artificial Sequence: Synthetic coding sequence
atggccaccctgagcgtgatcggcagcagcagcctgatcgcctacgccgtgttccacaacatccagaagagccccgagatcagacccctgttctacctgagcttctgcgacctgctgctgggcctgtgctggctgaccgagaccctgctgtacggcgccagcgtggccaacaaggacatcatctgctacaacctgcaggccgtgggccaggtgatcgactacacctgcagagtgtgccagatggccttcgtgttcagcagcctgatccccctgctgctgatgacccccgtgttctgcctgggcaacaccagcgagtgcttccagaacttcagccagagccacaagtgcatcctgatgcacagcccccccagcgccatggccgagctgccccccagcgccaacaccagcgtgtgcagcaccctgtacttctacggcatcgccatcttcctgggcagcttcgtgctgagcctgctgaccatcatggtgctgctgatcagagcccagaccctgtacaagaagttcgtgaagagcaccggcttcctgggcagcgagcagtgggccgtgatccacatcgtggaccagagagtgagattctaccccgtggccttcttctgctgctggggccccgccgtgatcctgatgatcatcaagctgaccaagccccaggacaccaagctgcacatggccctgtacgtgctgcaggccctgaccgccaccagccagggcctgctgaactgcggcgtgtacggctggacccagcacaagttccaccagctgaagcaggaggccagaagagacgccgacacccagacccccctgctgtgcagccagaagagattctacagcagaggcctgaacagcctggagagcaccctgaccttccccgccagcaccagcaccatcttctag

SEQ ID NO: 23178 - DNA, 1545 bp, Artificial Sequence
  Description of Artificial Sequence: Synthetic coding sequence
atgggcaaggacttcagatactacttccagcacccctggagcagaatgatcgtggcctacctggtgatcttcttcaacttcctgatcttcgccgaggaccccgtgagccacagccagaccgaggccaacgtgatcgtggtgggcaactgcttcagcttcgtgaccaacaagtaccccagaggcgtgggctggagaatcctgaaggtgctgctgtggctgctggccatcctgaccggcctgatcgccggcaagttcctgttccaccagagactgttcggccagctgctgagactgaagatgttcagagaggaccacggcagctggatgaccatgttcttcagcaccatcctgttcctgttcatcttcagccacatctacaacaccatcctgctgatggacggcaacatgggcgcctacatcatcaccgactacatgggcatcagaaacgagagcttcatgaagctggccgccgtgggcacctggatgggcgacttcgtgaccgcctggatggtgaccgacatgatgctgcaggacaagccctaccccgactggggcaagagcgccagagccttctggaagaagggcaacgtgagaatcaccctgttctggaccgtgctgttcaccctgaccagcgtggtggtgctggtgatcaccaccgactggatcagctgggacaagctgaacagaggcttcctgcccagcgacgaggtgagcagagccttcctggccagcttcatcctggtgttcgacctgctgatcgtgatgcaggactgggagttcccccacttcatgggcgacgtggacgtgaacctgcccggcctgcacaccccccacatgcagttcaagatccccttcttccagaagatcttcaaggaggagtacagaatccacatcaccggcaagtggttcaactacggcatcatcttcctggtgctgatcctggacctgaacatgtggaagaaccagatcttctacaagccccacgagtacggccagtacatcggccccggccagaagatctacaccgtgaaggacagcgagagcctgaaggacctgaacagaaccaagctgagctgggagtggagaagcaaccacaccaaccccagaaccaacaagacctacgtggagggcgacatgttcctgcacagcagattcatcggcgccagcctggacgtgaagtgcctggccttcgtgcccagcctgatcgccttcgtgtggttcggcttcttcatctggttcttcggcagattcctgaagaacgagcccagaatggagaaccaggacaagacctacaccagaatgaagagaaagagccccagcgagcacagcaaggacatgggcatcaccagagagaacacccaggccagcgtggaggaccccctgaacgaccccagcctggtgtgcatcagaagcgacttcaacgagatcgtgtacaagagcagccacctgaccagcgagaacctgagcagccagctgaacgagagcaccagcgccaccgaggccgaccaggaccccaccaccagcaagagcacccccaccaactag

SEQ ID NO: 23179 - DNA, 789 bp, Artificial Sequence
  Description of Artificial Sequence: Synthetic coding sequence
atgtacatcaaggactgggagttcccccacttcatgggcgacgtggacgtgaacctgcccggcctgcacaccccccacatgcagttcaagatccccttcttccagaagatcttcaaggaggagtacagaatccacatcaccggcaagtggttcaactacggcatcatcttcctggtgctgatcctggacctgaacatgtggaagaaccagatcttctacaagccccacgagtacggccagtacatcggccccggccagaagatctacaccgtgaaggacagcgagagcctgaaggacctgaacagaaccaagctgagctgggagtggagaagcaaccacaccaaccccagaaccaacaagacctacgtggagggcgacatgttcctgcacagcagattcatcggcgccagcctggacgtgaagtgcctggccttcgtgcccagcctgatcgccttcgtgtggttcggcttcttcatctggttcttcggcagattcctgaagaacgagcccagaatggagaaccaggacaagacctacaccagaatgaagagaaagagccccagcgagcacagcaaggacatgggcatcaccagagagaacacccaggccagcgtggaggaccccctgaacgaccccagcctggtgtgcatcagaagcgacttcaacgagatcgtgtacaagagcagccacctgaccagcgagaacctgagcagccagctgaacgagagcaccagcgccaccgaggccgaccaggaccccaccaccagcaagagcacccccaccaactag

SEQ ID NO: 23180 - DNA, 1233 bp, Artificial Sequence
  Description of Artificial Sequence: Synthetic coding sequence
atggccacctgccacagccacagaaccaacagctggcagatcagcgtgcccagcgccttcgtgtggagcgtggcccccatcaagaacgtgagcagaagaagctgggtggtggacgacaacgtgctgcagcacaacagcctgagcctgcacatcttcagccacatccagcacgacagcagcaacggctgggagcacggcgtgaccgacatgatgctgcaggacaagccctaccccgactggggcaagagcgccagagccttctggaagaagggcaacgtgagaatcaccctgttctggaccgtgctgttcaccctgaccagcgtggtggtgctggtgatcaccaccgactggatcagctgggacaagctgaacagaggcttcctgcccagcgacgaggtgagcagagccttcctggccagcttcatcctggtgttcgacctgctgatcgtgatgcaggactgggagttcccccacttcatgggcgacgtggacgtgaacctgcccggcctgcacaccccccacatgcagttcaagatccccttcttccagaagatcttcaaggaggagtacagaatccacatcaccggcaagtggttcaactacggcatcatcttcctggtgctgatcctggacctgaacatgtggaagaaccagatcttctacaagccccacgagtacggccagtacatcggccccggccagaagatctacaccgtgaaggacagcgagagcctgaaggacctgaacagaaccaagctgagctgggagtggagaagcaaccacaccaaccccagaaccaacaagacctacgtggagggcgacatgttcctgcacagcagattcatcggcgccagcctggacgtgaagtgcctggccttcgtgcccagcctgatcgccttcgtgtggttcggcttcttcatctggttcttcggcagattcctgaagaacgagcccagaatggagaaccaggacaagacctacaccagaatgaagagaaagagccccagcgagcacagcaaggacatgggcatcaccagagagaacacccaggccagcgtggaggaccccctgaacgaccccagcctggtgtgcatcagaagcgacttcaacgagatcgtgtacaagagcagccacctgaccagcgagaacctgagcagccagctgaacgagagcaccagcgccaccgaggccgaccaggaccccaccaccagcaagagcacccccaccaactag

SEQ ID NO: 23181 - DNA, 852 bp, Artificial Sequence
  Description of Artificial Sequence: Synthetic coding sequence
atggtgagcgccgccgcccccagcctgctgatcctgctgctgctgctgctgggcagcgtgcccgccaccgacgccagaagcgtgcccctgaaggccaccttcctggaggacgtggccggcagcggcgaggccgagggcagcagcgccagcagccccagcctgccccccccctggacccccgccctgagccccaccagcatgggcccccagcccatcaccctgggcggccccagcccccccaccaacttcctggacggcatcgtggacttcttcagacagtacgtgatgctgatcgccgtggtgggcagcctggccttcctgctgatgttcatcgtgtgcgccgccgtgatcaccagacagaagcagaaggccagcgcctactaccccagcagcttccccaagaagaagtacgtggaccagagcgacagagccggcggccccagagccttcagcgaggtgcccgacagagcccccgacagcagacccgaggaggccctggacagcagcagacagctgcaggccgacatcctggccgccacccagaacctgaagagccccaccagagccgccctgggcggcggcgacggcgccagaatggtggagggcagaggcgccgaggaggaggagaagggcagccaggagggcgaccaggaggtgcagggccacggcgtgcccgtggagacccccgaggcccaggaggagccctgcagcggcgtgctggagggcgccgtggtggccggcgagggccagggcgagctggagggcagcctgctgctggcccaggaggcccagggccccgtgggcccccccgagagcccctgcgcctgcagcagcgtgcaccccagcgtgtag

SEQ ID NO: 23182 - DNA, 654 bp, Artificial Sequence
  Description of Artificial Sequence: Synthetic coding sequence
atgggcccccagcccatcaccctgggcggccccagcccccccaccaacttcctggacggcatcgtggacttcttcagacagtacgtgatgctgatcgccgtggtgggcagcctggccttcctgctgatgttcatcgtgtgcgccgccgtgatcaccagacagaagcagaaggccagcgcctactaccccagcagcttccccaagaagaagtacgtggaccagagcgacagagccggcggccccagagccttcagcgaggtgcccgacagagcccccgacagcagacccgaggaggccctggacagcagcagacagctgcaggccgacatcctggccgccacccagaacctgaagagccccaccagagccgccctgggcggcggcgacggcgccagaatggtggagggcagaggcgccgaggaggaggagaagggcagccaggagggcgaccaggaggtgcagggccacggcgtgcccgtggagacccccgaggcccaggaggagccctgcagcggcgtgctggagggcgccgtggtggccggcgagggccagggcgagctggagggcagcctgctgctggcccaggaggcccagggccccgtgggcccccccgagagcccctgcgcctgcagcagcgtgcaccccagcgtgtag

SEQ ID NO: 23183 - DNA, 87 bp, Artificial Sequence
  Description of Artificial Sequence: Synthetic coding sequence
atggtgagcgccgccgcccccagcctgctgatcctgctgctgctgctgctgggcagcgtgcccgccaccgacgccagaagcgtgtag

SEQ ID NO: 23184 - DNA, 423 bp, Artificial Sequence
  Description of Artificial Sequence: Synthetic coding sequence
atggtgagcgccgccgcccccagcctgctgatcctgctgctgctgctgctgggcagcgtgcccgccaccgacgccagaagcgtgcccctgaaggccaccttcctggaggacgtggccggcagcggcgaggccgagggcagcagcgccagcagccccagcctgccccccccctggacccccgccctgagccccaccagcatgggcccccagcccatcaccctgggcggccccagcccccccaccaacttcctggacggcatcgtggacttcttcagacagtacgtgatgctgatcgccgtggtgggcagcctggccttcctgctgatgttcatcgtgtgcgccgccgtgatcaccagacagaagcagaaggccagcgcctactaccccagcagcttccccaagaagaagtacgtggaccagtag

SEQ ID NO: 23185 - DNA, 135 bp, Artificial Sequence
  Description of Artificial Sequence: Synthetic coding sequence
atggtgagcgccgccgcccccagcctgctgatcctgctgctgctgctgctgggcagcgtgcccgccaccgacgccagaagcgtgcccctgaaggccaccttcctggaggacgtggccggcagcggcgaggcctag

SEQ ID NO: 23186 - DNA, 1020 bp, Artificial Sequence
  Description of Artificial Sequence: Synthetic coding sequence
atgagcggccagctggagagatgcgagagagagtggcacgagctggagggcgagttccaggagctgcaggagacccacagaatctacaagcagaagctggaggagctggccgccctgcagaccctgtgcagcagcagcatcagcaagcagaagaagcacctgaaggacctgaagctgaccctgcagagatgcaagagacacgccagcagagaggaggccgagctggtgcagcagatggccgccaacatcaaggagagacaggacgtgttcttcgacatggaggcctacctgcccaagaagaacggcctgtacctgaacctggtgctgggcaacgtgaacgtgaccctgctgagcaaccaggccaagttcgcctacaaggacgagtacgagaagttcaagctgtacctgaccatcatcctgctgctgggcgccgtggcctgcagattcgtgctgcactacagagtgaccgacgaggtgttcaacttcctgctggtgtggtactactgcaccctgaccatcagagagagcatcctgatcagcaacggcagcagaatcaagggctggtgggtgagccaccactacgtgagcaccttcctgagcggcgtgatgctgacctggcccaacggccccatctaccagaagttcagaaaccagttcctggccttcagcatcttccagagctgcgtgcagttcctgcagtactactaccagagaggctgcctgtacagactgagagccctgggcgagagaaaccacctggacctgaccgtggagggcttccagagctggatgtggagaggcctgaccttcctgctgcccttcctgttctgcggccacttctggcagctgtacaacgccgtgaccctgttcgagctgagcagccacgaggagtgcagagagtggcaggtgttcgtgctggccttcaccttcctgatcctgttcctgggcaacttcctgaccaccctgaaggtggtgcacgccaagctgcagaagaacagaggcaagaccaagcagccctag

SEQ ID NO: 23187 - DNA, 1020 bp, Artificial Sequence; identical to SEQ ID NO: 23186
  Description of Artificial Sequence: Synthetic coding sequence

SEQ ID NO: 23188 - DNA, 960 bp, Artificial Sequence
  Description of Artificial Sequence: Synthetic coding sequence
atggtgctgcccccccccgacagaagacacgtgtgcctgaccaccctggtgatcatgggcagcatggccgtgatggacgcctacctggtggagcagaaccagggccccagaaagatcggcgtgtgcatcatcgtgctggtgggcgacgtgtgcttcctgctggtgctgagatacgtggccgtgtgggtgggcgccgaggtgagaaccgccaagagaggctacgccatgatcctgtggttcctgtacatcttcgtgctggagatcaagctgtacttcatcttccagaactacaaggccgccagaagaggcgccgccgaccccgtggccagaaaggccctgaccctgctgctgagcgtgtgcgtgcccggcctgttcctgctgctggtggccctggacagaatggagtacgtgagaaccttcagaaagagagaggacctgagaggcagactgttctgggtggccctggacctgctggacctgctggacatgcaggccagcctgtgggagccccccagaagcggcctgcccctgtgggccgagggcctgaccttcttctactgctacatgctgctgctggtgctgccctgcgtggccctgagcgaggtgagcatgcagggcgagcacatcgccccccagaagatgatgctgtaccccgtgctgagcctggccaccgtgaacgtggtggccgtgctggccagagccgccaacatggccctgttcagagacagcagagtgagcgccatcttcgtgggcaagaacgtggtggccctggccaccaaggcctgcaccttcctggagtacagaagacaggtgagagacttccccccccccgccctgagcctggagctgcagcccccccccccccagagaaacagcgtgccccccccccccccccccctgcacggcccccccggcagaccccacatgagcagccccaccagagaccccctggacacctag

SEQ ID NO: 23189 - DNA, 960 bp, Artificial Sequence; identical to SEQ ID NO: 23188
  Description of Artificial Sequence: Synthetic coding sequence

SEQ ID NO: 23190 - DNA, 660 bp, Artificial Sequence
  Description of Artificial Sequence: Synthetic coding sequence
atgagcgagcaggaggcccaggcccccggcggcagaggcctgccccccgacatgctggccgagcaggtggagctgtggtggagccagcagcccagaagaagcgccctgtgcttcgtggtggccgtgggcctggtggccggctgcggcgccggcggcgtggccctgctgagcaccaccagcagcagaagcggcgagtggagactggccaccggcaccgtgctgtgcctgctggccctgctggtgctggtgaagcagctgatgagcagcgccgtgcaggacatgaactgcatcagacaggcccaccacgtggccctgctgagaagcggcggcggcgccgacgccctggtggtgctgctgagcggcctggtgctgctggtgaccggcctgaccctggccggcctggccgccgcccccgcccccgccagacccctggccgccatgctgagcgtgggcatcgccctggccgccctgggcagcctgctgctgctgggcctgctgctgtaccaggtgggcgtgagcggccactgccccagcatctgcatggccacccccagcacccacagcggccacggcggccacggcagcatcttcagcatcagcggccagctgagcgccggcagaagacacgagaccaccagcagcatcgccagcctgatctag

SEQ ID NO: 23191 - DNA, 660 bp, Artificial Sequence; identical to SEQ ID NO: 23190
  Description of Artificial Sequence: Synthetic coding sequence

SEQ ID NO: 23192 - DNA, 51 bp, Artificial Sequence
  Description of Artificial Sequence: Synthetic coding sequence
atgagcgagcaggaggcccaggcccccggcggcagaggcctgcccccctag

SEQ ID NO: 23193 - DNA, 693 bp, Artificial Sequence
  Description of Artificial Sequence: Synthetic coding sequence
atggtggtgttcggctacgaggccggcaccaagcccagagacagcggcgtggtgcccgtgggcaccgaggaggcccccaaggtgttcaagatggccgccagcatgcacggccagcccagccccagcctggaggacgccaagctgagaagacccatggtgatcgagatcatcgagaagaacttcgactacctgagaaaggagatgacccagaacatctaccagatggccaccttcggcaccaccgccggcttcagcggcatcttcagcaacttcctgttcagaagatgcttcaaggtgaagcacgacgccctgaagacctacgccagcctggccaccctgcccttcctgagcaccgtggtgaccgacaagctgttcgtgatcgacgccctgtacagcgacaacatcagcaaggagaactgcgtgttcagaagcagcctgatcggcatcgtgtgcggcgtgttctaccccagcagcctggccttcaccaagaacggcagactggccaccaagtaccacaccgtgcccctgccccccaagggcagagtgctgatccactggatgaccctgtgccagacccagatgaagctgatggccatccccctggtgttccagatcatgttcggcatcctgaacggcctgtaccactacgccgtgttcgaggagaccctggagaagaccatccacgaggagtag

SEQ ID NO: 23194 - DNA, 603 bp, Artificial Sequence
  Description of Artificial Sequence: Synthetic coding sequence
atggccgccagcatgcacggccagcccagccccagcctggaggacgccaagctgagaagacccatggtgatcgagatcatcgagaagaacttcgactacctgagaaaggagatgacccagaacatctaccagatggccaccttcggcaccaccgccggcttcagcggcatcttcagcaacttcctgttcagaagatgcttcaaggtgaagcacgacgccctgaagacctacgccagcctggccaccctgcccttcctgagcaccgtggtgaccgacaagctgttcgtgatcgacgccctgtacagcgacaacatcagcaaggagaactgcgtgttcagaagcagcctgatcggcatcgtgtgcggcgtgttctaccccagcagcctggccttcaccaagaacggcagactggccaccaagtaccacaccgtgcccctgccccccaagggcagagtgctgatccactggatgaccctgtgccagacccagatgaagctgatggccatccccctggtgttccagatcatgttcggcatcctgaacggcctgtaccactacgccgtgttcgaggagaccctggagaagaccatccacgaggagtag

SEQ ID NO: 23195 - DNA, 513 bp, Artificial Sequence
  Description of Artificial Sequence: Synthetic coding sequence
atggtggtgttcggctacgaggccggcaccaagcccagagacagcggcgtggtgcccgtgggcaccgaggaggcccccaaggtgttcaagatggccgccagcatgcacggccagcccagccccagcctggaggacgccaagctgagaagacccatggtgatcgagatcatcgagaagaacttcgactacctgagaaaggagatgacccagaacatctaccagatggccaccttcggcaccaccgccggcttcagcggcatcttcagcaacttcctgttcagaagatgcttcaaggtgaagcacgacgccctgaagacctacgccagcctggccaccctgcccttcctgagcaccgtggtgaccgacaagctgttcgtgatcgacgccctgtacagcgacaacatcagcaaggagaactgcgtgttcagaagcagcctgatcggcatcgtgtgcggcgtgttctaccccagcagcctggccttcaccaagaacggcagactggccaccaagtag

SEQ ID NO: 23196 - DNA, 177 bp, Artificial Sequence
  Description of Artificial Sequence: Synthetic coding sequence
atggtggtgttcggctacgaggccggcaccaagcccagagacagcggcgtggtgcccgtgggcaccgaggaggcccccaaggacaccaagtacatcagcaacggcgacatctggaacaacagctggttcctgtggaacatcctgaagctgcccgtgcagaccctgctgcagggctag

SEQ ID NO: 23197 - DNA, 426 bp, Artificial Sequence
  Description of Artificial Sequence: Synthetic coding sequence
atgccccccttcggctacaagaccgagaccagcaccgccgtggagaagaaggagaagcccctgcccagactgaacatccacagcggcttctggatcctggccagcatcgtggtgacctactacgtggacttcttcaagaccctgaaggagaacttccacaccagcagctggttcctgtgcggcagcgccctgctgctggtgagcctgagcatcgccttctactgcatcgtgtacctggagtggtactgcggcatcggcgagtacgacgtgaagtaccccgccctgatccccatcaccaccgccagcttcatcgccgccggcatctgcttcaacatcgccctgtggcacgtgtggagcttcttcacccccctgctgctgttcacccagttcatgggcgtggtgatgttcatcaccctgctgggctag

SEQ ID NO: 23198 - DNA, 498 bp, Artificial Sequence
  Description of Artificial Sequence: Synthetic coding sequence
atggacagcagcagagccagacagcagctgagaagaagattcctgctgctgcccgacgccgaggcccagctggacagagagggcgacgccggccccgagaccagcaccgccgtggagaagaaggagaagcccctgcccagactgaacatccacagcggcttctggatcctggccagcatcgtggtgacctactacgtggacttcttcaagaccctgaaggagaacttccacaccagcagctggttcctgtgcggcagcgccctgctgctggtgagcctgagcatcgccttctactgcatcgtgtacctggagtggtactgcggcatcggcgagtacgacgtgaagtaccccgccctgatccccatcaccaccgccagcttcatcgccgccggcatctgcttcaacatcgccctgtggcacgtgtggagcttcttcacccccctgctgctgttcacccagttcatgggcgtggtgatgttcatcaccctgctgggctag

SEQ ID NO: 23199 - DNA, 399 bp, Artificial Sequence
  Description of Artificial Sequence: Synthetic coding sequence
atggacagcagcagagccagacagcagctgagaagaagattcctgctgctgcccgacgccgaggcccagctggacagagagggcgacgccggccccgagaccagcaccgccgtggagaagaaggagaagcccctgcccagactgaacatccacagcggcttctggatcctggccagcatcgtggtgacctactacgtggacttcttcaagaccctgaaggagaacttccacaccagcagctggttcctgtgcggcagcgccctgctgctggtgagcctgagcatcgccttctactgcatcgtgtacctggagtggtactgcggcatcggcgagtacgacgtgaagtaccccgccctgatccccatcaccaccgccagcttcatcgccgccggcatctag

SEQ ID NO: 23200 - DNA, 498 bp, Artificial Sequence; identical to SEQ ID NO: 23198
  Description of Artificial Sequence: Synthetic coding sequence

SEQ ID NO: 23201 - DNA, 1089 bp, Artificial Sequence
  Description of Artificial Sequence: Synthetic coding sequence
atggacagccccgaggtgaccttcaccctggcctacctggtgttcgccgtgtgcttcgtgttcacccccaacgagttccacgccgccggcctgaccgtgcagaacctgctgagcggctggctgggcagcgaggacgccgccttcgtgcccttccacctgagaagaaccgccgccaccctgctgtgccacagcctgctgcccctgggctactacgtgggcatgtgcctggccgccagcgagaagagactgcacgccctgagccaggcccccgaggcctggagactgttcctgctgctggccgtgaccctgcccagcatcgcctgcatcctgatctactactggagcagagacagatgggcctgccaccccctggccagaaccctggccctgtacgccctgccccagagcggctggcaggccgtggccagcagcgtgaacaccgagttcagaagaatcgacaagttcgccaccggcgcccccggcgccagagtgatcgtgaccgacacctgggtgatgaaggtgaccacctacagagtgcacgtggcccagcagcaggacgtgcacctgaccgtgaccgagagcagacagcacgagctgagccccgacagcaacctgcccgtgcagctgctgaccatcagagtggccagcaccaaccccgccgtgcaggccttcgacatctggctgaacagcaccgagtacggcgagctgtgcgagaagctgagagcccccatcagaagagccgcccacgtggtgatccaccagagcctgggcgacctgttcctggagaccttcgccagcctggtggaggtgaaccccgcctacagcgtgcccagcagccaggagctggaggcctgcatcggctgcatgcagaccagagccagcgtgaagctggtgaagacctgccaggaggccgccaccggcgagtgccagcagtgctactgcagacccatgtggtgcctgacctgcatgggcaagtggttcgccagcagacaggaccccctgagacccgacacctggctggccagcagagtgccctgccccacctgcagagccagattctgcatcctggacgtgtgcaccgtgagatag

SEQ ID NO: 23202 - DNA, 1089 bp, Artificial Sequence; identical to SEQ ID NO: 23201
  Description of Artificial Sequence: Synthetic coding sequence

SEQ ID NO: 23203 - DNA, 699 bp, Artificial Sequence
  Description of Artificial Sequence: Synthetic coding sequence
atggacagccccgaggtgaccttcaccctggcctacctggtgttcgccgtgtgcttcgtgttcacccccaacgagttccacgccgccggcctgaccgtgcagaacctgctgagcggctggctgggcagcgaggacgccgccttcgtgcccttccacctgagaagaaccgccgccaccctgctgtgccacagcctgctgcccctgggctactacgtgggcatgtgcctggccgccagcgagaagagactgcacgccctgagccaggcccccgaggcctggagactgttcctgctgctggccgtgaccctgcccagcatcgcctgcatcctgatctactactggagcagagacagatgggcctgccaccccctggccagaaccctggccctgtacgccctgccccagagcggctggcaggccgtggccagcagcgtgaacaccgagttcagaagaatcgacaagttcgccaccggcgcccccggcgccagagtgatcgtgaccgacacctgggtgatgaaggtgaccacctacagagtgcacgtggcccagcagcaggacgtgcacctgaccgtgaccgagagcagacagcacgagctgagccccgacagcaacctgcccgtgcagctgctgaccatcagagtggccagcaccaaccccgccgtgcaggccttcgacatctggagctggagacccgcctag

SEQ ID NO: 23204 - DNA, 1272 bp, Artificial Sequence
  Description of Artificial Sequence: Synthetic coding sequence
atggcccaggccgtgtggagcagactgggcagaatcctgtggctggcctgcctgctgccctgggcccccgccggcgtggccgccggcctgtacgagctgaacctgaccaccgacagccccgccaccaccggcgccgtggtgaccatcagcgccagcctggtggccaaggacaacggcagcctggccctgcccgccgacgcccacctgtacagattccactggatccacacccccctggtgctgaccggcaagatggagaagggcctgagcagcaccatcagagtggtgggccacgtgcccggcgagttccccgtgagcgtgtgggtgaccgccgccgactgctggatgtgccagcccgtggccagaggcttcgtggtgctgcccatcaccgagttcctggtgggcgacctggtggtgacccagaacaccagcctgccctggcccagcagctacctgaccaagaccgtgctgaaggtgagcttcctgctgcacgaccccagcaacttcctgaagaccgccctgttcctgtacagctgggacttcggcgacggcacccagatggtgaccgaggacagcgtggtgtactacaactacagcatcatcggcaccttcaccgtgaagctgaaggtggtggccgagtgggaggaggtggagcccgacgccaccagagccgtgaagcagaagaccggcgacttcagcgccagcctgaagctgcaggagaccctgagaggcatccaggtgctgggccccaccctgatccagaccttccagaagatgaccgtgaccctgaacttcctgggcagcccccccctgaccgtgtgctggagactgaagcccgagtgcctgcccctggaggagggcgagtgccaccccgtgagcgtggccagcaccgcctacaacctgacccacaccttcagagaccccggcgactactgcttcagcatcagagccgagaacatcatcagcaagacccaccagtaccacaagatccaggtgtggcccagcagaatccagcccgccgtgttcgccttcccctgcgccaccctgatcaccgtgatgctggccttcatcatgtacatgaccctgagaaacgccacccagcagaaggacatggtggagaaccccgagccccccagcggcgtgagatgctgctgccagatgtgctgcggccccttcctgctggagacccccagcgagtacctggagatcgtgagagagaaccacggcctgctgccccccctgtacaagagcgtgaagacctacaccgtgtag

SEQ ID NO: 23205 - DNA, 966 bp, Artificial Sequence
  Description of Artificial Sequence: Synthetic coding sequence
atggcccaggccgtgtggagcagactgggcagaatcctgtggctggcctgcctgctgccctgggcccccgccggcgtggccgccgagttcctggtgggcgacctggtggtgacccagaacaccagcctgccctggcccagcagctacctgaccaagaccgtgctgaaggtgagcttcctgctgcacgaccccagcaacttcctgaagaccgccctgttcctgtacagctgggacttcggcgacggcacccagatggtgaccgaggacagcgtggtgtactacaactacagcatcatcggcaccttcaccgtgaagctgaaggtggtggccgagtgggaggaggtggagcccgacgccaccagagccgtgaagcagaagaccggcgacttcagcgccagcctgaagctgcaggagaccctgagaggcatccaggtgctgggccccaccctgatccagaccttccagaagatgaccgtgaccctgaacttcctgggcagcccccccctgaccgtgtgctggagactgaagcccgagtgcctgcccctggaggagggcgagtgccaccccgtgagcgtggccagcaccgcctacaacctgacccacaccttcagagaccccggcgactactgcttcagcatcagagccgagaacatcatcagcaagacccaccagtaccacaagatccaggtgtggcccagcagaatccagcccgccgtgttcgccttcccctgcgccaccctgatcaccgtgatgctggccttcatcatgtacatgaccctgagaaacgccacccagcagaaggacatggtggagaaccccgagccccccagcggcgtgagatgctgctgccagatgtgctgcggccccttcctgctggagacccccagcgagtacctggagatcgtgagagagaaccacggcctgctgccccccctgtacaagagcgtgaagacctacaccgtgtag

SEQ ID NO: 23206 - DNA, 1308 bp, Artificial Sequence
  Description of Artificial Sequence: Synthetic coding sequence
atggcccaggccgtgtggagcagactgggcagaatcctgtggctggcctgcctgctgccctgggcccccgccggcgtggccgccggcctgtacgagctgaacctgaccaccgacagccccgccaccaccggcgccgtggtgaccatcagcgccagcctggtggccaaggacaacggcagcctggccctgcccgccgacgcccacctgtacagattccactggatccacacccccctggtgctgaccggcaagatggagaagggcctgagcagcaccatcagagtggtgggccacgtgcccggcgagttccccgtgagcgtgtgggtgaccgccgccgactgctggatgtgccagcccgtggccagaggcttcgtggtgctgcccatcaccgagttcctggtgggcgacctggtggtgacccagaacaccagcctgccctggcccagcagctacctgaccaagaccgtgctgaaggtgagcttcctgctgcacgaccccagcaacttcctgaagaccgccctgttcctgtacagctgggacttcggcgacggcacccagatggtgaccgaggacagcgtggtgtactacaactacagcatcatcggcaccttcaccgtgaagctgaaggtggtggccgagtgggaggaggtggagcccgacgccaccagagccgtgaagcagaagaccggcgacttcagcgccagcctgaagctgcaggagaccctgagaggcatccaggtgctgggccccaccctgatccagaccttccagaagatgaccgtgaccctgaacttcctgggcagcccccccctgaccgtgtgctggagactgaagcccgagtgcctgcccctggaggagggcgagtgccaccccgtgagcgtggccagcaccgcctacaacctgacccacaccttcagagaccccggcgactactgcttcagcatcagagccgagaacatcatcagcaagacccaccagtaccacaagatccaggtgtggcccagcagaatccagcccgccgtgttcgccttcccctgcgccaccctgatcaccgtgatgctggccttcatcatgtacatgaccctgagaaacgccacccagcagaaggacatggtggaggtggccgacttcgacttcagccccatgagcgacaagaaccccgagccccccagcggcgtgagatgctgctgccagatgtgctgcggccccttcctgctggagacccccagcgagtacctggagatcgtgagagagaaccacggcctgctgccccccctgtacaagagcgtgaagacctacaccgtgtag

SEQ ID NO: 23207 - DNA, 1215 bp, Artificial Sequence
  Description of Artificial Sequence: Synthetic coding sequence
atggaccccgagctgaccggcagctggggcctgtacgagctgaacctgaccaccgacagccccgccaccaccggcgccgtggtgaccatcagcgccagcctggtggccaaggacaacggcagcctggccctgcccgccgacgcccacctgtacagattccactggatccacacccccctggtgctgaccggcaagatggagaagggcctgagcagcaccatcagagtggtgggccacgtgcccggcgagttccccgtgagcgtgtgggtgaccgccgccgactgctggatgtgccagcccgtggccagaggcttcgtggtgctgcccatcaccgagttcctggtgggcgacctggtggtgacccagaacaccagcctgccctggcccagcagctacctgaccaagaccgtgctgaaggtgagcttcctgctgcacgaccccagcaacttcctgaagaccgccctgttcctgtacagctgggacttcggcgacggcacccagatggtgaccgaggacagcgtggtgtactacaactacagcatcatcggcaccttcaccgtgaagctgaaggtggtggccgagtgggaggaggtggagcccgacgccaccagagccgtgaagcagaagaccggcgacttcagcgccagcctgaagctgcaggagaccctgagaggcatccaggtgctgggccccaccctgatccagaccttccagaagatgaccgtgaccctgaacttcctgggcagcccccccctgaccgtgtgctggagactgaagcccgagtgcctgcccctggaggagggcgagtgccaccccgtgagcgtggccagcaccgcctacaacctgacccacaccttcagagaccccggcgactactgcttcagcatcagagccgagaacatcatcagcaagacccaccagtaccacaagatccaggtgtggcccagcagaatccagcccgccgtgttcgccttcccctgcgccaccctgatcaccgtgatgctggccttcatcatgtacatgaccctgagaaacgccacccagcagaaggacatggtggagaaccccgagccccccagcggcgtgagatgctgctgccagatgtgctgcggccccttcctgctggagacccccagcgagtacctggagatcgtgagagagaaccacggcctgctgccccccctgtacaagagcgtgaagacctacaccgtgtag

SEQ ID NO: 23208 - DNA, 5652 bp, Artificial Sequence
  Description of Artificial Sequence: Synthetic coding sequence
atgggcaagagagccggcggcggcgccaccggcgccaccaccgccgccgtgagcaccagcgccggcgccggcctggagcccgccgccgccagaagcggcggccccagaagcgccgccgccggcctgctgggcgccctgcacctggtgatgaccctggtggtggccgccgccagagccgagaaggaggccttcgtgcagagcgagagcatcatcgaggtgctgagattcgacgacggcggcctgctgcagaccgagaccaccctgggcctgagcagctaccagcagaagagcatcagcctgtacagaggcaactgcagacccatcagattcgagccccccatgctggacttccacgagcagcccgtgggcatgcccaagatggagaaggtgtacctgcacaaccccagcagcgaggagaccatcaccctggtgagcatcagcgccaccaccagccacttccacgccagcttcttccagaacagaaagatcctgcccggcggcaacaccagcttcgacgtggtgttcctggccagagtggtgggcaacgtggagaacaccctgttcatcaacaccagcaaccacggcgtgttcacctaccaggtgttcggcgtgggcgtgcccaacccctacagactgagacccttcctgggcgccagagtgcccgtgaacagcagcttcagccccatcatcaacatccacaacccccacagcgagcccctgcaggtggtggagatgtacagcagcggcggcgacctgcacctggagctgcccaccggccagcagggcggcaccagaaagctgtgggagatccccccctacgagaccaagggcgtgatgagagccagcttcagcagcagagaggccgacaaccacaccgccttcatcagaatcaagaccaacgccagcgacagcaccgagttcatcatcctgcccgtggaggtggaggtgaccaccgcccccggcatctacagcagcaccgagatgctggacttcggcaccctgagaacccaggacctgcccaaggtgctgaacctgcacctgctgaacagcggcaccaaggacgtgcccatcaccagcgtgagacccaccccccagaacgacgccatcaccgtgcacttcaagcccatcaccctgaaggccagcgagagcaagtacaccaaggtggccagcatcagcttcgacgccagcaaggccaagaagcccagccagttcagcggcaagatcaccgtgaaggccaaggagaagagctacagcaagctggagatcccctaccaggccgaggtgctggacggctacctgggcttcgaccacgccgccaccctgttccacatcagagacagccccgccgaccccgtggagagacccatctacctgaccaacaccttcagcttcgccatcctgatccacgacgtgctgctgcccgaggaggccaagaccatgttcaaggtgcacaacttcagcaagcccgtgctgatcctgcccaacgagagcggctacatcttcaccctgctgttcatgcccagcaccagcagcatgcacatcgacaacaacatcctgctgatcaccaacgccagcaagttccacctgcccgtgagagtgtacaccggcttcctggactacttcgtgctgccccccaagatcgaggagagattcatcgacttcggcgtgctgagcgccaccgaggccagcaacatcctgttcgccatcatcaacagcaaccccatcgagctggccatcaagagctggcacatcatcggcgacggcctgagcatcgagctggtggccgtggagagaggcaacagaaccaccatcatcagcagcctgcccgagttcgagaagagcagcctgagcgaccagagcagcgtgaccctggccagcggctacttcgccgtgttcagagtgaagctgaccgccaagaagctggagggcatccacgacggcgccatccagatcaccaccgactacgagatcctgaccatccccgtgaaggccgtgatcgccgtgggcagcctgacctgcttccccaagcacgtggtgctgccccccagcttccccggcaagatcgtgcaccagagcctgaacatcatgaacagcttcagccagaaggtgaagatccagcagatcagaagcctgagcgaggacgtgagattctactacaagagactgagaggcaacaaggaggacctggagcccggcaagaagagcaagatcgccaacatctacttcgaccccggcctgcagtgcggcgaccactgctacgtgggcctgcccttcctgagcaagagcgagcccaaggtgcagcccggcgtggccatgcaggaggacatgtgggacgccgactgggacctgcaccagagcctgttcaagggctggaccggcatcaaggagaacagcggccacagactgagcgccatcttcgaggtgaacaccgacctgcagaagaacatcatcagcaagatcaccgccgagctgagctggcccagcatcctgagcagccccagacacctgaagttccccctgaccaacaccaactgcagcagcgaggaggagatcaccctggagaaccccgccgacgtgcccgtgtacgtgcagttcatccccctggccctgtacagcaaccccagcgtgttcgtggacaagctggtgagcagattcaacctgagcaaggtggccaagatcgacctgagaaccctggagttccaggtgttcagaaacagcgcccaccccctgcagagcagcaccggcttcatggagggcctgagcagacacctgatcctgaacctgatcctgaagcccggcgagaagaagagcgtgaaggtgaagttcacccccgtgcacaacagaaccgtgagcagcctgatcatcgtgagaaacaacctgaccgtgatggacgccgtgatggtgcagggccagggcaccaccgagaacctgagagtggccggcaagctgcccggccccggcagcagcctgagattcaagatcaccgaggccctgctgaaggactgcaccgacagcctgaagctgagagagcccaacttcaccctgaagagaaccttcaaggtggagaacaccggccagctgcagatccacatcgagaccatcgagatcagcggctacagctgcgagggctacggcttcaaggtggtgaactgccaggagttcaccctgagcgccaacgccagcagagacatcatcatcctgttcacccccgacttcaccgccagcagagtgatcagagagctgaagttcatcaccaccagcggcagcgagttcgtgttcatcctgaacgccagcctgccctaccacatgctggccacctgcgccgaggccctgcccagacccaactgggagctggccctgtacatcatcatcagcggcatcatgagcgccctgttcctgctggtgatcggcaccgcctacctggaggcccagggcatctgggagcccttcagaagaagactgagcttcgaggccagcaacccccccttcgacgtgggcagacccttcgacctgagaagaatcgtgggcatcagcagcgagggcaacctgaacaccctgagctgcgaccccggccacagcagaggcttctgcggcgccggcggcagcagcagcagacccagcgccggcagccacaagcagtgcggccccagcgtgcacccccacagcagccacagcaacagaaacagcgccgacgtggagaacgtgagagccaagaacagcagcagcaccagcagcagaaccagcgcccaggccgccagcagccagagcgccaacaagaccagccccctggtgctggacagcaacaccgtgacccagggccacaccgccggcagaaagagcaagggcgccaagcagagccagcacggcagccagcaccacgcccacagccccctggagcagcacccccagccccccctgcccccccccgtgccccagccccaggagccccagcccgagagactgagccccgcccccctggcccaccccagccaccccgagagagccagcagcgccagacacagcagcgaggacagcgacatcaccagcctgatcgaggccatggacaaggacttcgaccaccacgacagccccgccctggaggtgttcaccgagcagccccccagccccctgcccaagagcaagggcaagggcaagcccctgcagagaaaggtgaagccccccaagaagcaggaggagaaggagaagaagggcaagggcaagccccaggaggacgagctgaaggacagcctggccgacgacgacagcagcagcaccaccaccgagaccagcaaccccgacaccgagcccctgctgaaggaggacaccgagaagcagaagggcaagcaggccatgcccgagaagcacgagagcgagatgagccaggtgaagcagaagagcaagaagctgctgaacatcaagaaggagatccccaccgacgtgaagcccagcagcctggagctgccctacaccccccccctggagagcaagcagagaagaaacctgcccagcaagatccccctgcccaccgccatgaccagcggcagcaagagcagaaacgcccagaagaccaagggcaccagcaagctggtggacaacagaccccccgccctggccaagttcctgcccaacagccaggagctgggcaacaccagcagcagcgagggcgagaaggacagccccccccccgagtgggacagcgtgcccgtgcacaagcccggcagcagcaccgacagcctgtacaagctgagcctgcagaccctgaacgccgacatcttcctgaagcagagacagaccagccccacccccgccagccccagcccccccgccgccccctgccccttcgtggccagaggcagctacagcagcatcgtgaacagcagcagcagcagcgaccccaagatcaagcagcccaacggcagcaagcacaagctgaccaaggccgccagcctgcccggcaagaacggcaaccccaccttcgccgccgtgaccgccggctacgacaagagccccggcggcaacggcttcgccaaggtgagcagcaacaagaccggcttcagcagcagcctgggcatcagccacgcccccgtggacagcgacggcagcgacagcagcggcctgtggagccccgtgagcaaccccagcagccccgacttcacccccctgaacagcttcagcgccttcggcaacagcttcaacctgaccggcgaggtgttcagcaagctgggcctgagcagaagctgcaaccaggccagccagagaagctggaacgagttcaacagcggccccagctacctgtgggagagccccgccaccgaccccagccccagctggcccgccagcagcggcagccccacccacaccgccaccagcgtgctgggcaacaccagcggcctgtggagcaccacccccttcagcagcagcatctggagcagcaacctgagcagcgccctgcccttcaccacccccgccaacaccctggccagcatcggcctgatgggcaccgagaacagccccgccccccacgcccccagcaccagcagccccgccgacgacctgggccagacctacaacccctggagaatctggagccccaccatcggcagaagaagcagcgacccctggagcaacagccacttcccccacgagaactag

SEQ ID NO: 23209 - DNA, 999 bp, Artificial Sequence
  Description of Artificial Sequence: Synthetic coding sequence
tgaggcctgctgggcgccctgcacctggtgatgaccctggtggtggccgccgccagagccgagaaggaggccttcgtgcagagcgagagcatcatcgaggtgctgagattcgacgacggcggcctgctgcagaccgagaccaccctgggcctgagcagctaccagcagaagagcatcagcctgtacagaggcaactgcagacccatcagattcgagccccccatgctggacttccacgagcagcccgtgggcatgcccaagatggagaaggtgtacctgcacaaccccagcagcgaggagaccatcaccctggtgagcatcagcgccaccaccagccacttccacgccagcttcttccagaacagaaagatcctgcccggcggcaacaccagcttcgacgtggtgttcctggccagagtggtgggcaacgtggagaacaccctgttcatcaacaccagcaaccacggcgtgttcacctaccaggtgttcggcgtgggcgtgcccaacccctacagactgagacccttcctgggcgccagagtgcccgtgaacagcagcttcagccccatcatcaacatccacaacccccacagcgagcccctgcaggtggtggagatgtacagcagcggcggcgacctgcacctggagctgcccaccggccagcagggcggcaccagaaagctgtgggagatccccccctacgagaccaagggcgtgatgagagccagcttcagcagcagagaggccgacaaccacaccgccttcatcagaatcaagaccaacgccagcgacagcaccgagttcatcatcctgcccgtggaggtggaggtgaccaccgcccccggcatctacagcagcaccgagatgctggacttcggcaccctgagaacccaggacctgcccaaggtgctgaacctgcacctgctgaacagcggcaccaaggacgtgcccatcacccacagaagacagaagagccacctgagcttcctgggcaagtag

SEQ ID NO: 23210 - DNA, 969 bp, Artificial Sequence
  Description of Artificial Sequence: Synthetic coding sequence
atgaccctggtggtggccgccgccagagccgagaaggaggccttcgtgcagagcgagagcatcatcgaggtgctgagattcgacgacggcggcctgctgcagaccgagaccaccctgggcctgagcagctaccagcagaagagcatcagcctgtacagaggcaactgcagacccatcagattcgagccccccatgctggacttccacgagcagcccgtgggcatgcccaagatggagaaggtgtacctgcacaaccccagcagcgaggagaccatcaccctggtgagcatcagcgccaccaccagccacttccacgccagcttcttccagaacagaaagatcctgcccggcggcaacaccagcttcgacgtggtgttcctggccagagtggtgggcaacgtggagaacaccctgttcatcaacaccagcaaccacggcgtgttcacctaccaggtgttcggcgtgggcgtgcccaacccctacagactgagacccttcctgggcgccagagtgcccgtgaacagcagcttcagccccatcatcaacatccacaacccccacagcgagcccctgcaggtggtggagatgtacagcagcggcggcgacctgcacctggagctgcccaccggccagcagggcggcaccagaaagctgtgggagatccccccctacgagaccaagggcgtgatgagagccagcttcagcagcagagaggccgacaaccacaccgccttcatcagaatcaagaccaacgccagcgacagcaccgagttcatcatcctgcccgtggaggtggaggtgaccaccgcccccggcatctacagcagcaccgagatgctggacttcggcaccctgagaacccaggacctgcccaaggtgctgaacctgcacctgctgaacagcggcaccaaggacgtgcccatcacccacagaagacagaagagccacctgagcttcctgggcaagtag

SEQ ID NO: 23211 - DNA, 3237 bp, Artificial Sequence
  Description of Artificial Sequence: Synthetic coding sequence
atgttcggcgccgccagcagaatggacaccaccgccgtgtgcaccggcggcgtgaccgagagcagaggcatcgtggacagcctgcagaagttcagcagcctgcccgcctacctgcccaccaacctgcacatcagcaacgccgaggagagcttcttcctgaaggaggccaaccaggacctgaccagaaacagcagcctgcaggccagagtggagcccttcttcatctacagagccagaaccccccccatcatcaacgccagctacggccccttcagcgtggagaagatcatcccccaggagctgctgctgaccagcaccgccttcggcaacatggacaagttccccttcaactggaagctgaagagccacatcctggacagcagcatctacagcaacagacccaaggtgcagaccctgttctacgtgaccggcatgggctgggacgacagcgacctgaccgaggacctgccctgcgtgaagatgttcgccttccccgaggccagagaggtggccgccagctgcagactgcagggcgcccccggcctgtgcgtggccgagctggagctgctgcccgagtggttcagcagcggcctggacctggagcccgaggaggagatccccgccctgctgggcggcaccaccatggagctgttcttcaccctgtaccccgccgacaaggccggccagtgccccctggaggaggagggcaagtgggagaacaacatccacagcggcctggagagcccccagcaggccttccccgccagagagagaatcggcagcgtggtggtgtaccccacccaggacgacctgaagtggagcctggtgagcctggacgagaacgtggtgatcagcgtgcccctgaacctggtgagagagggcgacaccgccaccttcctggtgagcctgaccagcagcagcgtggccgaccagttcaccctgagaatcaaggccgccgccggcgtgaagatcaccgccgtgagagtgagcagcgaggaccagtgggccgtgcaggaggagatcgacaacggcagcacccagaccagcgccaccctgacctgcatgggccacagacccgacacccagagcagagtgaacggcagcttctacgagatcctgcaggtggacttcggcatcgacaacagcagcgacctggccggcgcccagcagatcacctggcaggtggagtaccccatcgaggacagcatgagcgagctggtggtgagcgagatcttcgtgagccagaccaccttcgtgggcatcgtgcccctggccatggacaccgaggtgctgaacaccgccatcctgaccggcaagcccgtgagcgtgcccgtgaaggtggtgggcgtgcaggaggacggcagcgtggtggacgtgagcgagagcgtggagtgcaagagcgccgacgaggacgtgatcaaggtgagcaacaactgcgacagcatcttcgtgaacggcaaggagatgaagagcaaggtggacaccatcgtgaacttcacccaccagcacttcaccagccagttcgaggtgaccgtgtgggcccccagactgcccctgcagatcgagatcagcgacaccgagctgagccagatcaagggctggagaatccccgtggccgccaacagaagacccaccagagagagcgacgacgaggacgacgaggagaagaagggcagaggctgcagcctgcagtaccagcacgccaccgtgagagtgctgacccagttcgtggccgagagccccgacctgggccagctgacctacatgctgggccccgactggcagttcgacatcaccgacctggtgaccgagttcatgaaggtggaggagcccaagatcgcccagctgcaggacggcagaaccctggccggcagagagcccggcatcaccaccgtgcaggtgctgagccccctgagcgacagcatcctggccgagaagaccgtgatcgtgctggacgacagagtgaccatcgccgagctgggcgtgcagctggtggccggcatgagcctgagcctgcagccccacagagccgacaagagagccatcgtgagcaccgccgccgccctggacgtgctgcagagcccccagcaggaggccatcgtgagcagctggatcctgttcagcgacggcagcgtgacccccctggacatctacgaccccaaggactacagcgtgaccgtgagcagcctggacgagatggtggtgagcgtgcaggccaacctggagagcaagtggcccatcgtggtggccgagggcgagggccagggccccctgatcaagctggagatgatgatcagcgagccctgccagaagaccaagagaaagagcgtgctggccgtgggcaagggcaacgtgaaggtgaagttcgagcccagcagcgacgagcaccagggcggcagcaacgacatcgagggcatcaacagagagtacaaggaccacctgagcaacagcatcgagagagagggcaaccaggagagagccgtgcaggagtggttccacagaggcacccccgtgggccaggaggagagcaccaacaagagcaccaccccccagagccccatggagggcaagaacaagctgctgaagagcggcggccccgacgccttcaccagcttccccacccagggcaagagccccgaccccaacaaccccagcgacctgaccgtgaccagcagaggcctgaccgacctggagatcggcatgtacgccctgctgtgcgtgttctgcctggccatcctggtgttcctgatcaactgcgtggccttcgcctggaagtacagacacaagagattcgccgtgagcgagcagggcaacatcccccacagccacgactgggtgtggctgggcaacgaggtggagctgctggagaaccccgtggacatcaccctgcccagcgaggagtgcaccaccatgatcgacagaggcctgcagttcgaggagagaaacttcctgctgaacggcagcagccagaagaccttccacagccagctgctgagacccagcgactacgtgtacgagaaggagatcaagaacgagcccatgaacagcagcggccccaagagaaagagagtgaagttcaccagctacaccaccatcctgcccgaggacggcggcccctacaccaacagcatcctgttcgacagcgacgacaacatcaagtgggtgtgccaggacatgggcctgggcgacagccaggacttcagagactacatggagagcctgcaggaccagatgtag

SEQ ID NO: 23212 - DNA, 3327 bp, Artificial Sequence
  Description of Artificial Sequence: Synthetic coding sequence
atgagaagcgagggcgccgcccccggccccgccgcccccctgtgcggcgccctgagcctgctgctgggcgccctgctgggcaaggtgatcgagggccacggcgtgaccgacaacatccagagattcagcagcctgcccccctacctgcccgtgagctaccacatcctgagagccgagaccagcttcttcctgaaggaggccaaccaggacctgctgagaaacagcagcctgcaggccagagtggagagcttcttcacctacaagaccagacagccccccgtgctgaacgccagctacggccccttcagcgtggagaaggtggtgcccctggacctgatgctgaccagcaacttcctgggccccaccaacaagttcagcttcgactggaagctgaaggcccacatcctgagagacaaggtgtacctgagcagacccaaggtgcaggtgctgttccacatcatgggcagagactgggacgaccacggcgccggcgagaagctgccctgcctgagagtgttcgccttcagagagaccagagaggtgagaggcagctgcagactgaagggcgacctgggcctgtgcgtggccgagctggagctgctgagcagctggttcagcgcccccaccgtgggcgccggcagaaagaagagcatggaccagcccgagggcacccccgtggagctgtactacaccgtgcaccccggcaacgagagaggcgactgcgccggcggcgacttcagaaagggcaacgccatcagacccggcaaggacggcctggaggagaccaccagccacctgcagagaatcggcaccgtgggcctgtacagagcccaggacagcgcccagctgagcgagctgagactggacggcaacgtggtgatctggctgcccagcagacccgtgaagcagggcgaggtggtgaccgcctacgtgaccatcagcagcaacagcagcgtggacctgttcatcctgagagccaaggtgaagaagggcgtgaacatcctgagcgcccagaccagagagcccagacagtggggcgtgaagcaggaggtgggcagcggcggcaagcacgtgaccgccaccgtggcctgccagagactgggccccagccccagaaacagaagcagcagcctgttcaacgaggtggtgcagatgaacttcgagatcgccagcttcagcagcctgagcggcacccagcccatcacctggcaggtggagtaccccagaaagggcaccaccgacatcgccgtgagcgagatcttcgtgagccagaaggacctggtgggcatcgtgcccctggccatggacaccgagatcctgaacaccgccgtgctgaccggcaagaccgtggccatgcccatcaaggtggtgagcgtggaggagaacagcgccgtgatggacatcagcgagagcgtggagtgcaagagcaccgacgaggacgtgatcaaggtgagcgagagatgcgactacatcttcgtgaacggcaaggagatcaagggcaagatggacgccgtggtgaacttcacctaccagtacctgagcgcccccctgtgcgtgaccgtgtgggtgcccagactgcccctgcagatcgaggtgagcgacaccgagctgagccagatcaagggctggagagtgcccatcgtgaccaacaagagacccaccagagagagcgaggacgaggacgaggaggagagaagaggcagaggctgcgccctgcagtaccagcacgccaccgtgagagtgctgacccagttcgtgagcgagggcgccggcccctggggccagcccaactacctgctgagccccaactggcagttcgacatcacccacctggtggccgacttcatgaagctggaggagccccacgtggccaccctgcaggacagcagagtgctggtgggcagagaggtgggcatgaccaccatccaggtgctgagccccctgagcgacagcatcctggccgagaagaccatcaccgtgctggacgacaaggtgagcgtgaccgacctggccatccagctggtggccggcctgagcgtggccctgtaccccaacgccgagaacagcaaggccgtgaccgccgtggtgaccgccgaggaggtgctgagaacccccaagcaggaggccgtgttcagcacctggctgcagttcagcgacggcagcgtgacccccctggacatctacgacaccaaggacttcagcctggccgccaccagccaggacgaggccgtggtgagcgtgccccagcccagaagccccagatggcccgtggtggtggccgagggcgagggccagggccccctgatcagagtggacatgaccatcgccgaggcctgccagaagagcaagagaaagagcatcctggccgtgggcgtgggcaacgtgagagtgaagttcggccagaacgacgccgacagcagccccggcggcgactacgaggaggacgagatcaagaaccacgccagcgacagaagacagaagggccagcaccacgagagaaccggccaggacggccacctgtacggcagcagccccgtggagagagaggagggcgccctgagaagagccaccaccaccgccagaagcctgctggacaacaaggtggtgaagaacagcagagccgacggcggcagactggccggcgagggccagctgcagaacatccccatcgacttcaccaacttccccgcccacgtggacctgcccaaggccggcagcggcctggaggagaacgacctggtgcagacccccagaggcctgagcgacctggagatcggcatgtacgccctgctgggcgtgttctgcctggccatcctggtgttcctgatcaactgcgccaccttcgccctgaagtacagacacaagcaggtgcccctggagggccaggccagcatgacccacagccacgactgggtgtggctgggcaacgaggccgagctgctggagagcatgggcgacgccccccccccccaggacgagcacaccaccatcatcgacagaggccccggcgcctgcgaggagagcaaccacctgctgctgaacggcggcagccacaagcacgtgcagagccagatccacagaagcgccgacagcggcggcagacagggcagagagcagaagcaggaccccctgcacagccccaccagcaagagaaagaaggtgaagttcaccaccttcaccaccatcccccccgacgacagctgccccaccgtgaacagcatcgtgagcagcaacgacgaggacatcaagtgggtgtgccaggacgtggccgtgggcgcccccaaggagctgagaaactacctggagaagctgaaggacaaggcctag

SEQ ID NO: 23213 - DNA, 1914 bp, Artificial Sequence
  Description of Artificial Sequence: Synthetic coding sequence
atgcagagagacgagagcagccccttcccccccctgttcagcctgaccagcagccaggtgagcgacagatgcgactacgtgttcgtgaacggcaaggagatgaagggcaaggtgaacgtggtggtgaacttcacctaccagcacctgagcagccccctggagatgaccgtgtgggtgcccagactgcccctgcagatcgaggtgagcgacaccgagctgaaccagatcaagggctggagagtgcccatcgtgagcagcagaagacccgccggcgacagcgaggaggaggaggacgacgagagaagaggcagaggctgcaccctgcagtaccagcacgccatggtgagagtgctgacccagttcgtggccgaggccgccggccccggcggccacctggcccacctgctgggcagcgactggcaggtggacatcaccgagctgatcaacgacttcatgcaggtggaggagcccagaatcgccaagctgcagggcggccagatcctgatgggccaggagctgggcatgaccaccatccagatcctgagccccctgagcgacaccatcctggccgagaagaccatcaccgtgctggacgagaaggtgaccatcaccgacctgggcgtgcagctggtgaccggcctgagcctgagcctgcagctgagccccggcagcaacagagccatcttcgccaccgccgtggcccaggagctgctgcagagacccaagcaggaggccgccatcagctgctgggtgcagttcagcgacggcagcgtgacccccctggacatctacgacggcaaggacttcagcctgatggccaccagcctggacgagaaggtggtgagcatccaccaggaccccaagttcaagtggcccatcatcgccgccgagaccgagggccagggcaccctggtgaaggtggagatggtgatcagcgagagctgccagaagagcaagagaaagagcgtgctggccgtgggcaccgccaacatcaaggtgaagttcggccagaacgacgccaaccccaacaccagcgacagcagacacaccggcgccggcgtgcacatggagaacaacgtgagcgacagaagacccaagaagcccagccaggagtggggcagccaggagggccagtactacggcagcagcagcatgggcctgatggagggcagaggcaccaccaccgacagaagcatcctgcagaagaagaagggccaggagagcctgctggacgacaacagccacctgcagaccatccccagcgacctgaccagcttccccgcccaggtggacctgcccagaagcaacggcgagatggacggcaacgacctgatgcaggccagcaagggcctgagcgacctggagatcggcatgtacgccctgctgggcgtgttctgcctggccatcctggtgttcctgatcaactgcgtgaccttcgccctgaagtacagacacaagcaggtgcccttcgaggagcaggagggcatgagccacagccacgactgggtgggcctgagcaacagaaccgagctgctggagaaccacatcaacttcgccagcagccaggacgagcagatcaccgccatcgacagaggcatggacttcgaggagagcaagtacctgctgagcaccaacagccagaagagcatcaacggccagctgttcaagcccctgggccccatcatcatcgacggcaaggaccagaagagcgagccccccaccagccccaccagcaagagaaagagagtgaagttcaccaccttcaccgccgtgagcagcgacgacgagtaccccaccagaaacagcatcgtgatgagcagcgaggacgacatcaagtgggtgtgccaggacctggaccccggcgactgcaaggagctgcacaactacatggagagactgcacgagaacgtgtag

SEQ ID NO: 23214 - DNA, 3300 bp, Artificial Sequence
  Description of Artificial Sequence: Synthetic coding sequence
atgtgccccagcgagatgggcaccctgtggcaccactggagccccgtgctgatcagcctggccgccctgttcagcaaggtgaccgagggcagaggcatcctggagagcatccagagattcagcctgctgcccacctacctgcccgtgacctaccacatcaacaacgccgacgtgagcttcttcctgaaggaggccaaccaggacatcatgagaaacagcagcctgcagagcagagtggagagcttcctgatctacaagagcagaagactgcccgtgctgaacgccagctacggccccttcagcatcgagcaggtggtgccccaggacctgatgctgcccagcaaccccttcggcttcaccaacaagttcagcctgaactggaagctgaaggcccacatcctgagagacaaggtgtacctgagcagacccaaggtgcaggtgctgttccacatcatgggcagagactgggacgacagaagcgccggcgagaagctgccctgcctgagagtgttcgccttcagagagaccagagaggtgagaggcagctgcagactgcagggcgacctgggcctgtgcgtggccgagctggagctgctgagcagctggttcagcccccccaccgtggtggccggcagaagaaagagcgtggaccagcccgagggcacccccgtggagctgtactacaccgtgcaccccggcggcgagagaggcgactgcgtgagagaggacgccagaagaagcaacggcatcagaaccggccacagcgacatcgacgagagcggcccccccctgcagagaatcggcagcatcttcctgtaccagacccacagaaagcccagcctgagagagctgagactggacaacagcgtggccatccactacatccccaagaccgtgagaaagggcgacgtgctgaccttccccgtgagcatcagcagaaacagcaccgaggacagattcaccctgagagccaaggtgaagaagggcgtgaacatcatcggcgtgagagccagcagccccagcatctgggacgtgaaggagagaaccgactacaccggcaagtacgcccccgccgtgatcgtgtgccagaagaaggccgccggcagcgagaacagcgccgacggcgccagctacgaggtgatgcagatcgacgtggaggtggaggagcccggcgacctgcccgccacccagctggtgacctggcaggtggagtaccccggcgagatcaccagcgacctgggcgtgagcaagatctacgtgagccccaaggacctgatcggcgtggtgcccctggccatggaggccgagatcctgaacaccgccatcctgaccggcaagaccgtggccgtgcccgtgaaggtggtgagcgtggaggacgacggcaccgtgaccgagctgctggagagcgtggagtgcagaagcagcgacgaggacgtgatcaaggtgagcgacagatgcgactacgtgttcgtgaacggcaaggagatgaagggcaaggtgaacgtggtggtgaacttcacctaccagcacctgagcagccccctggagatgaccgtgtgggtgcccagactgcccctgcagatcgaggtgagcgacaccgagctgaaccagatcaagggctggagagtgcccatcgtgagcagcagaagacccgccggcgacagcgaggaggaggaggacgacgagagaagaggcagaggctgcaccctgcagtaccagcacgccatggtgagagtgctgacccagttcgtggccgaggccgccggccccggcggccacctggcccacctgctgggcagcgactggcaggtggacatcaccgagctgatcaacgacttcatgcaggtggaggagcccagaatcgccaagctgcagggcggccagatcctgatgggccaggagctgggcatgaccaccatccagatcctgagccccctgagcgacaccatcctggccgagaagaccatcaccgtgctggacgagaaggtgaccatcaccgacctgggcgtgcagctggtgaccggcctgagcctgagcctgcagctgagccccggcagcaacagagccatcttcgccaccgccgtggcccaggagctgctgcagagacccaagcaggaggccgccatcagctgctgggtgcagttcagcgacggcagcgtgacccccctggacatctacgacggcaaggacttcagcctgatggccaccagcctggacgagaaggtggtgagcatccaccaggaccccaagttcaagtggcccatcatcgccgccgagaccgagggccagggcaccctggtgaaggtggagatggtgatcagcgagagctgccagaagagcaagagaaagagcgtgctggccgtgggcaccgccaacatcaaggtgaagttcggccagaacgacgccaaccccaacaccagcgacagcagacacaccggcgccggcgtgcacatggagaacaacgtgagcgacagaagacccaagaagcccagccaggagtggggcagccaggagggccagtactacggcagcagcagcatgggcctgatggagggcagaggcaccaccaccgacagaagcatcctgcagaagaagaagggccaggagagcctgctggacgacaacagccacctgcagaccatccccagcgacctgaccagcttccccgcccaggtggacctgcccagaagcaacggcgagatggacggcaacgacctgatgcaggccagcaagggcctgagcgacctggagatcggcatgtacgccctgctgggcgtgttctgcctggccatcctggtgttcctgatcaactgcgtgaccttcgccctgaagtacagacacaagcaggtgcccttcgaggagcaggagggcatgagccacagccacgactgggtgggcctgagcaacagaaccgagctgctggagaaccacatcaacttcgccagcagccaggacgagcagatcaccgccatcgacagaggcatggacttcgaggagagcaagtacctgctgagcaccaacagccagaagagcatcaacggccagctgttcaagcccctgggccccatcatcatcgacggcaaggaccagaagagcgagccccccaccagccccaccagcaagagaaagagagtgaagttcaccaccttcaccgccgtgagcagcgacgacgagtaccccaccagaaacagcatcgtgatgagcagcgaggacgacatcaagtgggtgtgccaggacctggaccccggcgactgcaaggagctgcacaactacatggagagactgcacgagaacgtgtag

SEQ ID NO: 23215 - DNA, 2955 bp, Artificial Sequence
  Description of Artificial Sequence: Synthetic coding sequence
atggcccccggcatgagcggcagaggcggcgccgccctgctgtgcctgagcgccctgctggcccacgccagcggcagaagccaccccgccagccccagcccccccggcccccaggccagccccgtgctgcccgtgagctacagactgagccacaccagactggccttcttcctgagagaggccagaccccccagccccgccgtggccaacagcagcctgcagagaagcgagcccttcgtggtgttccagaccaaggagctgcccgtgctgaacgtgagcctgggccccttcagcaccagccaggtggtggccagagagctgctgcagcccagcagcaccctggacatccccgagagactgaccgtgaactggaaggtgagagccttcatcgtgagaagccacgtgcccgccagccagcccgtggtgcaggtgctgttctacgtggccggcagagactgggacgacttcggcgtgaccgagagactgccctgcgtgagactgcacgccttcagagacgccagagagcaccccctgctgagaatcggcagcatcagcctgttcagacccccccccagaagaaccctgcaggagcacagactggacagcaacctgatgatcagactgcccgacagacccctgaagcccggcgaggtgctgagcatcctgctgtacctggcccccaacagcagcagccccagcagccccagcgtggagcacttcaccctgagagtgaaggccaagaagggcgtgaccctgctgggcaccaagagcagaagcggccagtggcacgtgaccagcgagctgctgaccggcgccaagcacagcaccgccaccgtggacgtggcctgggcccagagcacccccctgccccccagagagggccagggccccctggagatcctgcagctggacttcgagatggagaacttcaccagccagagcgtgaagagaagaatcatgtggcacatcgactacagaggccacggcgccctgcccgacctggagagagccgtgaccgagctgaccgtgatccagagagacgtgcaggccatcctgcccctggccatggacaccgagatcatcaacaccgccatcctgaccggcagaaccgtggccatccccgtgaaggtgatcgccatcgaggtgaacggcctggtgctggacatcagcgccctggtggagtgcgagagcgacaacgaggacatcatcaaggtgagcagcagctgcgactacgtgttcgtgagcggcaaggagagcagaggcagcatgaacgccagagtgaccttcagatacgacgtgctgaacgcccccctggagatgaccgtgtgggtgcccaagctgcccctgcacatcgagctgagcgacgccagactgagccaggtgaagggctggagagtgcccatcctgcccgacagaagaagcgtgagagagagcgaggacgaggacgaggaggaggaggagagaagacagagcgccagcagaggctgcaccctgcagtaccagcacgccaccctgcaggtgttcacccagttccacaccaccagcagcgagggcaccgaccaggtggtgaccatgctgggccccgactggctggtggaggtgaccgacctggtgagcgacttcatgagagtgggcgaccccagagtggcccacatggtggacagcagcaccctggccggcctggagcccggcaccacccccttcaaggtggtgagccccctgaccgaggccgtgctgggcgagaccctgctgaccgtgaccgaggagaaggtgagcatcacccagctgcaggcccaggtggtggccagcctggccctgagcctgagacccagccccggcagcagccacaccatcctggccaccaccgccgcccagcagaccctgagcttcctgaagcaggaggccctgctgagcctgtggctgagctacagcgacggcaccaccgcccccctgagcctgtacagccccagagactacggcctgctggtgagcagcctggacgagcacgtggccaccgtgacccaggacagagccttccccctggtggtggccgaggccgagggcagcggcgagctgctgagagccgagctgaccatcgccgagagctgccagaagaccaagagaaagagcgtgctggccaccacccccgtgggcctgagagtgcacttcggcagagacgaggaggaccccacctacgactaccccggccccagccagcccggccccggcggcggcgaggacgaggccagaggcgccggcccccccggcagcgccctgcccgcccccgaggcccccggccccggcaccgccagccccgtggtgccccccaccgaggacttcctgcccctgcccaccggcttcctgcaggtgcccagaggcctgaccgacctggagatcggcatgtacgccctgctgggcgtgttctgcctggccatcctggtgttcctgatcaactgcatcgtgttcgtgctgagatacagacacaagagaatcccccccgagggccagaccagcatggaccacagccaccactgggtgttcctgggcaacggccagcccctgagagtgcagggcgagctgagcccccccgccggcaaccccctggagaccgtgcccgccttctgccacggcgaccaccacagcagcggcagcagccagaccagcgtgcagagccaggtgcacggcagaggcgacggcagcagcggcggcagcgccagagaccaggccgaggaccccgccagcagccccaccagcaagagaaagagagtgaagttcaccaccttcaccaccctgcccagcgaggagctggcctacgacagcgtgcccgccggcgaggaggacgaggaggaggaggaggacctgggctggggctgccccgacgtggccggccccaccagacccaccgccccccccgacctgcacaactacatgagaagaatcaaggagatcgcctag

SEQ ID NO: 23216 - DNA, 390 bp, Artificial Sequence
  Description of Artificial Sequence: Synthetic coding sequence
atgaccagccaccactgcgtgggccccggcaaccacatcagctggagcggccacgagaaggagcacagactggactactgccccgaggtgaccttccccctgaccaagggcttccccctgggctacaccctgctgttcaacttcgccagctaccccttcctgctgcccagcaagatcaagaccctgctgagaaacaaggacagcttcctgaacatcctgtgccccgcctgcctgctgctgatcagaagatgcaacatcgagtacagcagcaccggcctgaacttcctgaacaccttcaccgtgagcctgatcgtgaccgtgatccccctgctgcagaacgtgcccgtgcccctgggcaacaacgtgggcaagatgcaggtgtacgagtag

SEQ ID NO: 23217 - DNA, 588 bp, Artificial Sequence
  Description of Artificial Sequence: Synthetic coding sequence
atgagcgccgccagaccccagttcagcatcgacgacgccttcgagctgagcctggaggacggcggccccggccccgagagcagcggcgtggccagattcggccccctgcacttcgagagaagagccagattcgaggtggccgacgaggacaagcagagcagactgagataccagaacctggagaacgacgaggacggcgcccaggccagccccgagcccgacggcggcgtgggcaccagagacagcagcagaaccagcatcagaagcagccagtggagcttcagcaccatcagcagcagcacccagagaagctacaacacctgctgcagctggacccagcaccccctgatccagaagaacagaagagtggtgctggccagcttcctgctgctgctgctgggcctggtgctgatcctggtgggcgtgggcctggaggccacccccagccccggcgtgagcagcgccatcttcttcgtgcccggcttcctgctgctggtgcccggcgtgtaccacgtgatcttcatctactgcgccgtgaagggccacagaggcttccagttcttctacctgccctacttcgagaagtag

SEQ ID NO: 23218 - DNA, 543 bp, Artificial Sequence
  Description of Artificial Sequence: Synthetic coding sequence
atgagcgccgccagaccccagttcagcatcgacgacgccttcgagctgagcctggaggacggcggccccggccccgagagcagcggcgtggccagattcggccccctgcacttcgagagaagagccagattcgaggtggccgacgaggacaagcagagcagactgagataccagaacctggagaacgacgaggacggcgcccaggccagccccgagcccgacggcggcgtgggcaccagagacagcagcagaaccagcatcagaagcagccagtggagcttcagcaccatcagcagcagcacccagagaagctacaacacctgctgcagctggacccagcaccccctgatccagaagaacagaagagtggtgctggccagcttcctgctgctgctgctgggcctgggcgtgagcagcgccatcttcttcgtgcccggcttcctgctgctggtgcccggcgtgtaccacgtgatcttcatctactgcgccgtgaagggccacagaggcttccagttcttctacctgccctacttcgagaagtag

SEQ ID NO: 23219 - DNA, 1377 bp, Artificial Sequence
  Description of Artificial Sequence: Synthetic coding sequence
atggccgccctgagcaagagcatcccccacaactgctacgagatcggccacacctggcaccccagctgcagagtgagcttcctgcagatcaccggcggcgccctggaggagagcctgaagatctacgcccccctgtacctgatcgccgccatcctgagaaagagaaagctggactactacctgcacaagctgctgcccgagatcctgcagagcgccagcttcctgaccgccaacggcgccctgtacatggccttcttctgcatcctgagaaagatcctgggcaagttctacagctggacccccggcttcggcgccgccctgcccgccagctacgtggccatcctgatcgagagaaagagcagaagaggcctgctgaccatctacatggccaacctggccaccgagaccctgttcagaatgggcgtggccagaggcaccatcaccaccctgagaaacggcgaggtgctgctgttctgcatcaccgccgccatgtacatgttcttcttcagatgcaaggacggcctgaagggcttcaccttcagcgccctgagattcatcgtgggcaaggaggagatccccacccacagcttcagccccgaggccgcctacgccaaggtggagcagaagagagagcagcacgaggagaagcccggcagaatgaacatgatcggcctggtgagaaagttcgtggacagcatctgcaagcacggccccagacacagatgctgcaagcactacgaggacaactgcatcagctactgcatcaagggcttcatcagaatgttcagcgtgggctacctgatccagtgctgcctgagaatccccagcgccttcagacacctgttcacccagcccagcagactgctgagcctgttctacaacaaggagaacttccagctgggcgccttcctgggcagcttcgtgagcatctacaagggcaccagctgcttcctgagatggatcagaaacctggacgacgagctgcacgccatcatcgccggcttcctggccggcatcagcatgatgttctacaagagcaccaccatcagcatgtacctggccagcaagctggtggagaccatgtacttcaagggcatcgaggccggcaaggtgccctacttcccccacgccgacaccatcatctacagcatcagcaccgccatctgcttccaggccgccgtgatggaggtgcagaccctgagacccagctactggaagttcctgctgagactgaccaagggcaagttcgccgtgatgaacagaaaggtgctggacgtgttcggcaccggcgccagcaagcacttccaggacttcatccccagactggaccccagatacaccaccgtgacccccgagctgcccaccgagttcagctag

SEQ ID NO: 23220 - DNA, 1311 bp, Artificial Sequence
  Description of Artificial Sequence: Synthetic coding sequence
atggccgccctgagcaagagcatcccccacaactgctacgagatcggccacacctggcaccccagctgcagagtgagcttcctgcagatcaccggcggcgccctggaggagagcctgaagatctacgcccccctgtacctgatcgccgccatcctgagaaagagaaagctggactactacctgcacaagctgctgcccgagatcctgcagagcgccagcttcctgaccgccaacggcgccctgtacatggccttcttctgcatcctgagaaagatcctgggcaagttctacagctggacccccggcttcggcgccgccctgcccgccagctacgtggccatcctgatcgagagaaagagcagaagaggcctgctgaccatctacatggccaacctggtgctgctgttctgcatcaccgccgccatgtacatgttcttcttcagatgcaaggacggcctgaagggcttcaccttcagcgccctgagattcatcgtgggcaaggaggagatccccacccacagcttcagccccgaggccgcctacgccaaggtggagcagaagagagagcagcacgaggagaagcccggcagaatgaacatgatcggcctggtgagaaagttcgtggacagcatctgcaagcacggccccagacacagatgctgcaagcactacgaggacaactgcatcagctactgcatcaagggcttcatcagaatgttcagcgtgggctacctgatccagtgctgcctgagaatccccagcgccttcagacacctgttcacccagcccagcagactgctgagcctgttctacaacaaggagaacttccagctgggcgccttcctgggcagcttcgtgagcatctacaagggcaccagctgcttcctgagatggatcagaaacctggacgacgagctgcacgccatcatcgccggcttcctggccggcatcagcatgatgttctacaagagcaccaccatcagcatgtacctggccagcaagctggtggagaccatgtacttcaagggcatcgaggccggcaaggtgccctacttcccccacgccgacaccatcatctacagcatcagcaccgccatctgcttccaggccgccgtgatggaggtgcagaccctgagacccagctactggaagttcctgctgagactgaccaagggcaagttcgccgtgatgaacagaaaggtgctggacgtgttcggcaccggcgccagcaagcacttccaggacttcatccccagactggaccccagatacaccaccgtgacccccgagctgcccaccgagttcagctag

SEQ ID NO: 23221 - DNA, 483 bp, Artificial Sequence
  Description of Artificial Sequence: Synthetic coding sequence
atggccgccctgagcaagagcatcccccacaactgctacgagatcggccacacctggcaccccagctgcagagtgagcttcctgcagatcaccggcggcgccctggaggagagcctgaagatctacgcccccctgtacctgatcgccgccatcctgagaaagagaaagctggactactacctgcacaagctgctgcccgagatcctgcagagcgccagcttcctgaccgccaacggcgccctgtacatggccttcttctgcatcctgagaaagatcctgggcaagttctacagctggacccccggcttcggcgccgccctgcccgccagctacgtggccatcctgatcgagagaaagagcagaagaggcctgctgaccatctacatggccaacctgatggagagccactgcctgccccaggccggcgtgatcagcgccccctgcagcctgtgcctgcccggcagcagagacagccccgcctag

SEQ ID NO: 23222 - DNA, 960 bp, Artificial Sequence
  Description of Artificial Sequence: Synthetic coding sequence
atgggcgtggccagaggcaccatcaccaccctgagaaacggcgaggtgctgctgttctgcatcaccgccgccatgtacatgttcttcttcagatgcaaggacggcctgaagggcttcaccttcagcgccctgagattcatcgtgggcaaggaggagatccccacccacagcttcagccccgaggccgcctacgccaaggtggagcagaagagagagcagcacgaggagaagcccggcagaatgaacatgatcggcctggtgagaaagttcgtggacagcatctgcaagcacggccccagacacagatgctgcaagcactacgaggacaactgcatcagctactgcatcaagggcttcatcagaatgttcagcgtgggctacctgatccagtgctgcctgagaatccccagcgccttcagacacctgttcacccagcccagcagactgctgagcctgttctacaacaaggagaacttccagctgggcgccttcctgggcagcttcgtgagcatctacaagggcaccagctgcttcctgagatggatcagaaacctggacgacgagctgcacgccatcatcgccggcttcctggccggcatcagcatgatgttctacaagagcaccaccatcagcatgtacctggccagcaagctggtggagaccatgtacttcaagggcatcgaggccggcaaggtgccctacttcccccacgccgacaccatcatctacagcatcagcaccgccatctgcttccaggccgccgtgatggaggtgcagaccctgagacccagctactggaagttcctgctgagactgaccaagggcaagttcgccgtgatgaacagaaaggtgctggacgtgttcggcaccggcgccagcaagcacttccaggacttcatccccagactggaccccagatacaccaccgtgacccccgagctgcccaccgagttcagctag

SEQ ID NO: 23223 - DNA, 888 bp, Artificial Sequence
  Description of Artificial Sequence: Synthetic coding sequence
atgtacatgttcttcttcagatgcaaggacggcctgaagggcttcaccttcagcgccctgagattcatcgtgggcaaggaggagatccccacccacagcttcagccccgaggccgcctacgccaaggtggagcagaagagagagcagcacgaggagaagcccggcagaatgaacatgatcggcctggtgagaaagttcgtggacagcatctgcaagcacggccccagacacagatgctgcaagcactacgaggacaactgcatcagctactgcatcaagggcttcatcagaatgttcagcgtgggctacctgatccagtgctgcctgagaatccccagcgccttcagacacctgttcacccagcccagcagactgctgagcctgttctacaacaaggagaacttccagctgggcgccttcctgggcagcttcgtgagcatctacaagggcaccagctgcttcctgagatggatcagaaacctggacgacgagctgcacgccatcatcgccggcttcctggccggcatcagcatgatgttctacaagagcaccaccatcagcatgtacctggccagcaagctggtggagaccatgtacttcaagggcatcgaggccggcaaggtgccctacttcccccacgccgacaccatcatctacagcatcagcaccgccatctgcttccaggccgccgtgatggaggtgcagaccctgagacccagctactggaagttcctgctgagactgaccaagggcaagttcgccgtgatgaacagaaaggtgctggacgtgttcggcaccggcgccagcaagcacttccaggacttcatccccagactggaccccagatacaccaccgtgacccccgagctgcccaccgagttcagctag

SEQ ID NO: 23224 - DNA, 804 bp, Artificial Sequence
  Description of Artificial Sequence: Synthetic coding sequence
atgacccagtgctgcttcctgagagtgcaccccctgttcttctggttctggagcttccaccacagaatggccctggccctgtgcctgcaggtgctgtgcagcctgtgcggctggctgagcctgtacatcagcttctgccacctgaacaagcacagaagctacgagtggagctgcagactggtgaccttcacccacggcgtgctgagcatcggcctgagcgcctacatcggcttcatcgacggcccctggcccttcacccaccccggcagccccaacacccccctgcaggtgcacgtgctgtgcctgaccctgggctacttcatcttcgacctgggctggtgcgtgtacttccagagcgagggcgccctgatgctggcccaccacaccctgagcatcctgggcatcatcatggccctggtgctgggcgagagcggcaccgaggtgaacgccgtgctgttcggcagcgagctgaccaaccccctgctgcagatgagatggttcctgagagagaccggccactaccacagcttcaccggcgacgtggtggacttcctgttcgtggccctgttcaccggcgtgagaatcggcgtgggcgcctgcctgctgttctgcgagatggtgagccccacccccaagtggttcgtgaaggccggcggcgtggccatgtacgccgtgagctggtgcttcatgttcagcatctggagattcgcctggagaaagagcatcaagaagtaccacgcctggagaagcagaagaagcgaggagagacagctgaagcacaacggccacctgaagatccactag

SEQ ID NO: 23225 - DNA, 738 bp, Artificial Sequence
  Description of Artificial Sequence: Synthetic coding sequence
atggccctggccctgtgcctgcaggtgctgtgcagcctgtgcggctggctgagcctgtacatcagcttctgccacctgaacaagcacagaagctacgagtggagctgcagactggtgaccttcacccacggcgtgctgagcatcggcctgagcgcctacatcggcttcatcgacggcccctggcccttcacccaccccggcagccccaacacccccctgcaggtgcacgtgctgtgcctgaccctgggctacttcatcttcgacctgggctggtgcgtgtacttccagagcgagggcgccctgatgctggcccaccacaccctgagcatcctgggcatcatcatggccctggtgctgggcgagagcggcaccgaggtgaacgccgtgctgttcggcagcgagctgaccaaccccctgctgcagatgagatggttcctgagagagaccggccactaccacagcttcaccggcgacgtggtggacttcctgttcgtggccctgttcaccggcgtgagaatcggcgtgggcgcctgcctgctgttctgcgagatggtgagccccacccccaagtggttcgtgaaggccggcggcgtggccatgtacgccgtgagctggtgcttcatgttcagcatctggagattcgcctggagaaagagcatcaagaagtaccacgcctggagaagcagaagaagcgaggagagacagctgaagcacaacggccacctgaagatccactag

SEQ ID NO: 23226 - DNA, 447 bp, Artificial Sequence
  Description of Artificial Sequence: Synthetic coding sequence
atgacccagtgctgcttcctgagagtgcaccccctgttcttctggttctggagcttccaccacagaatggccctggccctgtgcctgcaggtgctgtgcagcctgtgcggctggctgagcctgtacatcagcttctgccacctgaacaagcacagaagctacgagtggagctgcagactggtgaccttcacccacggcgtgctgagcatcggcctgagcgcctacatcggcttcatcgacggcccctggcccttcacccaccccggcagccccaacacccccctgcaggtgcacgtgctgtgcctgaccctgggctacttcatcttcgacctgggctgcatctggagattcgcctggagaaagagcatcaagaagtaccacgcctggagaagcagaagaagcgaggagagacagctgaagcacaacggccacctgaagatccactag

SEQ ID NO: 23227 - DNA, 651 bp, Artificial Sequence
  Description of Artificial Sequence: Synthetic coding sequence
atggtgcccatgcacctgctgggcagactggagaagcccctgctgctgctgtgctgcgccagcttcctgctgggcctggccctgctgggcatcaagaccgacatcacccccgtggcctacttcttcctgaccctgggcggcttcttcctgttcgcctacctgctggtgagattcctggagtggggcctgagaagccagctgcagagcatgcagaccgagagccccggccccagcggcaacgccagagacaacgaggccttcgaggtgcccgtgtacgaggaggccgtggtgggcctggagagccagtgcagaccccaggagctggaccagccccccccctacagcaccgtggtgatcccccccgcccccgaggaggagcagcccagccaccccgagggcagcagaagagccaagctggagcagagaagaatggccagcgagggcagcatggcccaggagggcagccccggcagagcccccatcaacctgagactgagaggccccagagccgtgagcaccgcccccgacctgcagagcctggccgccgtgcccaccctggagcccctgacccccccccccgcctacgacgtgtgcttcggccaccccgacgacgacagcgtgttctacgaggacaactgggcccccccctag

SEQ ID NO: 23228 - DNA, 651 bp, Artificial Sequence; identical to SEQ ID NO: 23227
  Description of Artificial Sequence: Synthetic coding sequence

SEQ ID NO: 23229 - DNA, 651 bp, Artificial Sequence; identical to SEQ ID NO: 23227
  Description of Artificial Sequence: Synthetic coding sequence

SEQ ID NO: 23230 - DNA, 651 bp, Artificial Sequence; identical to SEQ ID NO: 23227
  Description of Artificial Sequence: Synthetic coding sequence

SEQ ID NO: 23231 - DNA, 651 bp, Artificial Sequence; identical to SEQ ID NO: 23227
  Description of Artificial Sequence: Synthetic coding sequence

SEQ ID NO: 23232 - DNA, 558 bp, Artificial Sequence
  Description of Artificial Sequence: Synthetic coding sequence
atggccggccccagacccagatggagagaccagctgctgttcatgagcatcatcgtgctggtgatcgtggtgatctgcctgatgttctacgccctgctgtgggaggccggcaacctgaccgacctgcccaacctgagaatcggcttctacaacttctgcctgtggaacgaggacaccagcaccctgcagtgccaccagttccccgagctggaggccctgggcgtgcccagagtgggcctgggcctggccagactgggcgtgtacggcagcctggtgctgaccctgttcgccccccagcccctgctgctggcccagtgcaacagcgacgagagagcctggagactggccgtgggcttcctggccgtgagcagcgtgctgctggccggcggcctgggcctgttcctgagctacgtgtggaagtgggtgagactgagcctgcccggccccggcttcctggccctgggcagcgcccaggccctgctgatcctgctgctgatcgccatggccgtgttccccctgagagccgagagagccgagagcaagctggagagctgctag

SEQ ID NO: 23233 - DNA, 447 bp, Artificial Sequence
  Description of Artificial Sequence: Synthetic coding sequence
atggccggccccagacccagatggagagaccagctgctgttcatgagcatcatcgtgctggtgatcgtggtgatctgcctgatgttctacgccctgctgtgggaggccggcaacctgaccgacctgcccaacctgagaatcggcttctacaacttctgcctgtggaacgaggacaccagcaccctgcagtgccaccagttccccgagctggaggccctgggcgtgcccagagtgggcctgggcctggccagactgggcgtgtacggcagcctggtgctgaccctgttcttcctgagctacgtgtggaagtgggtgagactgagcctgcccggccccggcttcctggccctgggcagcgcccaggccctgctgatcctgctgctgatcgccatggccgtgttccccctgagagccgagagagccgagagcaagctggagagctgctag

SEQ ID NO: 23234 - DNA, 327 bp, Artificial Sequence
  Description of Artificial Sequence: Synthetic coding sequence
atggtgaacctgggcctgagcagagtggacgacgccgtggccgccaagcaccccggcctgggcgagtacgccgcctgccagagccacgccttcatgaagggcgtgttcaccttcgtgaccggcaccggcatggccttcggcctgcagatgttcatccagagaaagttcccctaccccctgcagtggagcctgctggtggccgtggtggccggcagcgtggtgagctacggcgtgaccagagtggagagcgagaagtgcaacaacctgtggctgttcctggagaccggccagctgcccaaggacagaagcaccgaccagagaagctag

SEQ ID NO: 23235 - DNA, 1380 bp, Artificial Sequence
  Description of Artificial Sequence: Synthetic coding sequence
atgaccgtggagctgtggctgagactgagaggcaagggcctggccatgctgcacgtgaccagaggcgtgtggggcagcagagtgagagtgtggcccctgctgcccgccctgctgggcccccccagagccctgagcagcctggccgccaagatgggcgagtacagaaagatgtggaaccccagagagcccagagactgggcccagcagtacagagagagattcatccccttcagcaaggagcagctgctgagactgctgatccaggagttccacagcagccccgccgagaaggccgccctggaggccttcagcgcccacgtggacttctgcaccctgttccactaccaccagatcctggccagactgcaggccctgtacgaccccatcaaccccgacagagagaccctggaccagcccagcctgaccgacccccagagactgagcaacgagcaggaggtgctgagagccctggagcccctgctggcccaggccaacttcagccccctgagcgaggacaccctggcctacgccctggtggtgcaccacccccaggacgaggtgcaggtgaccgtgaacctggaccagtacgtgtacatccacttctgggccctgggccagagagtgggccagatgcccctgaagagcagcgtgggcagcagaagaggcttcttcaccaagctgccccccgccgagagaagatacttcaagagagtggtgctggccgccagaaccaagagaggccacctggtgctgaagagcttcaaggacacccccctggagggcctggagcagctgctgcccgagctgaaggtgagaacccccaccctgcagagagccctgctgaacctgatgctggtggtgagcggcgtggccatcttcgtgaacgtgggcatggtggtgctgaccgacctgaaggtggccaccagcctgctgctgctgctgttcgccatcttcatgggcctgagagccagcaagatgttcggccagagaagaagcgcccaggccctggagctggcccacatgctgtactacagaagcaccagcaacaacagcgagctgctgagcgccctggccctgagagcccaggacgagcacaccaaggaggccctgctggcccacagcttcctggccagaagacccggcggcacccagggcagccccgaggagaccagcagatggctgagaagcgaggtggagaactggctgctggccaagagcggctgcgaggtgaccttcaacggcaccagagccctggcccacctgcaggccctgacccccagcatgggcctgtaccccccccccggcttccccaagctggaccccgtggcccccatcaccagcgagcccccccaggccacccccagcagcaacatcagctag

SEQ ID NO: 23236 - DNA, 1080 bp, Artificial Sequence
  Description of Artificial Sequence: Synthetic coding sequence
atgaccgtggagctgtggctgagactgagaggcaagggcctggccatgctgcacgtgaccagaggcgtgtggggcagcagagtgagagtgtggcccctgctgcccgccctgctgggcccccccagagccctgagcagcctggccgccaagatgggcgagtacagaaagatgtggaaccccagagagcccagagactgggcccagcagtacagagagagattcatccccttcagcaaggagcagctgctgagactgctgatccaggtgaccgtgaacctggaccagtacgtgtacatccacttctgggccctgggccagagagtgggccagatgcccctgaagagcagcgtgggcagcagaagaggcttcttcaccaagctgccccccgccgagagaagatacttcaagagagtggtgctggccgccagaaccaagagaggccacctggtgctgaagagcttcaaggacacccccctggagggcctggagcagctgctgcccgagctgaaggtgagaacccccaccctgcagagagccctgctgaacctgatgctggtggtgagcggcgtggccatcttcgtgaacgtgggcatggtggtgctgaccgacctgaaggtggccaccagcctgctgctgctgctgttcgccatcttcatgggcctgagagccagcaagatgttcggccagagaagaagcgcccaggccctggagctggcccacatgctgtactacagaagcaccagcaacaacagcgagctgctgagcgccctggccctgagagcccaggacgagcacaccaaggaggccctgctggcccacagcttcctggccagaagacccggcggcacccagggcagccccgaggagaccagcagatggctgagaagcgaggtggagaactggctgctggccaagagcggctgcgaggtgaccttcaacggcaccagagccctggcccacctgcaggccctgacccccagcatgggcctgtaccccccccccggcttccccaagctggaccccgtggcccccatcaccagcgagcccccccaggccacccccagcagcaacatcagctag

SEQ ID NO: 23237 - DNA, 1275 bp, Artificial Sequence
  Description of Artificial Sequence: Synthetic coding sequence
atgaccgtggagctgtggctgagactgagaggcaagggcctggccatgctgcacgtgaccagaggcgtgtggggcagcagagtgagagtgtggcccctgctgcccgccctgctgggcccccccagagccctgagcagcctggccgccaagatgggcgagtacagaaagatgtggaaccccagagagcccagagactgggcccagcagtacagagagagattcatccccttcagcaaggagcagctgctgagactgctgatccaggccctgtacgaccccatcaaccccgacagagagaccctggaccagcccagcctgaccgacccccagagactgagcaacgagcaggaggtgctgagagccctggagcccctgctggcccaggccaacttcagccccctgagcgaggacaccctggcctacgccctggtggtgcaccacccccaggacgaggtgcaggtgaccgtgaacctggaccagtacgtgtacatccacttctgggccctgggccagagagtgggccagatgcccctgaagagcagcgtgggcagcagaagaggcttcttcaccaagctgccccccgccgagagaagatacttcaagagagtggtgctggccgccagaaccaagagaggccacctggtgctgaagagcttcaaggacacccccctggagggcctggagcagctgctgcccgagctgaaggtgagaacccccaccctgcagagagccctgctgaacctgatgctggtggtgagcggcgtggccatcttcgtgaacgtgggcatggtggtgctgaccgacctgaaggtggccaccagcctgctgctgctgctgttcgccatcttcatgggcctgagagccagcaagatgttcggccagagaagaagcgcccaggccctggagctggcccacatgctgtactacagaagcaccagcaacaacagcgagctgctgagcgccctggccctgagagcccaggacgagcacaccaaggaggccctgctggcccacagcttcctggccagaagacccggcggcacccagggcagccccgaggagaccagcagatggctgagaagcgaggtggagaactggctgctggccaagagcggctgcgaggtgaccttcaacggcaccagagccctggcccacctgcaggccctgacccccagcatgggcctgtaccccccccccggcttccccaagctggaccccgtggcccccatcaccagcgagcccccccaggccacccccagcagcaacatcagctag

SEQ ID NO: 23238 - DNA, 1185 bp, Artificial Sequence
  Description of Artificial Sequence: Synthetic coding sequence
atgaccgtggagctgtggctgagactgagaggcaagggcctggccatgctgcacgtgaccagaggcgtgtggggcagcagagtgagagtgtggcccctgctgcccgccctgctgggcccccccagagccctgagcagcctggccgccaagatgggcgagtacagaaagatgtggaaccccagagagcccagagactgggcccagcagtacagagagagattcatccccttcagcaaggagcagctgctgagactgctgatccaggagttccacagcagccccgccgagaaggccgccctggaggccttcagcgcccacgtggacttctgcaccctgttccactaccaccagatcctggccagactgcaggtgaccgtgaacctggaccagtacgtgtacatccacttctgggccctgggccagagagtgggccagatgcccctgaagagcagcgtgggcagcagaagaggcttcttcaccaagctgccccccgccgagagaagatacttcaagagagtggtgctggccgccagaaccaagagaggccacctggtgctgaagagcttcaaggacacccccctggagggcctggagcagctgctgcccgagctgaaggtgagaacccccaccctgcagagagccctgctgaacctgatgctggtggtgagcggcgtggccatcttcgtgaacgtgggcatggtggtgctgaccgacctgaaggtggccaccagcctgctgctgctgctgttcgccatcttcatgggcctgagagccagcaagatgttcggccagagaagaagcgcccaggccctggagctggcccacatgctgtactacagaagcaccagcaacaacagcgagctgctgagcgccctggccctgagagcccaggacgagcacaccaaggaggccctgctggcccacagcttcctggccagaagacccggcggcacccagggcagccccgaggagaccagcagatggctgagaagcgaggtggagaactggctgctggccaagagcggctgcgaggtgaccttcaacggcaccagagccctggcccacctgcaggccctgacccccagcatgggcctgtaccccccccccggcttccccaagctggaccccgtggcccccatcaccagcgagcccccccaggccacccccagcagcaacatcagctag

SEQ ID NO: 23239 - DNA, 1050 bp, Artificial Sequence
  Description of Artificial Sequence: Synthetic coding sequence
atgagaagaagactgaacgacagcagagccctggccaaggccctgtacgaccccatcaaccccgacagagagaccctggaccagcccagcctgaccgacccccagagactgagcaacgagcaggaggtgctgagagccctggagcccctgctggcccaggccaacttcagccccctgagcgaggacaccctggcctacgccctggtggtgcaccacccccaggacgaggtgcaggtgaccgtgaacctggaccagtacgtgtacatccacttctgggccctgggccagagagtgggccagatgcccctgaagagcagcgtgggcagcagaagaggcttcttcaccaagctgccccccgccgagagaagatacttcaagagagtggtgctggccgccagaaccaagagaggccacctggtgctgaagagcttcaaggacacccccctggagggcctggagcagctgctgcccgagctgaaggtgagaacccccaccctgcagagagccctgctgaacctgatgctggtggtgagcggcgtggccatcttcgtgaacgtgggcatggtggtgctgaccgacctgaaggtggccaccagcctgctgctgctgctgttcgccatcttcatgggcctgagagccagcaagatgttcggccagagaagaagcgcccaggccctggagctggcccacatgctgtactacagaagcaccagcaacaacagcgagctgctgagcgccctggccctgagagcccaggacgagcacaccaaggaggccctgctggcccacagcttcctggccagaagacccggcggcacccagggcagccccgaggagaccagcagatggctgagaagcgaggtggagaactggctgctggccaagagcggctgcgaggtgaccttcaacggcaccagagccctggcccacctgcaggccctgacccccagcatgggcctgtaccccccccccggcttccccaagctggaccccgtggcccccatcaccagcgagcccccccaggccacccccagcagcaacatcagctag

SEQ ID NO: 23240 - DNA, 1038 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgggcctgggcatcctgatctggggcagcttcaacgccctgaccggctgggccagcagcagattcggctggttcggcctggacgccgaggaggtgagcaaccccctgctgaactacatcggcgccggcctgagcgtggtgagcgccttcatcttcctgttcatcaagagcgagatccccaacaacacctgcagcatggacaccacccccctgatcaccgagcacgtgatcaacaccacccaggacccctgcagctgggtggacaagctgagcaccgtgcaccacagaatcgtgggctgcagcctggccgtgatcagcggcgtgctgtacggcagcaccttcgtgcccatcatctacatcaaggaccacagcaagagaaacgacagcatctacgccggcgccagccagtacgacctggactacgtgttcgcccacttcagcggcatcttcctgaccagcaccgtgtacttcctggcctactgcatcgccatgaagaacagccccaagctgtaccccgaggccgtgctgcccggcttcctgagcggcgtgctgtgggccatcgccacctgctgctggttcatcgccaaccacagcctgagcgccgtggtgagcttccccatcatcaccgccggccccggcttcatcgccgccatgtggggcatcttcatgttcaaggagatcaagggcctgcagaactacctgctgatgatcctggccttctgcatcatcctgaccggcgccctgtgcaccgccttcagcaagatctag

SEQ ID NO: 23241 - DNA, 234 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccacctag

SEQ ID NO: 23242 - DNA, 333 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgggcctgggcatcctgatctggggcagcttcaacgccctgaccggctgggccagcagctag

SEQ ID NO: 23243 - DNA, 414 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgggcctgggcatcctgatctggggcagcttcaacgccctgaccggctgggccagcagcagattcggctggttcggcctggacgccgaggaggtgagcaaccccctgctgaactacatcggcgccggcctgagcgtggtgtag

SEQ ID NO: 23244 - DNA, 234 bp, Artificial Sequence; identical to SEQ ID NO: 23241
  Description of Artificial Sequence: Synthetic coding sequence

SEQ ID NO: 23245 - DNA, 264 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagtag

SEQ ID NO: 23246 - DNA, 504 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgggcctgggcatcctgatctggggcagcttcaacgccctgaccggctgggccagcagcagattcggctggttcggcctggacgccgaggaggtgagcaaccccctgctgaactacatcggcgccggcctgagcgtggtgagcgccttcatcttcctgttcatcaagagcgagatccccaacaacacctgcagcatggacaccacccccctgatcaccgagcacgtgatctag

SEQ ID NO: 23247 - DNA, 33 bp, Artificial Sequence
  Description of Artificial Sequence: Synthetic coding sequence
atgagcaacaacggcgccgacctgaccttctag

SEQ ID NO: 23248 - DNA, 264 bp, Artificial Sequence; identical to SEQ ID NO: 23245
  Description of Artificial Sequence: Synthetic coding sequence

SEQ ID NO: 23249 - DNA, 510 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgggcctgggcatcctgatctggggcagcttcaacgccctgaccggctgggccagcagcagattcggctggttcggcctggacgccgaggaggtgagcaaccccctgctgaactacatcggcgccggcctgagcgtggtgagcgccttcatcttcctgttcatcaagagcgagatccccaacaacacctgcagcatggacaccacccccctgatcaccgagcacgtgagcatcgtgtag

SEQ ID NO: 23250 - DNA, 276 bp, Artificial Sequence
  Description of Artificial Sequence: Synthetic coding sequence
atgagcaacaacggcgccgacctgaccttcggctacatcagctgcttcgtggccatcctgctgttcggcagcaacttcgtgcccctgaagaagttcgacaccggcgacggcatgttcctgcagtgggtgctgtgcgccgccatctggctggtggccctggtggtgaacctgatcctgcactgccccaagttctggcccttcgccatgctgggcggctgcatctgggccaccggcaacatcgccgtggtgcccatcatcaagaccatcggcctgtag

SEQ ID NO: 23251 - DNA, 1482 bp, Artificial Sequence
  Description of Artificial Sequence: Synthetic coding sequence
atggagcccctgagagcccccgccctgagaagactgctgccccccctgctgctgctgctgctgagcctgccccccagagccagagccaagtacgtgagaggcaacctgagcagcaaggaggactgggtgttcctgaccagattctgcttcctgagcgactacggcagactggacttcagattcagataccccgaggccaagtgctgccagaacatcctgctgtacttcgacgaccccagccagtggcccgccgtgtacaaggccggcgacaaggactgcctggccaaggagagcgtgatcagacccgagaacaaccaggtgatcaacctgaccacccagtacgcctggagcggctgccaggtggtgagcgaggagggcaccagatacctgagctgcagcagcggcagaagcttcagaagcggcgacggcctgcagctggagtacgagatggtgctgaccaacggcaagagcttctggaccagacacttcagcgccgacgagttcggcatcctggagaccgacgtgaccttcctgctgatcttcatcctgatcttcttcctgagctgctacttcggctacctgctgaagggcagacagctgctgcacaccacctacaagatgttcatggccgccgccggcgtggaggtgctgagcctgctgttcttctgcatctactggggccagtacgccaccgacggcatcggcaacgagagcgtgaagatcctggccaagctgctgttcagcagcagcttcctgatcttcctgctgatgctgatcctgctgggcaagggcttcaccgtgaccagaggcagaatcagccacgccggcagcgtgaagctgagcgtgtacatgaccctgtacaccctgacccacgtggtgctgctgatctacgaggccgagttcttcgaccccggccaggtgctgtacacctacgagagccccgccggctacggcctgatcggcctgcaggtggccgcctacgtgtggttctgctacgccgtgctggtgagcctgagacacttccccgagaagcagcccttctacgtgcccttcttcgccgcctacaccctgtggttcttcgccgtgcccgtgatggccctgatcgccaacttcggcatccccaagtgggccagagagaagatcgtgaacggcatccagctgggcatccacctgtacgcccacggcgtgttcctgatcatgaccagacccagcgccgccaacaagaacttcccctaccacgtgagaaccagccagatcgccagcgccggcgtgcccggccccggcggcagccagagcgccgacaaggccttcccccagcacgtgtacggcaacgtgaccttcatcagcgacagcgtgcccaacttcaccgagctgttcagcatccccccccccgccaccagccccctgcccagagccgcccccgacagcggcctgcccctgttcagagacctgagaccccccggccccctgagagacctgtag

SEQ ID NO: 23252 - DNA, 1404 bp, Artificial Sequence
  Description of Artificial Sequence: Synthetic coding sequence
agactgagacactgcacccccacctgggccaccgagcccgacagcgtgaagaagaagagaaacagaaagagaagcggcgccgtggcccacaactgcaacctgaagcacttcggcagacccagatgggaggaccacctgtgccccggcatctgggaccagagaggcaacatcatcgagttcctgaccggcgagttcatctacagaatgtacaccatcgacatgcacagccagctggagctgaccgccagcctgatcccccagcccggcaccagcctgatccccctggtgatggtgagcaacccccacagcctgggcttccaggccaccttctacgagaacggctacaccagcgacggcaacaccaagtacaagctggacatcttcctgaagcagcagcagcactggggcagaaccgacagcaacttcaccagcagcctgaagaaggccaccatgagcaccctgaccgtggacatcgccaacaaggagatcagctgcgtggacatcaagcccctgagcaccctgatcagcgtgggctgcgacctggacaagaagatcgtgatccagaacaaggtgagcgcctgcagcatgggcatcctggaccccctgaccctgcaggacaactacagcttcatcatcgagaaggagttctacgaccccggcttccagggccagcagagcagcgaggacctgcacgtgttctacagctaccagcagctgggctgccccctgctggtgtactacgacaccctgtggaagcccgtggtggagctgtggagaaaggacagcttccaggaggtgatcgacgccgagtacgtgctgctggaggtgaacggccagttcagctacagctacagcctgaccgcccagagcgccatgtgcaccagccagccccagaactggaccaccatgatcaaggagttcggcggccccttcttctggaacagagagaactacgtgagctgccacgaccccaacaacaacgcccccctgagatggcccgacgtgcagtaccagatcctgggcggcagaaccgccaaccagatcatcttcggccacaacggcttctacgtgttctacatcagcatcgtggacccctactacagctactgccagctggagaccatcttcagcatctacgtgtacggcgccttccccgtgcagctggtgagcgccggcgtggtgatcctgctgatcatcagcagcatcctgggcagcgtgtggctggcctacaagacccccaagctgctgagaaccgccagaggcagaagaatcaagaagtgcgccacccagctgtgcagaagatgcaagaccgtgtgccagttcagagccagcgccaccgccagagccggcaccgagccccccggcagacacagaaccccccacggcggcagaagcgaccactag

SEQ ID NO: 23253 - DNA, 1080 bp, Artificial Sequence
  Description of Artificial Sequence: Synthetic coding sequence
atgttcagaagccccggcaccctggagatcctgacccccctgagagacaccgccttccccgccttcgacttccagaagtgcctggtgaacatccaggccctgctgatggaccccgagctgcacgtgggcaagtgcaagatcgagttcctgaccggcgagttcatctacagaatgtacaccatcgacatgcacagccagctggagctgaccgccagcctgatcccccagcccggcaccagcctgatccccctggtgatggtgagcaacccccacagcctgggcttccaggccaccttctacgagaacggctacaccagcgacggcaacaccaagtacaagctggacatcttcctgaagcagcagcagcactggggcagaaccgacagcaacttcaccagcagcctgaagaaggccaccatgagcaccctgaccgtggacatcgccaacaaggagatcagctgcgtggacatcaagcccctgagcaccctgatcagcgtgggctgcgacctggacaagaagatcgtgatccagaacaaggtgagcgcctgcagcatgggcatcctggaccccctgaccctgcaggacaactacagcttcatcatcgagaaggagttctacgaccccggcttccagggccagcagagcagcgaggacctgcacgtgttctacagctaccagcagctgggctgccccctgctggtgtactacgacaccctgtggaagcccgtggtggagctgctggagagcagcggcatgaacaccgtgcactgcagcctgaacctgcccggcagcagcggcccccccgccagcgccagccaggtggccggcaccgccgtggcctaccacaacgccagactgatcttcttcttcttcttcttcttcttcttcctgagacagagcctggccctgagccccagactggagtgcagcggcgtgatcctggcccacagaaagctgtgcctgcccggcagcagacacagccccgccagcgccagcagagtggccggcatcaccggcgccagacactgcgccagactgatcttcttcatcttcagcagagacagagtgagcccctgctag

SEQ ID NO: 23254 - DNA, 2397 bp, Artificial Sequence
  Description of Artificial Sequence: Synthetic coding sequence
atgctgatgctgatgctggtggccgccgtgaccatgtggctgagacccctggtgaccgcccagctgtgcagaagcagaaccgtgagaaccggcaaggtgttcaacctgatccaggacgtgcagggcgacagactgtacttccaccccaccaccaccagactgatcaagcacccctgcgagaagaacatcgccctgtacctgggcaagcaggtgttcttcaccatggacaacttcgagaccagcctgctgcccttcaccatccccaccagcatgcaggtgggcgtgcccgaggtgaccagcgcccacttcgccggcagcctgctgctgctggtggtggaccagaaggtgtacatctacgactacgagaacaacagctggagcatgagcctgggcatcaagcaccccgtgacccacgtgagcggcgacaactgctgctacaccggcagcctgttctgcgtgcacgtgagcaacctggtgttcgcctacttcagaggcgaccagatcagccagacctacatctactacagcaacaccggcggcttcagcttctggaagtaccactacgacagacaggccgagatcatcggcagcctgggcggcatcttccacttcttcagcctgagccaggtggccatgctggtggtgaaccagggcaagggcatgttcaagtacagcgaccaccccctgaacagaagcttcggcctgagcttcgactacaacggcaccctggacatcctgatcgcccccggccagagaggcatcctgctgctgtggttcgagaacagcctgctgttcagccacaacgccggccagctggtggacaccgtgagagtgaagaagggcgaccagaccctgttcagcagcatcttcgaggccaagatcaccatccacaacatcgccgtgaccgagaacgagctggccgtgatcaccagagaggacaacctgtactacggcaacctgggcatcgtgcccagcagcatcatcaagttcgccgaccagtacatctggagcgaggacgtggccctgatgttcagaagccccggcaccctggagatcctgacccccctgagagacaccgccttccccgccttcgacttccagaagtgcctggtgaacatccaggccctgctgatggaccccgagctgcacgtgggcaagtgcaagatcgagttcctgaccggcgagttcatctacagaatgtacaccatcgacatgcacagccagctggagctgaccgccagcctgatcccccagcccggcaccagcctgatccccctggtgatggtgagcaacccccacagcctgggcttccaggccaccttctacgagaacggctacaccagcgacggcaacaccaagtacaagctggacatcttcctgaagcagcagcagcactggggcagaaccgacagcaacttcaccagcagcctgaagaaggccaccatgagcaccctgaccgtggacatcgccaacaaggagatcagctgcgtggacatcaagcccctgagcaccctgatcagcgtgggctgcgacctggacaagaagatcgtgatccagaacaaggtgagcgcctgcagcatgggcatcctggaccccctgaccctgcaggacaactacagcttcatcatcgagaaggagttctacgaccccggcttccagggccagcagagcagcgaggacctgcacgtgttctacagctaccagcagctgggctgccccctgctggtgtactacgacaccctgtggaagcccgtggtggagctgtggagaaaggacagcttccaggaggtgatcgacgccgagtacgtgctgctggaggtgaacggccagttcagctacagctacagcctgaccgcccagagcgccatgtgcaccagccagccccagaactggaccaccatgatcaaggagttcggcggccccttcttctggaacagagagaactacgtgagctgccacgaccccaacaacaacgcccccctgagatggcccgacgtgcagtaccagatcctgggcggcagaaccgccaaccagatcatcttcggccacaacggcttctacgtgttctacatcagcatcgtggacccctactacagctactgccagctggagaccatcttcagcatctacgtgtacggcgccttccccgtgcagctggtgagcgccggcgtggtgatcctgctgatcatcagcagcatcctgggcagcgtgtggctggcctacaagacccccaagctgctgagaaccgccagaggcagaagaatcaagaagtgcgccacccagctgtgcagaagatgcaagaccgtgtgccagttcagagccagcgccaccgccagagccggcaccgagccccccggcagacacagaaccccccacggcggcagaagcgaccactag

SEQ ID NO: 23255 - DNA, 777 bp, Artificial Sequence
  Description of Artificial Sequence: Synthetic coding sequence
atggccagcgccgccgccgccgaggccgagaagggcagccccgtggtggtgggcctgctggtggtgggcaacatcatcatcctgctgagcggcctgagcctgttcgccgagaccatctgggtgaccgccgaccagtacagagtgtaccccctgatgggcgtgagcggcaaggacgacgtgttcgccggcgcctggatcgccatcttctgcggcttcagcttcttcatggtggccagcttcggcgtgggcgccgccctgtgcagaagaagaagcatggtgctgacctacctggtgctgatgctgatcgtgtacatcttcgagtgcgccagctgcatcaccagctacacccacagagactacatggtgagcaaccccagcctgatcaccaagcagatgctgaccttctacagcgccgacaccgaccagggccaggagctgaccagactgtgggacagagtgatgatcgagcaggagtgctgcggcaccagcggccccatggactgggtgaacttcaccagcgccttcagagccgccacccccgaggtggtgttcccctggccccccctgtgctgcagaagaaccggcaacttcatccccctgaacgaggagggctgcagactgggccacatggactacctgttcaccaagggctgcttcgagcacatcggccacgccatcgacagctacacctggggcatcagctggttcggcttcgccatcctgatgtggaccctgcccgtgatgctgatcgccatgtacttctacaccatgctgtag

SEQ ID NO: 23256 - DNA, 528 bp, Artificial Sequence
  Description of Artificial Sequence: Synthetic coding sequence
atgctgttcctggccaccttcttccccacctgggagggcggcatctacgacttcatcggcgagttcatgaaggccagcgtggacgtggccgacctgatcggcctgaacctggtgatgagcagaaacgccggcaagggcgagtacaagatcatggtggccgccctgggctgggccaccgccgagctgatcatgagcagatgcatccccctgtgggtgggcgccagaggcatcgagttcgactggaagtacatccagatgagcatcgacagcaacatcagcctggtgcactacatcgtggccagcgcccaggtgtggatgatcaccagatacgacctgtaccacaccttcagacccgccgtgctgctgctgatgttcctgagcgtgtacaaggccttcgtgatggagaccttcgtgcacctgtgcagcctgggcagctgggccgccctgctggccagagccgtggtgaccggcctgctggccctgagcaccctggccctgtacgtggccgtggtgaacgtgcacagctag

SEQ ID NO: 23257 - DNA, 555 bp, Artificial Sequence
  Description of Artificial Sequence: Synthetic coding sequence
atgaccctgttccacttcggcaactgcttcgccctggcctacttcccctacttcatcacctacaagtgcagcggcctgagcgagtacaacgccttctggaagtgcgtgcaggccggcgtgacctacctgttcgtgcagctgtgcaagatgctgttcctggccaccttcttccccacctgggagggcggcatctacgacttcatcggcgagttcatgaaggccagcgtggacgtggccgacctgatcggcctgaacctggtgatgagcagaaacgccggcaagggcgagtacaagatcatggtggccgccctgggctgggccaccgccgagctgatcatgagcagatgcatccccctgtgggtgggcgccagaggcatcgagttcgactggaagtacatccagatgagcatcgacagcaacatcagcctggtgcactacatcgtggccagcgcccaggtgtggatgatcaccagatacgacctgtaccacaccttcagacccgccgtgctgctgctgatgttcctgagcgtgtacaaggccttcgtgatggagtag

SEQ ID NO: 23258 - DNA, 96 bp, Artificial Sequence
  Description of Artificial Sequence: Synthetic coding sequence
atgagacccggctggagccacctgcccctgtgccccaccctgcaggacgccgtgctgggccacttcctgagccacctgggcagaagacacctgtag

SEQ ID NO: 23259 - DNA, 1098 bp, Artificial Sequence
  Description of Artificial Sequence: Synthetic coding sequence
atgagcctgatcagaaagaagggcttctacaagcaggacgtgaacaagaccgcctgggagctgcccaagacctacgtgagccccacccacgtgggcagcggcgcctacggcagcgtgtgcagcgccatcgacaagagaagcggcgagaaggtggccatcaagaagctgagcagacccttccagagcgagatcttcgccaagagagcctacagagagctgctgctgctgaagcacatgcagcacgagaacgtgatcggcctgctggacgtgttcacccccgccagcagcctgagaaacttctacgacttctacctggtgatgcccttcatgcagaccgacctgcagaagatcatgggcatggagttcagcgaggagaagatccagtacctggtgtaccagatgctgaagggcctgaagtacatccacagcgccggcgtggtgcacagagacctgaagcccggcaacctggccgtgaacgaggactgcgagctgaagatcctggacttcggcctggccagacacgccgacgccgagatgaccggctacgtggtgaccagatggtacagagcccccgaggtgatcctgagctggatgcactacaaccagaccgtggacatctggagcgtgggctgcatcatggccgagatgctgaccggcaagaccctgttcaagggcaaggactacctggaccagctgacccagatcctgaaggtgaccggcgtgcccggcaccgagttcgtgcagaagctgaacgacaaggccgccaagagctacatccagagcctgccccagacccccagaaaggacttcacccagctgttccccagagccagcccccaggccgccgacctgctggagaagatgctggagctggacgtggacaagagactgaccgccgcccaggccctgacccaccccttcttcgagcccttcagagaccccgaggaggagaccgaggcccagcagcccttcgacgacagcctggagcacgagaagctgaccgtggacgagtggaagcagcacatctacaaggagatcgtgaacttcagccccatcgccagaaaggacagcagaagaagaagcggcatgaagctgtag

SEQ ID NO: 23260 - DNA, 243 bp, Artificial Sequence
  Description of Artificial Sequence: Synthetic coding sequence
atggagaagcccctgttccccctggtgcccctgcactggttcggcttcggctacaccgccctggtggtgagcggcggcatcgtgggctacgtgaagaccgccgccaccagcgtgaccttcgtgggcgtgatgggcatgagaagctactactacggcaagttcatgcccgtgggcctgatcgccggcgccagcctgctgatggccgccaaggtgggcgtgagaatgctgatgaccagcgactag

SEQ ID NO: 23261 - DNA, 345 bp, Artificial Sequence
  Description of Artificial Sequence: Synthetic coding sequence
atggagaagcccctgttccccctggtgcccctgcactggttcggcttcggctacaccgccctggtggtgagcggcggcatcgtgggctacgtgaagaccggcagcgtgcccagcctggccgccggcctgctgttcggcagcctggccggcctgggcgcctaccagctgtaccaggaccccagaaacgtgtggggcttcctggccgccaccagcgtgaccttcgtgggcgtgatgggcatgagaagctactactacggcaagttcatgcccgtgggcctgatcgccggcgccagcctgctgatggccgccaaggtgggcgtgagaatgctgatgaccagcgactag

SEQ ID NO: 23262 - DNA, 345 bp, Artificial Sequence; identical to SEQ ID NO: 23261
  Description of Artificial Sequence: Synthetic coding sequence

SEQ ID NO: 23263 - DNA, 408 bp, Artificial Sequence
  Description of Artificial Sequence: Synthetic coding sequence
atggagaagcccctgttccccctggtgcccctgcactggttcggcttcggctacaccgccctggtggtgagcggcggcatcgtgggctacgtgaagaccggcagcgtgcccagcctggccgccggcctgctgttcggcagcctggccggcctgggcgcctaccagctgtaccaggaccccagaaacgtgtggggcttcctggccgccaccagcgtgaccttcgtgggcgtgatgggcatgagaagctactactacggcaagttcatgcccgtgggcctgatcgccggcgccagatacttccacagcatcaccctgctgtaccacgtggagttcagcctgctgcccagaatcctgtacgccttcaagaccctgctggtgagcgagtacctgatgctgtgcatcaactag

SEQ ID NO: 23264 - DNA, 2151 bp, Artificial Sequence
  Description of Artificial Sequence: Synthetic coding sequence
atggaggacagcaccagccccaagcaggagaaggagaaccaggaggagctgggcgagaccagaagaccctgggagggcaagaccgccgccagcccccagtacagcgagcccgagagcagcgagcccctggaggccaagcagggccccgagaccggcagacagagcagaagcagcagaccctggagcccccagagcagagccaagacccccctgggcggccccgccggccccgagaccagcagccccgcccccgtgagccccagagagcccagcagcagccccagccccctggcccccgccagacaggacctggccgcccccccccagagcgacagaaccaccagcgtgatccccgaggccggcaccccctaccccgaccccctggagcagagcagcgacaagagagagagcaccccccaccacaccagccagagcgagggcaacaccttccagcagagccagcagcccaagccccacctgtgcggcagaagagacgtgagctacaacaacgccaagcagaaggagctgagattcgacgtgttccaggaggaggacagcaacagcgactacgacctgcagcagcccgcccccggcggcagcgaggtggcccccagcatgctggagatcaccatccagaacgccaaggcctacctgctgaagaccagcagcaacagcggcttcaacctgtacgaccacctgagcaacatgctgaccaagatcctgaacgagagacccgagaacgccgtggacatcttcgagaacatcagccaggacgtgaagatggcccacttcagcaagaagttcgacgccctgcagaacgagaacgagctgctgcccacctacgagatcgccgagaagcagaaggccctgttcctgcagggccacctggagggcgtggaccaggagctggaggacgagatcgccgagaacgccctgcccaacgtgatggagagcgccttctacttcgagcaggccggcgtgggcctgggcaccgacgagacctacagaatcttcctggccctgaagcagctgaccgacacccaccccatccagagatgcagattctggggcaagatcctgggcctggagatgaactacatcgtggccgaggtggagttcagagagggcgaggacgaggaggaggtggaggaggaggacgtggccgaggagagagacaacggcgagagcgaggcccacgaggacgaggaggacgagctgcccaagagcttctacaaggccccccaggccatccccaaggaggagagcagaaccggcgccaacaagtacgtgtacttcgtgtgcaacgagcccggcagaccctgggtgaagctgccccccgtgatccccgcccagatcgtgatcgccagaaagatcaagaagttcttcaccggcagactggacgcccccatcatcagctacccccccttccccggcaacgagagcaactacctgagagcccagatcgccagaatcagcgccggcacccacgtgagccccctgggcttctaccagttcggcgaggaggagggcgaggaggaggaggaggccgagggcggcagaaacagcttcgaggagaaccccgacttcgagggcatccaggtgatcgacctggtggagagcctgagcaactgggtgcaccacgtgcagcacatcctgagccagggcagatgcaactggttcaacagcatccagaagaacgaggaggaggaggaggaggaggacgaggagaaggacgacagcgactacatcgagcaggaggtgggcctgcccctgctgacccccatcagcgaggacctggagatccagaacatccccccctggaccaccagactgagcagcaacctgatcccccagtacgccatcgccgtgctgcagagcaacctgtggcccggcgcctacgccttcagcaacggcaagaagttcgagaacttctacatcggctggggccacaagtacagccccgacaactacaccccccccgtgcccccccccgtgtaccaggagtaccccagcggccccgagatcaccgagatggacgaccccagcgtggaggaggagcaggccttcagagccgcccaggaggccgtgctgctggccgccgagaacgaggagagcgaggaggacgaggacgaggaggacgactacgactag

SEQ ID NO: 23265 - DNA, 315 bp, Artificial Sequence
  Description of Artificial Sequence: Synthetic coding sequence
atgcaggacaccggcagcgtggtgcccctgcactggttcggcttcggctacgccgccctggtggccagcggcggcatcatcggctacgtgaaggccggcagcgtgcccagcctggccgccggcctgctgttcggcagcctggccggcctgggcgcctaccaggtgagcggcagcaaggagagactgggcttccccagctacatctggtacctgggctggcactacggcaacgaggtgctgcccctgtggaagatccacgcctgcagattcaactgcagatgccagttcgccgacggcagacagagctggagctag

SEQ ID NO: 23266 - DNA, 339 bp, Artificial Sequence; identical to SEQ ID NO: 17364
  Description of Artificial Sequence: Synthetic coding sequence

SEQ ID NO: 23267 - DNA, 378 bp, Artificial Sequence
  Description of Artificial Sequence: Synthetic coding sequence
atgcagatggaccccggcccccaggtgcccctgtactggctgggcttcgtgtacgccgccctggccgccctgggcggcatcagcggctacgccaaggtgggcagcgtgcagagccccagcgccggcttcttcttcagcgagctggccggcctggacgccagccagcccagcagaaaccccaaggagcacctgagcagccccgtgtacatctgggacctggccagatactacgccaacaagatcctgaccctgtggaacatctacgcctgcggcttcagctgcagatgcctgctgatcgtgagcaagctgggcagcatgtacggcgagcagatcctgagcgtggtggccatgagccagctgggcctgatgaagaactag

SEQ ID NO: 23268 - DNA, 657 bp, Artificial Sequence
  Description of Artificial Sequence: Synthetic coding sequence
atgtacgccctgtggagaaccggccccaccaccagccccgccctgctgaccctgctgagcaagggcgtgcccagacccgccgccccctggaccatgagccccagcagcgtggccctgatctgcctgctgagatacggccagctgctggagcagagcagacacagctgggtgaacaccaccgccctgatcaccggctgcaccaacgccgccggcctgctggtggtgggcaacttccaggtggaccacgccagaagcctgcactacgtgggcgccggcgtggccttccccgccggcctgctgttcgtgtgcctgcactgcgccctgagctaccagggcgccaccgcccccctggacctggccgtggcctacctgagaagcgtgctggccgtgatcgccttcatcaccctggtgctgagcggcgtgttcttcgtgcacgagagcagccagctgcagcacggcgccgccctgtgcgagtgggtgtgcgtgatcgacatcctgatcttctacggcaccttcagctacgagttcggcgccgtgagcagcgacaccctggtggccgccctgcagcccacccccggcagagcctgcaagagcagcggcagcagcagcaccagcacccacctgaactgcgcccccgagagcatcgccatgatctag

SEQ ID NO: 23269 - DNA, 816 bp, Artificial Sequence
  Description of Artificial Sequence: Synthetic coding sequence
atgaccgcctggatcctgctgcccgtgagcctgagcgccttcagcatcaccggcatctggaccgtgtacgccatggccgtgatgaaccaccacgtgtgccccgtggagaactggagctacaacgagagctgcccccccgaccccgccgagcagggcggccccaagacctgctgcaccctggacgacgtgcccctgatcagcaagtgcggcagctacccccccgagagctgcctgttcagcctgatcggcaacatgggcgccttcatggtggccctgatctgcctgctgagatacggccagctgctggagcagagcagacacagctgggtgaacaccaccgccctgatcaccggctgcaccaacgccgccggcctgctggtggtgggcaacttccaggtggaccacgccagaagcctgcactacgtgggcgccggcgtggccttccccgccggcctgctgttcgtgtgcctgcactgcgccctgagctaccagggcgccaccgcccccctggacctggccgtggcctacctgagaagcgtgctggccgtgatcgccttcatcaccctggtgctgagcggcgtgttcttcgtgcacgagagcagccagctgcagcacggcgccgccctgtgcgagtgggtgtgcgtgatcgacatcctgatcttctacggcaccttcagctacgagttcggcgccgtgagcagcgacaccctggtggccgccctgcagcccacccccggcagagcctgcaagagcagcggcagcagcagcaccagcacccacctgaactgcgcccccgagagcatcgccatgatctag

SEQ ID NO: 23270 - DNA, 816 bp, Artificial Sequence; identical to SEQ ID NO: 23269
  Description of Artificial Sequence: Synthetic coding sequence

SEQ ID NO: 23271 - DNA, 204 bp, Artificial Sequence
  Description of Artificial Sequence: Synthetic coding sequence
atgtacgccctgtggagaaccggccccaccaccagccccgccctgctgaccctgctgagcaagggcgtgcccagacccgccgccccctggaccatgagccccagcagcgtggccctgatctgcctgctgagatacggccagctgctggagcagagcagacacagctgggtgaacaccaccgccctgatcaccggctgcacctag

SEQ ID NO: 23272 - DNA, 702 bp, Artificial Sequence
  Description of Artificial Sequence: Synthetic coding sequence
atgtggggctacctgagcctgatgcccgtgttcctggccgtgtgggccatcagcggcgtgtggatcgtgttcgccatcgccgtgaccaacagaaccgtggacctgagcaagggcttcccctacatcagcatctgcggcagcttccccccccagagctgcatcttcagccaggtgctgaacatgggcgccgccctggccgcctggatctgcatcgtgagataccaccagctgagagactggggcgtgagaagatggcccaaccagctgatcctgtggaccggcctgctgtgcgccctgggcaccagcgtggtgggcaacttccaggagaagaaccagagacccacccacctggccggcgccttcctggccttcatcctgggcaacgtgtacttctggctgcagctgctgctgtggagactgaagagactgccccagcccggcgccgcctggatcggccccctgagactgggcctgtgcagcgtgtgcaccatcctgatcgtggccatgatcgtgctgcacgcctgcagcctgagaagcgtgagcgccgcctgcgagtgggtggtggccatgctgctgttcgccctgttcggcctgctggccgtggacttcagcgccctggagagctgcaccctgtgcgtgcagccctggcccagcctgagccccccccccgccagccccatcagcctgcccgtgcagctgtag

SEQ ID NO: 23273 - DNA, 702 bp, Artificial Sequence; identical to SEQ ID NO: 23272
  Description of Artificial Sequence: Synthetic coding sequence

SEQ ID NO: 23274 - DNA, 750 bp, Artificial Sequence
  Description of Artificial Sequence: Synthetic coding sequence
atggacggcaagaagtgcagcgtgtggatgttcctgcccctggtgttcaccctgttcaccagcgccggcctgtggatcgtgtacttcatcgccgtggaggacgacaagatcctgcccctgaacagcgccgagagaaagcccggcgtgaagcacgccccctacatcagcatcgccggcgacgacccccccgccagctgcgtgttcagccaggtgatgaacatggccgccttcctggccctggtggtggccgtgctgagattcatccagctgaagcccaaggtgctgaacccctggctgaacatcagcggcctggtggccctgtgcctggccagcttcggcatgaccctgctgggcaacttccagctgaccaacgacgaggagatccacaacgtgggcaccagcctgaccttcggcttcggcaccctgacctgctggatccaggccgccctgaccctgaaggtgaacatcaagaacgagggcagaagagtgggcatccccagagtgatcctgagcgccagcatcaccctgtgcgtggtgctgtacttcatcctgatggcccagagcatccacatgtacgccgccagagtgcagtggggcctggtgatgtgcttcctgagctacttcggcaccttcgccgtggagttcagacactacagatacgagatcgtgtgcagcgagtaccaggagaacttcctgagcttcagcgagagcctgagcgaggccagcgagtaccagaccgaccaggtgtag

SEQ ID NO: 23275 - DNA, 204 bp, Artificial Sequence
  Description of Artificial Sequence: Synthetic coding sequence
atggacggcaagaagtgcagcgtgtggatgttcctgcccctggtgttcaccctgttcaccagcgccggcctgtggatcgtgtacttcatcgccgtggaggacgacaagatcctgcccctgaacagcgccgagagaaagcccggcgtgaagcacgccccctacatcagcatcgccggcgacgacccccccgccagctgcgtgtag

SEQ ID NO: 23276 - DNA, 750 bp, Artificial Sequence; identical to SEQ ID NO: 23274
  Description of Artificial Sequence: Synthetic coding sequence

SEQ ID NO: 23277 - DNA, 1407 bp, Artificial Sequence
  Description of Artificial Sequence: Synthetic coding sequence
atgcccgaggacggcgccggcgacggcggcgaggtgcccgccctgatccccgacggcgagcccctgagagaggagcagagacccctgaagcagagcctgggcagcagcctgtgcagagagagccactggaagtgcctgctgctgaccctgctgatccacgcctgcggcgccgtggtggcctggtgcagactggccaccgtgcccagactggtgctgggccccgaggccgccctggccagaggcgccggcggccccccccccacctaccccgccagcccctgcagcgacggctacctgtacatccccctggccttcgtgagcctgctgtacctgctgtacctggccgagtgctggcactgccacgtgagaagctgccaggcccccagaaccgacgcccacaccgtgctggccctgatcagaagactgcagcaggcccccccctgcgtgtggtggaaggccaccagctaccactacgtgagaagaaccagacagatcaccagatacagaaacggcgacgcctacaccaccacccaggtgtaccacgagagagccgacagcagaaccgccagaggcgagttcgactacagcgcccacggcgtgagagacgtgagcaaggagctggtgggcctggccgagcacgccgccaccagactgagattcaccaagtgcttcagcttcggcagcgccgaggccgaggccagctacctgacccagagagccagattcttcagcgccaacgagggcctggacgactacctggaggccagagagggcatgcacctgaaggacgtggacttcagagagagcctgatggtgttcgccgaccccagaagccccccctggtacgccagagcctgggtgttctggctggtgagcgccgccaccctgagctggcccctgagagtggtggccgcctacggcaccgcccacgtgcactaccaggtggagaagctgttcggcgccagcagccccccccccggcgccgtgcccagcggcccccccctgagcagagtggccaccgtggacttcaccgagctggagtggcacatctgcagcaacagacagctggtgcccagctacagcgaggccgtggtgatgggcgccggcagcggcgcctacctgagaggctgccagagatgcagaagaagcgtgagcagcaacagcctgccccccgccagacccagcggccccagactgcccttcagcagaagcagactgagcctgggcgccggcggcagagccacccccggcgtgttcagaagcctgagcggcggccccctgggcagaagaggcgaggacaccgagcccctggagagccccccctgctacgaggacgccctgtacttccccgtgctgatcgtgcacggcgacagcggctgccagggcgacggccagggcgccctgtag

SEQ ID NO: 23278 - DNA, 669 bp, Artificial Sequence
  Description of Artificial Sequence: Synthetic coding sequence
atgagcccccccggcagcgccgccggcgagagcgccgccggcggcggcggcggcggcggcggccccggcgtgagcgaggagctgaccgccgccgccgccgccgccgccgccgacgagggccccgccagagaggagcagagacccatccagcccagcttcaccaagagcctgtgcagagagagccactggaagtgcctgctgctgagcctgctgatgtacggctgcctgggcgccgtggcctggtgccacgtgaccaccgtgaccagactgaccttcagcagcgcctaccagggcaacagcctgatgtaccacgacagcccctgcagcaacggctacgtgtacatccccctggccttcctgctgatgctgtacgccgtgtacctggtggagtgctggcactgccaggccagacacgagctgcagcacagagtggacgtgagcagcgtgagagagagagtgggcagaatgcagcaggccaccccctgcatctggtggaaggccatcagctaccactacgtgagaagaaccagacaggtgaccagatacagaaacggcgacgcctacaccaccacccaggtgcccggctgcctgggcagccaggtggtgcccctgagaagcccctggagaaacgcccagctggacgccggcagcgacgaggagcccgcctag

SEQ ID NO: 23279 - DNA, 1701 bp, Artificial Sequence
  Description of Artificial Sequence: Synthetic coding sequence
atgagcccccccggcagcgccgccggcgagagcgccgccggcggcggcggcggcggcggcggccccggcgtgagcgaggagctgaccgccgccgccgccgccgccgccgccgacgagggccccgccagagaggagcagagacccatccagcccagcttcaccaagagcctgtgcagagagagccactggaagtgcctgctgctgagcctgctgatgtacggctgcctgggcgccgtggcctggtgccacgtgaccaccgtgaccagactgaccttcagcagcgcctaccagggcaacagcctgatgtaccacgacagcccctgcagcaacggctacgtgtacatccccctggccttcctgctgatgctgtacgccgtgtacctggtggagtgctggcactgccaggccagacacgagctgcagcacagagtggacgtgagcagcgtgagagagagagtgggcagaatgcagcaggccaccccctgcatctggtggaaggccatcagctaccactacgtgagaagaaccagacaggtgaccagatacagaaacggcgacgcctacaccaccacccaggtgtaccacgagagagtgaacacccacgtggccgaggccgagttcgactacgccagatgcggcgtgagagacgtgagcaagaccctggtgggcctggagggcgcccccgccaccagactgagattcaccaagtgcttcagcttcgccagcgtggaggccgagaacgcctacctgtgccagagagccagattcttcgccgagaacgagggcctggacgactacatggaggccagagagggcatgcacctgaagaacgtggacttcagagagttcatggtggccttccccgaccccgccagacccccctggtacgcctgcagcagcgccttctgggccgccgccctgctgaccctgagctggcccctgagagtgctggccgagtacagaaccgcctacgcccactaccacgtggagaagctgttcggcctggagggccccggcagcgccagcagcgccggcggcggcctgagccccagcgacgagctgctgccccccctgacccacagactgcccagagtgaacaccgtggacagcaccgagctggagtggcacatcagaagcaaccagcagctggtgcccagctacagcgaggccgtgctgatggacctggccggcctgggcaccagatgcggcggcgccggcggcggctacgcccccagctgcagatacggcggcgtgggcggccccggcgccgccggcgtggccccctacagaagaagctgcgagcactgccagagagccgtgagcagcagcagcatcttcagcagaagcgccctgagcatctgcgccagccccagagccggccccggccccggcggcggcgccggctgcggcggcagcagattcagcctgggcagactgtacggcagcagaagaagctgcctgtggagaagcagaagcggcagcgtgaacgaggccagctgccccaccgagcagaccagactgagcagccaggccagcatgggcgacgacgaggacgacgacgaggaggaggccggccccccccccccctaccacgacgccctgtacttccccgtgctgatcgtgcacagacaggagggctgcctgggccacagccacagacccctgcacagacacggcagctgcgtggagaccagcctgtag

SEQ ID NO: 23280 - DNA, 552 bp, Artificial Sequence
  Description of Artificial Sequence: Synthetic coding sequence
atgcaggcccccagagccgccctggtgttcgccctggtgatcgccctggtgcccgtgggcagaggcaactacgaggagctggagaacagcggcgacaccaccgtggagagcgagagacccaacaaggtgaccatccccagcaccttcgccgccgtgaccatcaaggagaccctgaacgccaacatcaacagcaccaacttcgcccccgacgagaaccagctggagttcatcctgatggtgctgatccccctgatcctgctggtgctgctgctgctgagcgtggtgttcctggccacctactacaagagaaagagaaccaagcaggagcccagcagccagggcagccagagcgccctgcagacctacgagctgggcagcgagaacgtgaaggtgcccatcttcgaggaggacacccccagcgtgatggagatcgagatggaggagctggacaagtggatgaacagcatgaacagaaacgccgacttcgagtgcctgcccaccctgaaggaggagaaggagagcaaccacaaccccagcgacagcgagagctag

SEQ ID NO: 23281 - DNA, 378 bp, Artificial Sequence
  Description of Artificial Sequence: Synthetic coding sequence
atgcaggcccccagagccgccctggtgttcgccctggtgatcgccctggtgcccgtgggcagaggcaactacgaggagctggagaacagcggcgacaccaccgtggagagcgagagacccaacaaggtgaccatccccagcaccttcgccgccgtgaccatcaaggagaccctgaacgccaacatcaacagcaccaacttcgcccccgacgagaaccagctggagttcatcctgatggtgctgatccccctgatcctgctggtgctgctgctgctgagcgtggtgttcctggccacctactacaagagaaagagaaccaagcaggagcccagcagccagggcagccagagcgccctgcagacctacctgctggtgtag

SEQ ID NO: 23282 - DNA, 891 bp, Artificial Sequence
  Description of Artificial Sequence: Synthetic coding sequence
atgaccaagaccgccctgctgaagctgttcgtggccatcgtgatcaccttcatcctgatcctgcccgagtacttcaagacccccaaggagagaaccctggagctgagctgcctggaggtgtgcctgcagagcaacttcacctacagcctgagcagcctgaacttcagcttcgtgaccttcctgcagcccgtgagagagacccagatcatcatgagaatcttcctgaaccccagcaacttcagaaacttcaccagaacctgccaggacatcaccggcgagttcaagatgtgcagcagctgcctggtgtgcgagagcaagggcaacatggacttcatcagccaggagcagaccagcaaggtgctgatcagaagaggcagcatggaggtgaaggccaacgacttccacagcccctgccagcacttcaacttcagcgtggcccccctggtggaccacctggaggagtacaacaccacctgccacctgaagaaccacaccggcagaagcaccatcatggaggacgagcccagcaaggagaagagcatcaactacacctgcagaatcatggagtaccccaacgactgcatccacatcagcctgcacctggagatggacatcaagaacatcacctgcagcatgaagatcacctggtacatcctggtgctgctggtgttcatcttcctgatcatcctgaccatcagaaagatcctggagggccagagaagagtgcagaagtggcagagccacagagacaagcccaccagcgtgctgctgagaggcagcgacagcgagaagctgagagccctgaacgtgcaggtgctgagcgccgagaccacccagagactgcccctggaccaggtgcaggaggtgctgccccccatccccgagctgtag

SEQ ID NO: 23283 - DNA, 567 bp, Artificial Sequence
  Description of Artificial Sequence: Synthetic coding sequence
atgggcggcggctggtggtgggccagagccgccagactggccagactgagattcagaagaagcctgctgcccccccagagacccagaagcggcggcgccagaggcagcttcgcccccggccacggccccagagccggcgccagccccccccccgtgagcgagctggacagagccgacgcctggctgctgagaaaggcccacgagaccgccttcctgagctggttcagaaacggcctgctggccagcggcatcggcgtgatcagcttcatgcagagcgacatgggcagagaggccgcctacggcttcttcctgctgggcggcctgtgcgtggtgtggggcagcgccagctacgccgtgggcctggccgccctgagaggccccatgcagctgaccctgggcggcgccgccgtgggcgccggcgccgtgctggccgccagcctgctgtgggcctgcgccgtgggcctgtacatgggccagctggagctggacgtggagctggtgcccgaggacgacggcaccgccagcgccgagggccccgacgaggccggcagacccccccccgagtag

SEQ ID NO: 23284 - DNA, 1440 bp, Artificial Sequence
  Description of Artificial Sequence: Synthetic coding sequence
atggccgtgctgggcgtgcagctggtggtgaccctgctgaccgccaccctgatgcacagactggccccccactgcagcttcgccagatggctgctgtgcaacggcagcctgttcagatacaagcaccccagcgaggaggagctgagagccctggccggcaagcccagacccagaggcagaaaggagagatgggccaacggcctgagcgaggagaagcccctgagcgtgcccagagacgcccccttccagctggagacctgccccctgaccaccgtggacgccctggtgctgagattcttcctggagtaccagtggttcgtggacttcgccgtgtacagcggcggcgtgtacctgttcaccgaggcctactactacatgctgggccccgccaaggagaccaacatcgccgtgttctggtgcctgctgaccgtgaccttcagcatcaagatgttcctgaccgtgaccagactgtacttcagcgccgaggagggcggcgagagaagcgtgtgcctgaccttcgccttcctgttcctgctgctggccatgctggtgcaggtggtgagagaggagaccctggagctgggcctggagcccggcctggccagcatgacccagaacctggagcccctgctgaagaagcagggctgggactgggccctgcccgtggccaagctggccatcagagtgggcctggccgtggtgggcagcgtgctgggcgccttcctgaccttccccggcctgagactggcccagacccacagagacgccctgaccatgagcgaggacagacccatgctgcagttcctgctgcacaccagcttcctgagccccctgttcatcctgtggctgtggaccaagcccatcgccagagacttcctgcaccagccccccttcggcgagaccagattcagcctgctgagcgacagcgccttcgacagcggcagactgtggctgctggtggtgctgtgcctgctgagactggccgtgaccagaccccacctgcaggcctacctgtgcctggccaaggccagagtggagcagctgagaagagaggccggcagaatcgaggccagagagatccagcagagagtggtgagagtgtactgctacgtgaccgtggtgagcctgcagtacctgacccccctgatcctgaccctgaactgcaccctgctgctgaagaccctgggcggctacagctggggcctgggccccgcccccctgctgagccccgaccccagcagcgccagcgccgcccccatcggcagcggcgaggacgaggtgcagcagaccgccgccagaatcgccggcgccctgggcggcctgctgacccccctgttcctgagaggcgtgctggcctacctgatctggtggaccgccgcctgccagctgctggccagcctgttcggcctgtacttccaccagcacctggccggcagctag

SEQ ID NO: 23285 - DNA, 1131 bp, Artificial Sequence
  Description of Artificial Sequence: Synthetic coding sequence
atggccgtgctgggcgtgcagctggtggtgaccctgctgaccgccaccctgatgcacagactggccccccactgcagcttcgccagatggctgctgtgcaacggcagcctgttcagatacaagcaccccagcgaggaggagctgagagccctggccggcaagcccagacccagaggcagaaaggagagatgggccaacggcctgagcgaggagaagcccctgagcgtgcccagagacgcccccttccagctggagacctgccccctgaccaccgtggacgccctgggcctggccagcatgacccagaacctggagcccctgctgaagaagcagggctgggactgggccctgcccgtggccaagctggccatcagagtgggcctggccgtggtgggcagcgtgctgggcgccttcctgaccttccccggcctgagactggcccagacccacagagacgccctgaccatgagcgaggacagacccatgctgcagttcctgctgcacaccagcttcctgagccccctgttcatcctgtggctgtggaccaagcccatcgccagagacttcctgcaccagccccccttcggcgagaccagattcagcctgctgagcgacagcgccttcgacagcggcagactgtggctgctggtggtgctgtgcctgctgagactggccgtgaccagaccccacctgcaggcctacctgtgcctggccaaggccagagtggagcagctgagaagagaggccggcagaatcgaggccagagagatccagcagagagtggtgagagtgtactgctacgtgaccgtggtgagcctgcagtacctgacccccctgatcctgaccctgaactgcaccctgctgctgaagaccctgggcggctacagctggggcctgggccccgcccccctgctgagccccgaccccagcagcgccagcgccgcccccatcggcagcggcgaggacgaggtgcagcagaccgccgccagaatcgccggcgccctgggcggcctgctgacccccctgttcctgagaggcgtgctggcctacctgatctggtggaccgccgcctgccagctgctggccagcctgttcggcctgtacttccaccagcacctggccggcagctag

SEQ ID NO: 23286 - DNA, 1464 bp, Artificial Sequence
  Description of Artificial Sequence: Synthetic coding sequence
atgggcgtgatcggcatccagctggtggtgaccatggtgatggccagcgtgatgcagaagatcatcccccactacagcctggccagatggctgctgtgcaacggcagcctgagatggtaccagcaccccaccgaggaggagctgagaatcctggccggcaagcagcagaagggcaagaccaagaaggacagaaagtacaacggccacatcgagagcaagcccctgaccatccccaaggacatcgacctgcacctggagaccaagagcgtgaccgaggtggacaccctggccctgcactacttccccgagtaccagtggctggtggacttcaccgtggccgccaccgtggtgtacctggtgaccgaggtgtactacaacttcatgaagcccacccaggagatgaacatcagcctggtgtggtgcctgctggtgctgagcttcgccatcaaggtgctgttcagcctgaccacccactacttcaaggtggaggacggcggcgagagaagcgtgtgcgtgaccttcggcttcttcttcttcgtgaaggccatggccgtgctgatcgtgaccgagaactacctggagttcggcctggagaccggcttcaccaacttcagcgacagcgccatgcagttcctggagaagcagggcctggagagccagagccccgtgagcaagctgaccttcaagttcttcctggccatcttctgcagcttcatcggcgccttcctgaccttccccggcctgagactggcccagatgcacctggacgccctgaacctggccaccgagaagatcacccagaccctgctgcacatcaacttcctggcccccctgttcatggtgctgctgtgggtgaagcccatcaccaaggactacatcatgaacccccccctgggcaaggagagcatccccctgatgaccgaggccaccttcgacaccctgagactgtggctgatcatcctgctgtgcgccctgagactggccatgatgagaagccacctgcaggcctacctgaacctggcccagaagtgcgtggaccagatgaagaaggaggccggcagaatcagcaccgtggagctgcagaagatggtggccagagtgttctactacctgtgcgtgatcgccctgcagtacgtggcccccctggtgatgctgctgcacaccaccctgctgctgaagaccctgggcaaccacagctggggcatctaccccgagagcatcagcaccctgcccgtggacaacagcctgctgagcaacagcgtgtacagcgagctgcccagcgccgagggcaagatgaaggtgaccgtgacccagatcaccgtggccctgagcagcctgaagaacatcttcacccccctgctgttcagaggcctgctgagcttcctgacctggtggatcgccgcctgcctgttcagcaccagcctgttcggcctgttctaccaccagtacctgaccgtggcctag

SEQ ID NO: 23287 - DNA, 924 bp, Artificial Sequence
  Description of Artificial Sequence: Synthetic coding sequence
atgggcgtgatcggcatccagctggtggtgaccatggtgatggccagcgtgatgcagaagatcatcccccactacagcctggccagatggctgctgtgcaacggcagcctgagatggtaccagcaccccaccgaggaggagctgagaatcctggccggcaagcagcagaagggcaagaccaagaaggacagaaagtacaacggccacatcgagagcaagcccctgaccatccccaaggacatcgacctgcacctggagaccaagagcgtgaccgaggtggacaccctggccctgcactacttccccgagtaccagtggctggtggacttcaccgtggccgccaccgtggtgtacctggtgaccgaggtgtactacaacttcatgaagcccacccaggagatgaacatcagcctggtgtggtgcctgctggtgctgagcttcgccatcaaggtgctgttcagcctgaccacccactacttcaaggtggaggacggcggcgagagaagcgtgtgcgtgaccttcggcttcttcttcttcgtgaaggccatggccgtgctgatcgtgaccgagaactacctggagttcggcctggagaccggcttcaccaacttcagcgacagcgccatgcagttcctggagaagcagggcctggagagccagagccccgtgagcaagctgaccttcaagttcttcctggccatcttctgcagcttcatcggcgccttcctgaccttccccggcctgagactggcccagatgcacctggacgccctgaacctggccaccgagaagatcacccagaccctgctgcacatcaacttcctggcccccctgttcatggtgctgctgtgggtgaagcccatcaccaaggactacatcatgaacccccccctgggcaaggagatcagccccagcggcagatag

SEQ ID NO: 23288 - DNA, 870 bp, Artificial Sequence
  Description of Artificial Sequence: Synthetic coding sequence
atggagcccgccgccggcatccagagaagaagcagccagggccccaccgtgccccccccccccagaggccacgccccccccgccgccgcccccggccccgcccccctgagcagccccgtgagagagcccccccagctggaggaggagagacaggtgagaatcagcgagagcggccagttcagcgacggcctggaggacagaggcctgctggagagcagcaccagactgaagccccacgaggcccagaactacagaaagaaggccctgtgggtgagctggttcagcatcatcgtgaccctggccctggccgtggccgccttcaccgtgagcgtgatgagatacagcgccagcgccttcggcttcgccttcgacgccatcctggacgtgctgagcagcgccatcgtgctgtggagatacagcaacgccgccgccgtgcacagcgcccacagagagtacatcgcctgcgtgatcctgggcgtgatcttcctgctgagcagcatctgcatcgtggtgaaggccatccacgacctgagcaccagactgctgcccgaggtggacgacttcctgttcagcgtgagcatcctgagcggcatcctgtgcagcatcctggccgtgctgaagttcatgctgggcaaggtgctgaccagcagagccctgatcaccgacggcttcaacagcctggtgggcggcgtgatgggcttcagcatcctgctgagcgccgaggtgttcaagcacgacagcgccgtgtggtacctggacggcagcatcggcgtgctgatcggcctgaccatcttcgcctacggcgtgaagctgctgatcgacatggtgcccagagtgagacagaccagacactacgagatgttcgagtag

SEQ ID NO: 23289 - DNA, 279 bp, Artificial Sequence
  Description of Artificial Sequence: Synthetic coding sequence
tgcggcatgagcagaagcggcctgctggagagcagcaccagactgaagccccacgaggcccagaactacagaaagaaggccctgtgggtgagctggttcagcatcatcgtgaccctggccctggccgtggccgccttcaccgtgagcgtgatgagatacagcgccagcgccttcggcttcgccttcgacgccatcctggacgtgctgagcagcgccatcgtgctgtggagatacagcaacgccgccgccgtgcacagcgcccacagagagtacatgtag

SEQ ID NO: 23290 - DNA, 777 bp, Artificial Sequence
  Description of Artificial Sequence: Synthetic coding sequence
atgagcagatacagctaccagagcctgctggactggctgtacggcggcgtggaccccagcttcgccggcaacggcggccccgactgcgccgccttcctgagctggcagcagagactgctggagagcgtggtggtgctgaccctggccctgctggagatcctggtggccctgagacacatcctgagacagaccaaggaggacggcagaggcagccccggcagccagcccgagcaggtgacccagagacccgaggagggcaaggagagcctgagcaagaacctgctgctggtggccctgtgcctgaccttcggcgtggaggtgggcttcaagttcgccaccaagaccgtgatctacctgctgaacccctgccacctggtgaccatgatgcacctgcccttcgagctggagatctactacatccagcacgtgatgctgtacgtggtgcccatctacctgctgtggaagggcggcgcctacacccccgagcccctgagcagcttcagatgggccctgctgagcaccggcctgatgttcttctaccacttcagcgtgctgcagatcctgggcctggtgaccgaggtgaacctgaacaacatgctgtgccccgccatcagcgaccccttctacggcccctggtacagaatctgggccagcggccaccagaccctgatgaccatgacccacggcaagctggtgatcctgttcagctacatggccggccccctgtgcaagtacctgctggacctgctgagactgcccgccaagaagatcgactag

SEQ ID NO: 23291 - DNA, 894 bp, Artificial Sequence
  Description of Artificial Sequence: Synthetic coding sequence
atgagcagatacagctaccagagcctgctggactggctgtacggcggcgtggaccccagcttcgccggcaacggcggccccgactgcgccgccttcctgagctggcagcagagactgctggagagcgtggtggtgctgaccctggccctgctggagatcctggtggccctgagacacatcctgagacagaccaaggaggacggcagaggcagccccggcagccagcccgagcaggtgacccagagacccgaggagggcaaggagagcctgagcaagaacctgctgctggtggccctgtgcctgaccttcggcgtggaggtgggcttcaagttcgccaccaagaccgtgatctacctgctgaacccctgccacctggtgaccatgatgcacatcttcctgctggcctgccccccctgcagaggcgccatcgtggtgttcaagctgcagatgcacatgctgaacggcgccctgctggccctgctgttccccgtggtgaacaccagactgctgcccttcgagctggagatctactacatccagcacgtgatgctgtacgtggtgcccatctacctgctgtggaagggcggcgcctacacccccgagcccctgagcagcttcagatgggccctgctgagcaccggcctgatgttcttctaccacttcagcgtgctgcagatcctgggcctggtgaccgaggtgaacctgaacaacatgctgtgccccgccatcagcgaccccttctacggcccctggtacagaatctgggccagcggccaccagaccctgatgaccatgacccacggcaagctggtgatcctgttcagctacatggccggccccctgtgcaagtacctgctggacctgctgagactgcccgccaagaagatcgactag

SEQ ID NO: 23292 - DNA, 447 bp, Artificial Sequence
  Description of Artificial Sequence: Synthetic coding sequence
atgcacatgctgaacggcgccctgctggccctgctgttccccgtggtgaacaccagactgctgcccttcgagctggagatctactacatccagcacgtgatgctgtacgtggtgcccatctacctgctgtggaagggcggcgcctacacccccgagcccctgagcagcttcagatgggccctgctgagcaccggcctgatgttcttctaccacttcagcgtgctgcagatcctgggcctggtgaccgaggtgaacctgaacaacatgctgtgccccgccatcagcgaccccttctacggcccctggtacagaatctgggccagcggccaccagaccctgatgaccatgacccacggcaagctggtgatcctgttcagctacatggccggccccctgtgcaagtacctgctggacctgctgagactgcccgccaagaagatcgactag

SEQ ID NO: 23293 - DNA, 894 bp, Artificial Sequence; identical to SEQ ID NO: 23291
  Description of Artificial Sequence: Synthetic coding sequence

SEQ ID NO: 23294 - DNA, 777 bp, Artificial Sequence; identical to SEQ ID NO: 23290
  Description of Artificial Sequence: Synthetic coding sequence

SEQ ID NO: 23295 - DNA, 975 bp, Artificial Sequence
  Description of Artificial Sequence: Synthetic coding sequence
atggccgccgccgcccccggcaacggcagagccagcgcccccagactgctgctgctgttcctggtgcccctgctgtgggcccccgccgccgtgagagccggccccgacgaggacctgagccacagaaacaaggagccccccgcccccgcccagcagctgcagccccagcccgtggccgtgcagggccccgagcccgccagagtggagaagatcttcacccccgccgcccccgtgcacaccaacaaggaggaccccgccacccagaccaacctgggcttcatccacgccttcgtggccgccatcagcgtgatcatcgtgagcgagctgggcgacaagaccttcttcatcgccgccatcatggccatgagatacaacagactgaccgtgctggccggcgccatgctggccctgggcctgatgacctgcctgagcgtgctgttcggctacgccaccaccgtgatccccagagtgtacacctactacgtgagcaccgtgctgttcgccatcttcggcatcagaatgctgagagagggcctgaagatgagccccgacgagggccaggaggagctggaggaggtgcaggccgagctgaagaagaaggacgaggagttccagagaaccaagctgctgaacggccccggcgacgtggagaccggcaccagcatcaccgtgccccagaagaagtggctgcacttcatcagccccatcttcgtgcaggccctgaccctgaccttcctggccgagtggggcgacagaagccagctgaccaccatcgtgctggccgccagagaggacccctacggcgtggccgtgggcggcaccgtgggccactgcctgtgcaccggcctggccgtgatcggcggcagaatgatcgcccagaagatcagcgtgagaaccgtgaccatcatcggcggcatcgtgttcctggccttcgccttcagcgccctgttcatcagccccgacagcggcttctag

SEQ ID NO: 23296 - DNA, 786 bp, Artificial Sequence
  Description of Artificial Sequence: Synthetic coding sequence
atggagatccccatgcagaagatcttcacccccgccgcccccgtgcacaccaacaaggaggaccccgccacccagaccaacctgggcttcatccacgccttcgtggccgccatcagcgtgatcatcgtgagcgagctgggcgacaagaccttcttcatcgccgccatcatggccatgagatacaacagactgaccgtgctggccggcgccatgctggccctgggcctgatgacctgcctgagcgtgctgttcggctacgccaccaccgtgatccccagagtgtacacctactacgtgagcaccgtgctgttcgccatcttcggcatcagaatgctgagagagggcctgaagatgagccccgacgagggccaggaggagctggaggaggtgcaggccgagctgaagaagaaggacgaggagttccagagaaccaagctgctgaacggccccggcgacgtggagaccggcaccagcatcaccgtgccccagaagaagtggctgcacttcatcagccccatcttcgtgcaggccctgaccctgaccttcctggccgagtggggcgacagaagccagctgaccaccatcgtgctggccgccagagaggacccctacggcgtggccgtgggcggcaccgtgggccactgcctgtgcaccggcctggccgtgatcggcggcagaatgatcgcccagaagatcagcgtgagaaccgtgaccatcatcggcggcatcgtgttcctggccttcgccttcagcgccctgttcatcagccccgacagcggcttctag

SEQ ID NO: 23297 - DNA, 219 bp, Artificial Sequence
  Description of Artificial Sequence: Synthetic coding sequence
atgagcgccatcttcaacttccagagcctgctgaccgtgatcctgctgctgatctgcacctgcgcctacatcagaagcctggcccccagcctgctggacagaaacaagaccggcctgctgggcatcttctggaagtgcgccagaatcggcgagagaaagagcccctacgtggccgtgtgctgcatcgtgatggccttcagcatcctgttcatccagtag

SEQ ID NO: 23298 - DNA, 225 bp, Artificial Sequence
  Description of Artificial Sequence: Synthetic coding sequence
atgaccaacgtgtacagcctggacggcatcctggtgttcggcctgctgttcgtgtgcacctgcgcctacttcaagaaggtgcccagactgaagacctggctgctgagcgagaagaagggcgtgtggggcgtgttctacaaggccgccgtgatcggcaccagactgcacgccgccgtggccatcgcctgcgtggtgatggccttctacgtgctgttcatcaagtag

SEQ ID NO: 23299 - DNA, 2094 bp, Artificial Sequence
  Description of Artificial Sequence: Synthetic coding sequence
atgtgcaagagcctgagatactgcttcagccactgcctgtacctggccatgaccagactggaggaggtgaacagagaggtgaacatgcacagcagcgtgagatacctgggctacctggccagaatcaacctgctggtggccatctgcctgggcctgtacgtgagatgggagaagaccgccaacagcctgatcctggtgatcttcatcctgggcctgttcgtgctgggcatcgccagcatcctgtactactacttcagcatggaggccgccagcctgagcctgagcaacctgtggttcggcttcctgctgggcctgctgtgcttcctggacaacagcagcttcaagaacgacgtgaaggaggagagcaccaagtacctgctgctgaccagcatcgtgctgagaatcctgtgcagcctggtggagagaatcagcggctacgtgagacacagacccaccctgctgaccaccgtggagttcctggagctggtgggcttcgccatcgccagcaccaccatgctggtggagaagagcctgagcgtgatcctgctggtggtggccctggccatgctgatcatcgacctgagaatgaagagcttcctggccatccccaacctggtgatcttcgccgtgctgctgttcttcagcagcctggagacccccaagaaccccatcgccttcgcctgcttcttcatctgcctgatcaccgaccccttcctggacatctacttcagcggcctgagcgtgaccgagagatggaagcccttcctgtacagaggcagaatctgcagaagactgagcgtggtgttcgccggcatgatcgagctgaccttcttcatcctgagcgccttcaagctgagagacacccacctgtggtacttcgtgatccccggcttcagcatcttcggcatcttctggatgatctgccacatcatcttcctgctgaccctgtggggcttccacaccaagctgaacgactgccacaaggtgtacttcacccacagaaccgactacaacagcctggacagaatcatggccagcaagggcatgagacacttctgcctgatcagcgagcagctggtgttcttcagcctgctggccaccgccatcctgggcgccgtgagctggcagcccaccaacggcatcttcctgagcatgttcctgatcgtgctgcccctggagagcatggcccacggcctgttccacgagctgggcaactgcctgggcggcaccagcgtgggctacgccatcgtgatccccaccaacttctgcagccccgacggccagcccaccctgctgccccccgagcacgtgcaggagctgaacctgagaagcaccggcatgctgaacgccatccagagattcttcgcctaccacatgatcgagacctacggctgcgactacagcaccagcggcctgagcttcgacaccctgcacagcaagctgaaggccttcctggagctgagaaccgtggacggccccagacacgacacctacatcctgtactacagcggccacacccacggcaccggcgagtgggccctggccggcggcgacaccctgagactggacaccctgatcgagtggtggagagagaagaacggcagcttctgcagcagactgatcatcgtgctggacagcgagaacagcaccccctgggtgaaggaggtgagaaagatcaacgaccagtacatcgccgtgcagggcgccgagctgatcaagaccgtggacatcgaggaggccgaccccccccagctgggcgacttcaccaaggactgggtggagtacaactgcaacagcagcaacaacatctgctggaccgagaagggcagaaccgtgaaggccgtgtacggcgtgagcaagagatggagcgactacaccctgcacctgcccaccggcagcgacgtggccaagcactggatgctgcacttccccagaatcacctaccccctggtgcacctggccaactggctgtgcggcctgaacctgttctggatctgcaagacctgcttcagatgcctgaagagactgaagatgagctggttcctgcccaccgtgctggacaccggccagggcttcaagctggtgaagagctag

SEQ ID NO: 23300 - DNA, 942 bp, Artificial Sequence
  Description of Artificial Sequence: Synthetic coding sequence
atgttcctgatcgtgctgcccctggagagcatggcccacggcctgttccacgagctgggcaactgcctgggcggcaccagcgtgggctacgccatcgtgatccccaccaacttctgcagccccgacggccagcccaccctgctgccccccgagcacgtgcaggagctgaacctgagaagcaccggcatgctgaacgccatccagagattcttcgcctaccacatgatcgagacctacggctgcgactacagcaccagcggcctgagcttcgacaccctgcacagcaagctgaaggccttcctggagctgagaaccgtggacggccccagacacgacacctacatcctgtactacagcggccacacccacggcaccggcgagtgggccctggccggcggcgacaccctgagactggacaccctgatcgagtggtggagagagaagaacggcagcttctgcagcagactgatcatcgtgctggacagcgagaacagcaccccctgggtgaaggaggtgagaaagatcaacgaccagtacatcgccgtgcagggcgccgagctgatcaagaccgtggacatcgaggaggccgaccccccccagctgggcgacttcaccaaggactgggtggagtacaactgcaacagcagcaacaacatctgctggaccgagaagggcagaaccgtgaaggccgtgtacggcgtgagcaagagatggagcgactacaccctgcacctgcccaccggcagcgacgtggccaagcactggatgctgcacttccccagaatcacctaccccctggtgcacctggccaactggctgtgcggcctgaacctgttctggatctgcaagacctgcttcagatgcctgaagagactgaagatgagctggttcctgcccaccgtgctggacaccggccagggcttcaagctggtgaagagctag

SEQ ID NO: 23301 - DNA, 2094 bp, Artificial Sequence; identical to SEQ ID NO: 23299
  Description of Artificial Sequence: Synthetic coding sequence

SEQ ID NO: 23302 - DNA, 894 bp, Artificial Sequence
  Description of Artificial Sequence: Synthetic coding sequence
atggaggagcccaccgccgtggagggccaggtgcagctgcccagcccccaccagggcagcctgagaaaggccgtggccgccgccctggccctggacggcgagagcaccatgggccacagaaagaagaagagaaaggagagcagacccgagagcatcatcatctacagaagcgacaacgagaagaccgacgaggagcccggcgagagcgagggcggcgaccagcccaaggaggaggagggcgacgacttcctggactaccccgtggacgacgacatgtggaacctgcccctggacagcagatacgtgaccctgaccggcaccatcaccagaggcaagaagaagggccagatggtggacatccacgtgaccctgaccgagaaggagctgcaggagctgaccaagcccaaggagagcagcagagagaccacccccgagggcagaatggcctgccagatgggcgccgacagaggcccccacgtggtgctgtggaccctgatctgcctgcccgtggtgttcatcctgagcttcgtggtgagcttctactacggcaccatcacctggtacaacatcttcctggtgtacaacgaggagagaaccttctggcacaagatcagctactgcccctgcctggtgctgttctaccccgtgctgatcatggccatggccagcagcctgggcctgtacgccgccgtggtgcagctgagctggagctgggaggcctggtggcaggccgccagagacatggagaagggcttctgcggctggctgtgcagcaagctgggcctggaggactgcagcccctacagcatcgtggagctgctggagagcgacaacatcagcagcaccctgagcaacaaggaccccatccaggaggtggagaccagcaccgtgtag

SEQ ID NO: 23303 - DNA, 894 bp, Artificial Sequence; identical to SEQ ID NO: 23302
  Description of Artificial Sequence: Synthetic coding sequence

SEQ ID NO: 23304 - DNA, 351 bp, Artificial Sequence
  Description of Artificial Sequence: Synthetic coding sequence
atggaggagcccaccgccgtggagggccaggtgcagctgcccagcccccaccagggcagcctgagaaaggccgtggccgccgccctggccctggacggcgagagcaccatgggccacagaaagaagaagagaaaggagagcagacccgagagcatcatcatctacagaagcgacaacgagaagaccgacgaggagcccggcgagagcgagggcggcgaccagcccaaggaggaggagggcgacgacttcctggactaccccgtggacgacgacatgtggaacctgcccctggacagcagatacgtgaccctgaccggcaccatcaccagaggcaagaagaagggccagtag

SEQ ID NO: 23305 - DNA, 894 bp, Artificial Sequence; identical to SEQ ID NO: 23302
  Description of Artificial Sequence: Synthetic coding sequence

SEQ ID NO: 23306 - DNA, 894 bp, Artificial Sequence; identical to SEQ ID NO: 23302
  Description of Artificial Sequence: Synthetic coding sequence

SEQ ID NO: 23307 - DNA, 309 bp, Artificial Sequence
  Description of Artificial Sequence: Synthetic coding sequence
atggaggagcccaccgccgtggagggccaggtgcagctgcccagcccccaccagggcagcctgagaaaggccgtggccgccgccctggccctggacggcgagagcaccatgggccacagaaagaagaagagaaaggagagcagacccgagagcatcatcatctacagaagcgacaacgagaagaccgacgaggagcccggcgagagcgagggcggcgaccagcccaaggaggaggagggcgacgacttcctggactaccccgtggacgacgacatgtggaacctgcccctggacagcagatacgtgtag

SEQ ID NO: 23308 - DNA, 597 bp, Artificial Sequence
  Description of Artificial Sequence: Synthetic coding sequence
atggagctgcccgaccccgtgagacagagactgggcaacttcagcagagccgtgttcagcgacagcaacagaaccggccccgagagcaacgagggccccgagaacgagatggtgagcagcctggccctgcagatgagcctgtacttcaacacctactacttccccctgtggtgggtgagcagcatcatgatgctgcacatgaagtacagcatcctgcccgactactacaagttcatcgtgatcaccgtgatcatcctgatcaccctgatcgaggccatcagactgtacctgggctacgtgggcaacctgcaggagaaggtgcccgagctggccggcttctggctgctgagcctgctgctgcagctgcccctgatcctgttcctgctgttcaacgagggcctgaccaacctgcccctggagaaggccatccacatcatcttcaccctgttcctggccttccaggtggtggccgccttcctgaccctgagaaagatggtgaaccagctggccgtgagattccacctgcaggacttcgacagactgagcgccaacagaggcgacatgagaagaatgagaagctgcatcgaggagatctag

SEQ ID NO: 23309 - DNA, 435 bp, Artificial Sequence
  Description of Artificial Sequence: Synthetic coding sequence
atggagagagagggcagcggcggcagcggcggcagcgccggcctgctgcagcagatcctgagcctgaaggtggtgcccagagtgggcaacggcaccctgtgccccaacagcaccagcctgtgcagcttccccgagatgtggtacggcgtgttcctgtgggccctggtgagcagcctgttcttccacgtgcccgccggcctgctggccctgttcaccctgagacaccacaagtacggcagattcatgagcgtgagcatcctgctgatgggcatcgtgggccccatcaccgccggcatcctgaccagcgccgccatcgccggcgtgtacagagccgccggcaaggagatgatccccttcgaggccctgaccctgggcaccggccagaccttctgcgtgctggtggtgagcttcctgagaatcctggccaccctgtag

SEQ ID NO: 23310 - DNA, 435 bp, Artificial Sequence; identical to SEQ ID NO: 23309
  Description of Artificial Sequence: Synthetic coding sequence

SEQ ID NO: 23311 - DNA, 399 bp, Artificial Sequence
  Description of Artificial Sequence: Synthetic coding sequence
atgaaggccgagggcggcgaccacagcatgatcaacctgagcgtgcagcaggtgctgagcctgtgggcccacggcaccgtgctgagaaacctgaccgagatgtggtactggatcttcctgtgggccctgttcagcagcctgttcgtgcacggcgccgccggcgtgctgatgttcgtgatgctgcagagacacagacagggcagagtgatcagcgtgatcgccgtgagcatcggcttcctggccagcgtgaccggcgccatgatcaccagcgccgccgtggccggcatctacagagtggccggcaagaacatggcccccctggaggccctggtgtggggcgtgggccagaccgtgctgaccctgatcatcagcttcagcagaatcctggccaccctgtag

SEQ ID NO: 23312 - DNA, 399 bp, Artificial Sequence; identical to SEQ ID NO: 23311
  Description of Artificial Sequence: Synthetic coding sequence

SEQ ID NO: 23313 - DNA, 972 bp, Artificial Sequence
  Description of Artificial Sequence: Synthetic coding sequence
atgagccccgccgccgccgccgagcccgacggcgaccagcaggacagacacgtgagcaagctgatcttctgcttcttcgtgttcggcgccgtgctgctgtgcgtgggcgtgctgctgagcatcttcggcttccaggcctgccagtacaagcccctgcccgactgccccatggtgctgaaggtggccggccccgcctgcgccgtggtgggcctgggcgccgtgatcctggccagaagcagagcccagctgcagctgagagccggcctgcagagaggccagcagatggaccccgacagagccttcatctgcggcgagagcagacagttcgcccagtgcctgatcttcggcttcctgttcctgaccagcggcatgctgatcagcgtgctgggcatctgggtgcccggctgcggcagcaactgggcccaggagcccctgaacgagaccgacaccggcgacagcgagcccagaatgtgcggcttcctgagcctgcagatcatgggccccctgatcgtgctggtgggcctgtgcttcttcgtggtggcccacgtgaagaagagaaacaccctgaacgccggccaggacgccagcgagagagaggagggccagatccagatcatggagcccgtgcaggtgaccgtgggcgacagcgtgatcatcttccccccccccccccccccctacttccccgagagcagcgccagcgccgtggccgagagccccggcaccaacagcctgctgcccaacgagaacccccccagctactacagcatcttcaactacggcacccccaccagcgagggcgccgccagcgagagagactgcgagagcatctacaccatcagcggcaccaacagcagcagcgaggccagccacaccccccacctgcccagcgagctgccccccagatacgaggagaaggagaacgccgccgccaccttcctgcccctgagcagcgagcccagccccccctag

SEQ ID NO: 23314 - DNA, 975 bp, Artificial Sequence
  Description of Artificial Sequence: Synthetic coding sequence
atgagccccgccgccgccgccgagcccgacggcgaccagcaggacagacacgtgagcaagctgatcttctgcttcttcgtgttcggcgccgtgctgctgtgcgtgggcgtgctgctgagcatcttcggcttccaggcctgccagtacaagcccctgcccgactgccccatggtgctgaaggtggccggccccgcctgcgccgtggtgggcctgggcgccgtgatcctggccagaagcagagcccagctgcagctgagagccggcctgcagagaggccagcagatggaccccgacagagccttcatctgcggcgagagcagacagttcgcccagtgcctgatcttcggcttcctgttcctgaccagcggcatgctgatcagcgtgctgggcatctgggtgcccggctgcggcagcaactgggcccaggagcccctgaacgagaccgacaccggcgacagcgagcccagaatgtgcggcttcctgagcctgcagatcatgggccccctgatcgtgctggtgggcctgtgcttcttcgtggtggcccacgtgaagaagagaaacaccctgaacgccggccaggacgccagcgagagagaggagggccagatccagatcatggagcccgtgcaggtgaccgtgggcgacagcgtgatcatcttccccccccccccccccccctacttccccgagagcagcgccagcgccgtggccgagagccccggcaccaacagcctgctgcccaacgagaacccccccagctactacagcatcttcaactacggcagaacccccaccagcgagggcgccgccagcgagagagactgcgagagcatctacaccatcagcggcaccaacagcagcagcgaggccagccacaccccccacctgcccagcgagctgccccccagatacgaggagaaggagaacgccgccgccaccttcctgcccctgagcagcgagcccagccccccctag

SEQ ID NO: 23315 - DNA, 732 bp, Artificial Sequence
  Description of Artificial Sequence: Synthetic coding sequence
atggagcagggcagcggcagactggaggacttccccgtgaacgtgttcagcgtgaccccctacacccccagcaccgccgacatccaggtgagcgacgacgacaaggccggcgccaccctgctgttcagcggcatcttcctgggcctggtgggcatcaccttcaccgtgatgggctggatcaagtaccagggcgtgagccacttcgagtggacccagctgctgggccccgtgctgctgagcgtgggcgtgaccttcatcctgatcgccgtgtgcaagttcaagatgctgagctgccagctgtgcaaggagagcgaggagagagtgcccgacagcgagcagacccccggcggccccagcttcgtgttcaccggcatcaaccagcccatcaccttccacggcgccaccgtggtgcagtacatcccccccccctacggcagccccgagcccatgggcatcaacaccagctacctgcagagcgtggtgagcccctgcggcctgatcaccagcggcggcgccgccgccgccatgagcagccccccccagtactacaccatctacccccaggacaacagcgccttcgtggtggacgagggctgcctgagcttcaccgacggcggcaaccacagacccaaccccgacgtggaccagctggaggagacccagctggaggaggaggcctgcgcctgcttcagcccccccccctacgaggagatctacagcctgcccagatag

SEQ ID NO: 23316 - DNA, 1515 bp, Artificial Sequence
  Description of Artificial Sequence: Synthetic coding sequence
atgagccagcccagaacccccgagcaggccctggacacccccggcgactgcccccccggcagaagagacgaggacgccggcgagggcatccagtgcagccagagaatgctgagcttcagcgacgccctgctgagcatcatcgccaccgtgatgatcctgcccgtgacccacaccgagatcagccccgagcagcagttcgacagaagcgtgcagagactgctggccaccagaatcgccgtgtacctgatgaccttcctgatcgtgaccgtggcctgggccgcccacaccagactgttccaggtggtgggcaagaccgacgacaccctggccctgctgaacctggcctgcatgatgaccatcaccttcctgccctacaccttcagcctgatggtgaccttccccgacgtgcccctgggcatcttcctgttctgcgtgtgcgtgatcgccatcggcgtggtgcaggccctgatcgtgggctacgccttccacttcccccacctgctgagcccccagatccagagaagcgcccacagagccctgtacagaagacacgtgctgggcatcgtgctgcagggccccgccctgtgcttcgccgccgccatcttcagcctgttcttcgtgcccctgagctacctgctgatggtgaccgtgatcctgctgccctacgtgagcaaggtgaccggctggtgcagagacagactgctgggccacagagagcccagcgcccaccccgtggaggtgttcagcttcgacctgcacgagcccctgagcaaggagagagtggaggccttcagcgacggcgtgtacgccatcgtggccaccctgctgatcctggacatctgcgaggacaacgtgcccgaccccaaggacgtgaaggagagattcagcggcagcctggtggccgccctgagcgccaccggccccagattcctggcctacttcggcagcttcgccaccgtgggcctgctgtggttcgcccaccacagcctgttcctgcacgtgagaaaggccaccagagccatgggcctgctgaacaccctgagcctggccttcgtgggcggcctgcccctggcctaccagcagaccagcgccttcgccagacagcccagagacgagctggagagagtgagagtgagctgcaccatcatcttcctggccagcatcttccagctggccatgtggaccaccgccctgctgcaccaggccgagaccctgcagcccagcgtgtggttcggcggcagagagcacgtgctgatgttcgccaagctggccctgtacccctgcgccagcctgctggccttcgccagcacctgcctgctgagcagattcagcgtgggcatcttccacctgatgcagatcgccgtgccctgcgccttcctgctgctgagactgctggtgggcctggccctggccaccctgagagtgctgagaggcctggccagacccgagcaccccccccccgcccccaccggccaggacgacccccagagccagctgctgcccgccccctgctag

SEQ ID NO: 23317 - DNA, 798 bp, Artificial Sequence
  Description of Artificial Sequence: Synthetic coding sequence
atgaccttcctgatcgtgaccgtggcctgggccgcccacaccagactgttccaggtggtgggcaagaccgacgacaccctggccctgctgaacctggcctgcatgatgaccatcaccttcctgccctacaccttcagcctgatggtgaccttccccgacgtgcccctgggcatcttcctgttctgcgtgtgcgtgatcgccatcggcgtggtgcaggccctgatcgtgggctacgccttccacttcccccacctgctgagcccccagatccagagaagcgcccacagagccctgtacagaagacacgtgctgggcatcgtgctgcagggccccgccctgtgcttcgccgccgccatcttcagcctgttcttcgtgcccctgagctacctgctgatggtgaccgtgatcctgctgccctacgtgagcaaggtgaccggctggtgcagagacagactgctgggccacagagagcccagcgcccaccccgtggaggtgttcagcttcgacctgcacgagcccctgagcaaggagagagtggaggccttcagcgacggcgtgtacgccatcgtggccaccctgctgatcctggacatctgcgccccccacagattcgccgccccccccgcccccttcggctggctgctgctgcccagcagcgtgtgcagcagcgccgccagcagcgccagcagcagcgtgagagccagagtgagcagccagagcagcagattctggttcctgtggggcttcttcttcttcttcctgagacagagctgctgcgtggcccaggccggcgtgtag

SEQ ID NO: 23318 - DNA, 405 bp, Artificial Sequence
  Description of Artificial Sequence: Synthetic coding sequence
atgagccagcccagaacccccgagcaggccctggacacccccggcgactgcccccccggcagaagagacgaggacgccggcgagggcatccagtgcagccagagaatgctgagcttcagcgacgccctgctgagcatcatcgccaccgtgatgatcctgcccgtgacccacaccgagatcagccccgagcagcagttcgacagaagcgtgcagagactgctggccaccagaatcgccgtgtacctgatgaccttcctgatcgtgaccgtggcctgggccgcccacaccagactgttccaggtggtgggcaagaccgacgacaccctggccctgctgaacctggcctgcatgatgaccatcaccttcctgccctacaccttcagcctgatggtgaccttcccctag

SEQ ID NO: 23319 - DNA, 1167 bp, Artificial Sequence
  Description of Artificial Sequence: Synthetic coding sequence
atgatgaccatcaccttcctgccctacaccttcagcctgatggtgaccttccccgacgtgcccctgggcatcttcctgttctgcgtgtgcgtgatcgccatcggcgtggtgcaggccctgatcgtgggctacgccttccacttcccccacctgctgagcccccagatccagagaagcgcccacagagccctgtacagaagacacgtgctgggcatcgtgctgcagggccccgccctgtgcttcgccgccgccatcttcagcctgttcttcgtgcccctgagctacctgctgatggtgaccgtgatcctgctgccctacgtgagcaaggtgaccggctggtgcagagacagactgctgggccacagagagcccagcgcccaccccgtggaggtgttcagcttcgacctgcacgagcccctgagcaaggagagagtggaggccttcagcgacggcgtgtacgccatcgtggccaccctgctgatcctggacatctgcgaggacaacgtgcccgaccccaaggacgtgaaggagagattcagcggcagcctggtggccgccctgagcgccaccggccccagattcctggcctacttcggcagcttcgccaccgtgggcctgctgtggttcgcccaccacagcctgttcctgcacgtgagaaaggccaccagagccatgggcctgctgaacaccctgagcctggccttcgtgggcggcctgcccctggcctaccagcagaccagcgccttcgccagacagcccagagacgagctggagagagtgagagtgagctgcaccatcatcttcctggccagcatcttccagctggccatgtggaccaccgccctgctgcaccaggccgagaccctgcagcccagcgtgtggttcggcggcagagagcacgtgctgatgttcgccaagctggccctgtacccctgcgccagcctgctggccttcgccagcacctgcctgctgagcagattcagcgtgggcatcttccacctgatgcagatcgccgtgccctgcgccttcctgctgctgagactgctggtgggcctggccctggccaccctgagagtgctgagaggcctggccagacccgagcaccccccccccgcccccaccggccaggacgacccccagagccagctgctgcccgccccctgctag

SEQ ID NO: 23320 - DNA, 708 bp, Artificial Sequence
  Description of Artificial Sequence: Synthetic coding sequence
atgggcaccgccgacagcgacgagatggcccccgaggccccccagcacacccacatcgacgtgcacatccaccaggagagcgccctggccaagctgctgctgacctgctgcagcgccctgagacccagagccacccaggccagaggcagcagcagactgctggtggccagctgggtgatgcagatcgtgctgggcatcctgagcgccgtgctgggcggcttcttctacatcagagactacaccctgctggtgaccagcggcgccgccatctggaccggcgccgtggccgtgctggccggcgccgccgccttcatctacgagaagagaggcggcacctactgggccctgctgagaaccctgctgaccctggccgccttcagcaccgccatcgccgccctgaagctgtggaacgaggacttcagatacggctacagctactacaacagcgcctgcagaatcagcagcagcagcgactggaacacccccgcccccacccagagccccgaggaggtgagaagactgcacctgtgcaccagcttcatggacatgctgaaggccctgttcagaaccctgcaggccatgctgctgggcgtgtggatcctgctgctgctggccagcctgacccccctgtggctgtactgctggagaatgttccccaccaagggcaagagagaccagaaggagatgctggaggtgagcggcatctag

SEQ ID NO: 23321 - DNA, 708 bp, Artificial Sequence; identical to SEQ ID NO: 23320
  Description of Artificial Sequence: Synthetic coding sequence

SEQ ID NO: 23322 - DNA, 813 bp, Artificial Sequence
  Description of Artificial Sequence: Synthetic coding sequence
atgacccagaacaccgtgatcgtgaacggcgtggccatggccagcagacccagccagcccacccacgtgaacgtgcacatccaccaggagagcgccctgacccagctgctgaaggccggcggcagcctgaagaagttcctgttccaccccggcgacaccgtgcccagcaccgccagaatcggctacgagcagctggccctgggcgtgacccagatcctgctgggcgtggtgagctgcgtgctgggcgtgtgcctgagcctgggcccctggaccgtgctgagcgccagcggctgcgccttctgggccggcagcgtggtgatcgccgccggcgccggcgccatcgtgcacgagaagcaccccggcaagctggccggctacatcagcagcctgctgaccctggccggcttcgccaccgccatggccgccgtggtgctgtgcgtgaacagcttcatctggcagaccgagcccttcctgtacatcgacaccgtgtgcgacagaagcgaccccgtgttccccaccaccggctacagatggatgagaagaagccaggagaaccagtggcagaaggaggagtgcagagcctacatgcagatgctgagaaagctgttcaccgccatcagagccctgttcctggccgtgtgcgtgctgaaggtgatcgtgagcctggtgagcctgggcgtgggcctgagaaacctgtgcggccagagcagccagcccctgaacgaggagggcagcgagaagagactgctgggcgagaacagcgtgccccccagccccagcagagagcagaccagcaccgccatcgtgctgtag

SEQ ID NO: 23323 - DNA, 813 bp, Artificial Sequence; identical to SEQ ID NO: 23322
  Description of Artificial Sequence: Synthetic coding sequence

SEQ ID NO: 23324 - DNA, 813 bp, Artificial Sequence; identical to SEQ ID NO: 23322
  Description of Artificial Sequence: Synthetic coding sequence

SEQ ID NO: 23325 - DNA, 813 bp, Artificial Sequence; identical to SEQ ID NO: 23322
  Description of Artificial Sequence: Synthetic coding sequence

SEQ ID NO: 23326 - DNA, 702 bp, Artificial Sequence
  Description of Artificial Sequence: Synthetic coding sequence
atgacccagaacaccgtgatcgtgaacggcgtggccatggccagcagacccagccagcccacccacgtgaacgtgcacatccaccaggagagcgccctgacccagctgctgaaggccggcggcagcctgaagaagttcctgttccaccccggcgacaccgtgcccagcaccgccagaatcggctacgagcagctggccctgggcgtgatcgccgccggcgccggcgccatcgtgcacgagaagcaccccggcaagctggccggctacatcagcagcctgctgaccctggccggcttcgccaccgccatggccgccgtggtgctgtgcgtgaacagcttcatctggcagaccgagcccttcctgtacatcgacaccgtgtgcgacagaagcgaccccgtgttccccaccaccggctacagatggatgagaagaagccaggagaaccagtggcagaaggaggagtgcagagcctacatgcagatgctgagaaagctgttcaccgccatcagagccctgttcctggccgtgtgcgtgctgaaggtgatcgtgagcctggtgagcctgggcgtgggcctgagaaacctgtgcggccagagcagccagcccctgaacgaggagggcagcgagaagagactgctgggcgagaacagcgtgccccccagccccagcagagagcagaccagcaccgccatcgtgctgtag

SEQ ID NO: 23327 - DNA, 813 bp, Artificial Sequence; identical to SEQ ID NO: 23322
  Description of Artificial Sequence: Synthetic coding sequence

SEQ ID NO: 23328 - DNA, 813 bp, Artificial Sequence; identical to SEQ ID NO: 23322
  Description of Artificial Sequence: Synthetic coding sequence

SEQ ID NO: 23329 - DNA, 936 bp, Artificial Sequence
  Description of Artificial Sequence: Synthetic coding sequence
atggccggccccctgtggagaaccgccgccttcgtgcagagacacagaaccggcctgctggtgggcagctgcgccggcctgttcggcgtgcccatcagctaccacctgttccccgaccccgtggtgcagtggctgtaccagtactggccccagggccagcccgcccccctgcccccccagctgcagagcctgttccaggaggtgctgcaggacatcggcgtgcccagcggccactgctacaagcccttcaccaccttcaccttccagcccgtgagcgccggcttccccagactgcccgccggcgccgtggtgggcatccccgccagcttcctgggcgacctggtgatcaacaccaaccaccccgtggtgatccacggccacaccgtggactggagaagccccgccggcgccagactgagagccagcctgaccctgagcagagaggcccagaagttcgccctggccagagaggtggtgtacctggagagcagcaccaccgccgtgcacgccctgctggcccccgcctgcctggccggcacctgggccctgggcgtgggcgccaagtacaccctgggcctgcacgccggccccatgaacctgagagccgccttcagcctggtggccgccgtggccggcttcgtggcctacgccttcagccaggacagcctgacccacgccgtggagagctggctggacagaagaaccgccagcctgagcgccgcctacgcctgcggcggcgtggagttctacgagaagctgctgagcggcaacctggccctgagaagcctgctgggcaaggacggcgagaagctgtacacccccagcggcaacatcgtgcccagacacctgttcagaatcaagcacctgccctacaccaccagaagagacagcgtgctgcagatgtggagaggcatgctgaaccccggcagaagctag

SEQ ID NO: 23330 - DNA, 936 bp, Artificial Sequence; identical to SEQ ID NO: 23329
  Description of Artificial Sequence: Synthetic coding sequence

SEQ ID NO: 23331 - DNA, 753 bp, Artificial Sequence
  Description of Artificial Sequence: Synthetic coding sequence
atggccggccccctgtggagaaccgccgccttcgtgcagagacacagaaccggcctgctggtgggcagctgcgccggcctgttcggcgtgcccatcagctaccacctgttccccgaccccgtggtgcagtggctgtaccagtactggccccagggccagcccgcccccctgcccccccagctgcagagcctgttccaggaggtgctgcaggacatcggcgtgcccagcggccactgctacaagcccttcaccaccttcaccttccagcccgtgagcgccggcttccccagactgcccgccggcgccgtggtgggcatccccgccagcttcctgggcgacctggtgatcaacaccaaccaccccgtggtgatccacggccacaccgtggactggagaagccccgccggcgccagactgagagccagcctgaccctgagcagagaggcccagaagttcgccctggccagagaggtggtgtacctggagagcagcaccaccgccgtgcacgccctgctggcccccgcctgcctggccggcacctgggccctgggcgtgggcgccaagtacaccctgggcctgcacgccggccccatgaacctgagagccgccagcctgagcgccgcctacgcctgcggcggcgtggagttctacgagaagctgctgagcggcaacctggccctgagaagcctgctgggcaaggacggcgagaagctgcagatgtggagaggcatgctgaaccccggcagaagctag

SEQ ID NO: 23332 - DNA, 936 bp, Artificial Sequence; identical to SEQ ID NO: 23329
  Description of Artificial Sequence: Synthetic coding sequence

SEQ ID NO: 23333 - DNA, 345 bp, Artificial Sequence
  Description of Artificial Sequence: Synthetic coding sequence
atggccggccccctgtggagaaccgccgccttcgtgcagagacacagaaccggcctgctggtgggcagctgcgccggcctgttcggcgtgcccatcagctaccacctgttccccgaccccgtggtgcagtggctgtaccagtactggccccagggccagcccgcccccctgcccccccagctgcagagcctgttccaggaggtgctgcaggacatcggcgtgcccagcggccactgctacaagcccttcaccaccttcaccttccagcccgtgagcgccggcttccccagactgcccgccggcgccgtggtgggcatccccgccagcttcctgggcgacctgtag

SEQ ID NO: 23334 - DNA, 894 bp, Artificial Sequence
  Description of Artificial Sequence: Synthetic coding sequence
atggagcccagagccctggtgaccgccctgagcctgggcctgagcctgtgcagcctgggcctgctggtgaccgccatcttcaccgaccactggtacgagaccgaccccagaagacacaaggagagctgcgagagaagcagagccggcgccgacccccccgaccagaagaacagactgatgcccctgagccacctgcccctgagagacagcccccccctgggcagaagactgctgcccggcggccccggcagagccgaccccgagagctggagaagcctgctgggcctgggcggcctggacgccgagtgcggcagacccctgttcgccacctacagcggcctgtggagaaagtgctacttcctgggcatcgacagagacatcgacaccctgatcctgaagggcatcgcccagagatgcaccgccatcaagtaccacttcagccagcccatcagactgagaaacatccccttcaacctgaccaagaccatccagcaggacgagtggcacctgctgcacctgagaagaatcaccgccggcttcctgggcatggccgtggccgtgctgctgtgcggctgcatcgtggccaccgtgagcttcttctgggaggagagcctgacccagcacgtggccggcctgctgttcctgatgaccggcatcttctgcaccatcagcctgtgcacctacgccgccagcatcagctacgacctgaacagactgcccaagctgatctacagcctgcccgccgacgtggagcacggctacagctggagcatcttctgcgcctggtgcagcctgggcttcatcgtggccgccggcggcctgtgcatcgcctaccccttcatcagcagaaccaagatcgcccagctgaagagcggcagagacagcaccgtgtag

SEQ ID NO: 23335 - DNA, 336 bp, Artificial Sequence
  Description of Artificial Sequence: Synthetic coding sequence
atggagcccagagccctggtgaccgccctgagcctgggcctgagcctgtgcagcctgggcctgctggtgaccgccatcttcaccgaccactggtacgagaccgaccccagaagacacaaggagagctgcgagagaagcagagccggcgccgacccccccgaccagaagaacagactgatgcccctgagccacctgctgggccccctggaggaggtgctgctgcccggccacagacccggccacagacacccccaccccgagagatactgcgccgccatgcacggccaccaggtgcccctgttcagcgcccaccccctggccaagcacagcttctag

SEQ ID NO: 23336 - DNA, 594 bp, Artificial Sequence
  Description of Artificial Sequence: Synthetic coding sequence
atggccctgaacaacttcctgttcgcccagtgcgcctgctacttcctggccttcctgttcagcttcgtggtggtggtgcccctgagcgagaacggccacgacttcagaggcagatgcctgctgttcaccgagggcatgtggctgagcgccaacctgaccgtgcaggagagagagagattcaccgtgcaggagtggggcccccccgccgcctgcagattcagcctgctggccagcctgctgagcctgctgctggccgccgcccacgcctggagaaccctgttcttcctgtgcaagggccacgagggcagcttcttcagcgccttcctgaacctgctggtgagcgccttcgtggtgttcctggtgttcatcgccagcaccatcgtgagcgtgggcttcaccatgtggtgcgacaccatcaccgagaagggcaccgtgccccacagctgcgaggagctgcaggacatcgacctggagctgggcgtggacaacagcgccttctacgaccagttcgccatcgcccaggtgggcggcagcggccaggagggcagactggccatgctgggcggcggccacctgctgctggacatctgctag

SEQ ID NO: 23337 - DNA, 702 bp, Artificial Sequence
  Description of Artificial Sequence: Synthetic coding sequence
atggccctgaacaacttcctgttcgcccagtgcgcctgctacttcctggccttcctgttcagcttcgtggtggtggtgcccctgagcgagaacggccacgacttcagaggcagatgcctgctgttcaccgagggcatgtggctgagcgccaacctgaccgtgcaggagagagagagattcaccgtgcaggagtggggcccccccgccgcctgcagattcagcctgctggccagcctgctgagcctgctgctggccgccgcccacgcctggagaaccctgttcttcctgtgcaagggccacgagggcagcttcttcagcgccttcctgaacctgctggtgagcgccttcgtggtgttcctggtgttcatcgccagcaccatcgtgagcgtgggcttcaccatgtggtgcgacaccatcaccgagaagggcaccgtgccccacagctgcgaggagctgcaggacatcgacctggagctgggcgtggacaacagcgccttctacgaccagttcgccatcgcccagttcggcctgtgggccagctggctggcctggctggccatcaccaccctggccttcctgaaggtgtaccacaactacagacaggaggacctgctggacagcctgatccacgagaaggagctgctgctggccagacccagccccagaaccagcttccaggaggagaagagcgccgtgatctag

SEQ ID NO: 23338 - DNA, 660 bp, Artificial Sequence
  Description of Artificial Sequence: Synthetic coding sequence
atggccctgagctggctgcagagagtggagctggccctgttcgccgccgccttcctgtgcggcgccgtggccgccgccgccatgaccagaacccagggcagcttcagcggcagatgccccctgtacggcgtggccaccctgaacggcagcagcctggccctgagcagacccagcgcccccagcctgtgctacttcgtggccggcgccagcggcctgctggccctgtactgcctgctgctgctgctgttctggatctacagcagctgcatcgaggacagccacagaggcgccatcggcctgagaatcgccctggccatcagcgccatcgccgtgttcctggtgctggtgagcgcctgcatcctgagattcggcaccagaagcctgtgcaacagcatcatcagcctgaacaccaccatcagctgcagcgaggcccagaagatcccctggaccccccccggcaccgccctgcagttctacagcaacctgcacaacgccgagaccagcagctgggtgaacctggtgctgtggtgcgtggtgctggtgctgcaggtggtgcagtggaagagcgaggccaccccctacagacccctggagagaggcgaccccgagtggagcagcgagaccgacgccctggtgggcagcagactgagccacagctag

SEQ ID NO: 23339 - DNA, 1554 bp, Artificial Sequence
  Description of Artificial Sequence: Synthetic coding sequence
atgggcctgggccagccccaggcctggctgctgggcctgcccaccgccgtggtgtacggcagcctggccctgttcaccaccatcctgcacaacgtgttcctgctgtactacgtggacaccttcgtgagcgtgtacaagatcaacaagatggccttctgggtgggcgagaccgtgttcctgctgtggaacagcctgaacgaccccctgttcggctggctgagcgacagacagttcctgagcagccagcccagaagcggcgccggcctgagcagcagagccgtggtgctggccagagtgcaggccctgggctggcacggccccctgctggccctgagcttcctggccttctgggtgccctgggcccccgccggcctgcagttcctgctgtgcctgtgcctgtacgacggcttcctgaccctggtggacctgcaccaccacgccctgctggccgacctggccctgagcgcccacgacagaacccacctgaacttctactgcagcctgttcagcgccgccggcagcctgagcgtgttcgccagctacgccttctggaacaaggaggacttcagcagcttcagagccttctgcgtgaccctggccgtgagcagcggcctgggcttcctgggcgccacccagctgctgagaagaagagtggaggccgccagaaaggaccccggctgcagcggcctggtggtggacagcggcctgtgcggcgaggagctgctggtgggcagcgaggaggccgacagcatcaccctgggcagatacctgagacagctggccagacacagaaacttcctgtggttcgtgagcatggacctggtgcaggtgttccactgccacttcaacagcaacttcttccccctgttcctggagcacctgctgagcgaccacatcagcctgagcaccggcagcatcctgctgggcctgagctacgtggccccccacctgaacaacctgtacttcctgagcctgtgcagaagatggggcgtgtacgccgtggtgagaggcctgttcctgctgaagctgggcctgagcctgctgatgctgctggccggccccgaccacctgagcctgctgtgcctgttcatcgccagcaacagagtgttcaccgagggcacctgcaagctgctgaccctggtggtgaccgacctggtggacgaggacctggtgctgaaccacagaaagcaggccgccagcgccctgctgttcggcatggtggccctggtgaccaagcccggccagaccttcgcccccctgctgggcacctggctgctgtgcttctacaccggccacgacctgttccagcagagcctgatcacccccgtgggcagcgcccacccctggcccgagccccccgcccccgcccccgcccaggcccccaccctgagacagggctgcttctacctgctggtgctggtgcccatcacctgcgccctgctgcagctgttcacctggagccagttcaccctgcacggcagaagactgcacatggtgaaggcccagagacagaacctgagccaggcccagaccctggacgtgaagatggtgtag

SEQ ID NO: 23340 - DNA, 741 bp, Artificial Sequence
  Description of Artificial Sequence: Synthetic coding sequence
atggacctggtgcaggtgttccactgccacttcaacagcaacttcttccccctgttcctggagcacctgctgagcgaccacatcagcctgagcaccggcagcatcctgctgggcctgagctacgtggccccccacctgaacaacctgtacttcctgagcctgtgcagaagatggggcgtgtacgccgtggtgagaggcctgttcctgctgaagctgggcctgagcctgctgatgctgctggccggccccgaccacctgagcctgctgtgcctgttcatcgccagcaacagagtgttcaccgagggcacctgcaagctgctgaccctggtggtgaccgacctggtggacgaggacctggtgctgaaccacagaaagcaggccgccagcgccctgctgttcggcatggtggccctggtgaccaagcccggccagaccttcgcccccctgctgggcacctggctgctgtgcttctacaccggccacgacctgttccagcagagcctgatcacccccgtgggcagcgcccacccctggcccgagccccccgcccccgcccccgcccaggcccccaccctgagacagggctgcttctacctgctggtgctggtgcccatcacctgcgccctgctgcagctgttcacctggagccagttcaccctgcacggcagaagactgcacatggtgaaggcccagagacagaacctgagccaggcccagaccctggacgtgaagatggtgtag

SEQ ID NO: 23341 - DNA, 741 bp, Artificial Sequence; identical to SEQ ID NO: 23340
  Description of Artificial Sequence: Synthetic coding sequence

SEQ ID NO: 23342 - DNA, 462 bp, Artificial Sequence
  Description of Artificial Sequence: Synthetic coding sequence
atgggcctgggccagccccaggcctggctgctgggcctgcccaccgccgtggtgtacggcagcctggccctgttcaccaccatcctgcacaacgtgttcctgctgtactacgtggacaccttcgtgagcgtgtacaagatcaacaagatggccttctgggtgggcgagaccgtgttcctgctgtggaacagcctgaacgaccccctgttcggctggctgagcgacagacagttcctgagcagccagcccagactgtgcggcgaggagctgctggtgggcagcgaggaggccgacagcatcaccctgggcagatacctgagacagctggccagacacagaaacttcctgtggttcgtgagcatggacctggtgcaggtgcagtggctgacccccgtgatccccgccctgagagacgccaaggtggagagacccctggagcccagaagcagcagactgcagtag

SEQ ID NO: 23343 - DNA, 948 bp, Artificial Sequence
  Description of Artificial Sequence: Synthetic coding sequence
atgggcctgggccagccccaggcctggctgctgggcctgcccaccgccgtggtgtacggcagcctggccctgttcaccaccatcctgcacaacgtgttcctgctgtactacgtggacaccttcgtgagcgtgtacaagatcaacaagatggccttctgggtgggcgagaccgtgttcctgctgtggaacagcctgaacgaccccctgttcggctggctgagcgacagacagttcctgagcagccagcccagactgtgcggcgaggagctgctggtgggcagcgaggaggccgacagcatcaccctgggcagatacctgagacagctggccagacacagaaacttcctgtggttcgtgagcatggacctggtgcaggtgttccactgccacttcaacagcaacttcttccccctgttcctggagcacctgctgagcgaccacatcagcctgagcaccggcagcatcctgctgggcctgagctacgtggccccccacctgaacaacctgtacttcctgagcctgtgcagaagatggggcgtgtacgccgtggtgagaggcctgttcctgctgaagctgggcctgagcctgctgatgctgctggccggccccgaccacctgagcctgctgtgcctgttcatcgccagcaacagagtgttcaccgagggcacctgcaagctgctgaccctggtggtgaccgacctggtggacgaggacctggtgctgaaccacagaaagcaggccgccagcgccctgctgttcggcatggtggccctggtgaccaagcccggccagaccttcgcccccctgctgggcacctggctgctgtgcttctacaccggctgggacctgggctacgccctggcccacagcctgctgaaccaggccggccccagaagcagaatggcccaggaccagcccagaggcggcctgcccaccagcaccacctag

SEQ ID NO: 23344 - DNA, 402 bp, Artificial Sequence
  Description of Artificial Sequence: Synthetic coding sequence
atgagaggcgagcacaacagcaccagctacgacagcgccgtgatctacagaggcttctgggccgtgctgatgctgctgggcgtggtggccgtggtgatcgccagcttcctgatcatctgcgccgcccccttcgccagccacttcctgtacaaggccggcggcggcagctacatcgccgccggcatcctgttcagcctggtggtgatgctgtacgtgatctgggtgcaggccgtggccgacatggagagctacagaaacatgaagatgaaggactgcctggacttcacccccagcgtgctgtacggctggagcttcttcctggcccccgccggcatcttcttcagcctgctggccggcctgctgttcctggtggtgggctggcacatccagatccaccactag

SEQ ID NO: 23345 - DNA, 690 bp, Artificial Sequence
  Description of Artificial Sequence: Synthetic coding sequence
atgagactgaacatcgccatcttcttcggcgccctgttcggcgccctgggcgtgctgctgttcctggtggccttcggcagcgactactggctgctggccaccgaggtgggcagatgcagcggcgagaagaacatcgagaacgtgaccttccaccacgagggcttcttctggagatgctggttcaacggcatcgtggaggagaacgacagcaacatctggaagttctggtacaccaaccagccccccagcaagaactgcacccacgcctacctgagcccctaccccttcatgagaggcgagcacaacagcaccagctacgacagcgccgtgatctacagaggcttctgggccgtgctgatgctgctgggcgtggtggccgtggtgatcgccagcttcctgatcatctgcgccgcccccttcgccagccacttcctgtacaaggccggcggcggcagctacatcgccgccggcatcctgttcagcctggtggtgatgctgtacgtgatctgggtgcaggccgtggccgacatggagagctacagaaacatgaagatgaaggactgcctggacttcacccccagcgtgctgtacggctggagcttcttcctggcccccgccggcatcttcttcagcctgctggccggcctgctgttcctggtggtgggctggcacatccagatccaccactag

SEQ ID NO: 23346 - DNA, 1131 bp, Artificial Sequence
  Description of Artificial Sequence: Synthetic coding sequence
atggccagaggccccggccccctgggcagacccagacccgacaccgtggccatgcccaagagaggcaagagactgaagttcagagcccacgacgcctgcagcggcagagtgaccgtggccgactacgccaacagcgaccccgccgtggtgagaagcggcagagtgaagaaggccgtggccaacgccgtgcagcaggaggtgaagagcctgtgcggcctggaggccagccaggtgcccgccgaggaggccctgagcggcgccggcgagccctgcgacatcatcgacagcagcgacgagatggacgcccaggaggagagcatccacgagagaaccgtgagcagaaagaagaagagcaagagacacaaggaggagctggacggcgccggcggcgaggagtaccccatggacatctggctgctgctggccagctacatcagacccgaggacatcgtgaacttcagcctgatctgcaagaacgcctggaccgtgacctgcaccgccgccttctggaccagactgtacagaagacactacaccctggacgccagcctgcccctgagactgagacccgagagcatggagaagctgagatgcctgagagcctgcgtgatcagaagcctgtaccacatgtacgagcccttcgccgccagaatcagcaagaaccccgccatccccgagagcacccccagcaccctgaagaacagcaagtgcctgctgttctggtgcagaaagatcgtgggcaacagacaggagcccatgtgggagttcaacttcaagttcaagaagcagagccccagactgaagagcaagtgcaccggcggcctgcagccccccgtgcagtacgaggacgtgcacaccaaccccgaccaggactgctgcctgctgcaggtgaccaccctgaacttcatcttcatccccatcgtgatgggcatgatcttcaccctgttcaccatcaacgtgagcaccgacatgagacaccacagagtgagactggtgttccaggacagccccgtgcacggcggcagaaagctgagaagcgagcagggcgtgcaggtgatcctggaccccgtgcacagcgtgagactgttcgactggtggcacccccagtaccccttcagcctgagagcctag

SEQ ID NO: 23347 - DNA, 1242 bp, Artificial Sequence
  Description of Artificial Sequence: Synthetic coding sequence
atgagcaacgtgagcggcatcctggagaccgccggcgtgcccctggtgagcgccaactggccccagcccagccccccccccgccgtgcccgccggcccccagatggaccacatgggcaacagcagccagggcgccccctggctgttcctgaccagcgccctggccagaggcgtgagcggcatcttcgtgtggaccgccctggtgctgacctgccaccagatctacctgcacctgagaagctacaccgtgccccaggagcagagatacatcatcagactgctgctgatcgtgcccatctacgccttcgacagctggctgagcctgctgctgctgggcgaccaccagtactacgtgtacttcgacagcgtgagagactgctacgaggccttcgtgatctacagcttcctgagcctgtgcttccagtacctgggcggcgagggcgccatcatggccgagatcagaggcaagcccatcaagagcagctgcctgtacggcacctgctgcctgagaggcatgacctacagcatcggcttcctgagattctgcaagcaggccaccctgcagttctgcctggtgaagcccgtgatggccgtgaccaccatcatcctgcaggccttcggcaagtaccacgacggcgacttcaacgtgagaagcggctacctgtacgtgaccctgatctacaacgccagcgtgagcctggccctgtacgccctgttcctgttctacttcaccaccagagagctgctgagacccttccagcccgtgctgaagttcctgaccatcaaggccgtgatcttcctgagcttctggcagggcctgctgctggccatcctggagagatgcggcgtgatccccgaggtggagaccagcggcggcaacaagctgggcgccggcaccctggccgccggctaccagaacttcatcatctgcgtggagatgctgttcgccagcgtggccctgagatacgccttcccctgccaggtgtacgccgagaagaaggagaacagccccgccccccccgcccccatgcagagcatcagcagcggcatcagagagaccgtgagcccccaggacatcgtgcaggacgccatccacaacttcagccccgcctaccagcactacacccagcaggccacccacgaggcccccagacccggcacccaccccagcggcggcagcggcggcagcagaaagagcagaagcctggagaagagaatgctgatccccagcgaggacctgtag

SEQ ID NO: 23348 - DNA, 528 bp, Artificial Sequence
  Description of Artificial Sequence: Synthetic coding sequence
atgagcaacgtgagcggcatcctggagaccgccggcgtgcccctggtgagcgccaactggccccagcccagccccccccccgccgtgcccgccggcccccagatggaccacatgggcaacagcagccagggcgccccctggctgttcctgaccagcgccctggccagaggcgtgagcggcatcttcgtgtggaccgccctggtgctgacctgccaccagatctacctgcacctgagaagctacaccgtgccccaggagcagagatacatcatcagactgctgctgatcgtgcccatctacgccttcgacagctggctgagcctgctgctgctgggcgaccaccagtactacgtgtacttcgacagcgtgagagactgctacgaggccttcgtgatctacagcttcctgagcctgtgcttccagtacctgggcggcgagggcgccatcatggccgagatcagaggcaagcccatcaagagcagctgcctgtacggcacctgctgcctgagaggcatgacctacagctag

SEQ ID NO: 23349 - DNA, 420 bp, Artificial Sequence
  Description of Artificial Sequence: Synthetic coding sequence
atgagcaacgtgagcggcatcctggagaccgccggcgtgcccctggtgagcgccaactggccccagcccagccccccccccgccgtgcccgccggcccccagatggaccacatgggcaacagcagccagggcgccccctggctgttcctgaccagcgccctggccagaggcgtgagcggcatcttcgtgtggaccgccctggtgctgacctgccaccagatctacctgcacctgagaagctacaccgtgccccaggagcagagatacatcatcagactgctgctgatcgtgcccatctacgccttcgacagctggctgagcctgctgctgctgggcgaccaccagtactacgtgtacttcgacagcgtgagagactgctacgaggccttcgtgatctacagcttcctgagcctgtgctag

SEQ ID NO: 23350 - DNA, 477 bp, Artificial Sequence
  Description of Artificial Sequence: Synthetic coding sequence
atgagcaacgtgagcggcatcctggagaccgccggcgtgcccctggtgagcgccaactggccccagcccagccccccccccgccgtgcccgccggcccccagatggaccacatgggcaacagcagccagggcgccccctggctgttcctgaccagcgccctggccagaggcgtgagcggcatcttcgtgtggaccgccctggtgctgacctgccaccagatctacctgcacctgagaagctacaccgtgccccaggagcagagatacatcatcagactgctgctgatcgtgcccatctacgccttcgacagctggctgagcctgctgctgctgggcgaccaccagtactacgtgtacttcgacagcgtgagagactgctacgaggccttcgtgatctacagcttcctgagcctgtgcttccagtacctgggcggcgagggcgccatcatggccgagatcagaggcaagcccatctag

SEQ ID NO: 23351 - DNA, 1224 bp, Artificial Sequence
  Description of Artificial Sequence: Synthetic coding sequence
atgaccgtgagaggcgacgtgctggcccccgaccccgccagccccaccaccgccgccgccagccccagcgtgagcgtgatccccgagggcagccccaccgccatggagcagcccgtgttcctgatgaccaccgccgcccaggccatcagcggcttcttcgtgtggaccgccctgctgatcacctgccaccagatctacatgcacctgagatgctacagctgccccaacgagcagagatacatcgtgagaatcctgttcatcgtgcccatctacgccttcgacagctggctgagcctgctgttcttcaccaacgaccagtactacgtgtacttcggcaccgtgagagactgctacgaggccctggtgatctacaacttcctgagcctgtgctacgagtacctgggcggcgagagcagcatcatgagcgagatcagaggcaagcccatcgagagcagctgcatgtacggcacctgctgcctgtggggcaagacctacagcatcggcttcctgagattctgcaagcaggccaccctgcagttctgcgtggtgaagcccctgatggccgtgagcaccgtggtgctgcaggccttcggcaagtacagagacggcgacttcgacgtgaccagcggctacctgtacgtgaccatcatctacaacatcagcgtgagcctggccctgtacgccctgttcctgttctacttcgccaccagagagctgctgagcccctacagccccgtgctgaagttcttcatggtgaagagcgtgatcttcctgagcttctggcagggcatgctgctggccatcctggagaagtgcggcgccatccccaagatccacagcgccagagtgagcgtgggcgagggcaccgtggccgccggctaccaggacttcatcatctgcgtggagatgttcttcgccgccctggccctgagacacgccttcacctacaaggtgtacgccgacaagagactggacgcccagggcagatgcgcccccatgaagagcatcagcagcagcctgaaggagaccatgaacccccacgacatcgtgcaggacgccatccacaacttcagccccgcctaccagcagtacacccagcagagcaccctggagcccggccccacctggagaggcggcgcccacggcctgagcagaagccacagcctgagcggcgccagagacaacgagaagaccctgctgctgagcagcgacgacgagttctag

SEQ ID NO: 23352 - DNA, 1224 bp, Artificial Sequence; identical to SEQ ID NO: 23351
  Description of Artificial Sequence: Synthetic coding sequence

SEQ ID NO: 23353 - DNA, 420 bp, Artificial Sequence
  Description of Artificial Sequence: Synthetic coding sequence
atgcacctgagatgctacagctgccccaacgagcagagatacatcgtgagaatcctgttcatcgtgcccatctacgccttcgacagctggctgagcctgctgttcttcaccaacgaccagtactacgtgtacttcggcaccgtgagagactgctacgaggccctggtgatctacaacttcctgagcctgtgctacgagtacctgggcggcgagagcagcatcatgagcgagatcagaggcaagcccatcgagagcagctgcatgtacggcacctgctgcctgtggggcaagacctacagcatcggcttcctgagattctgcaagcaggccaccctgcagttctgcgtggtgaagcccctgatggccgtgagcaccgtggtgctgcaggccttcggcaagtacagagacggcgacttctag

SEQ ID NO: 23354 - DNA, 219 bp, Artificial Sequence
  Description of Artificial Sequence: Synthetic coding sequence
atgaccgtgagaggcgacgtgctggcccccgaccccgccagccccaccaccgccgccgccagccccagcgtgagcgtgatccccgagggcagccccaccgccatggagcagcccgtgttcctgatgaccaccgccgcccaggccatcagcggcttcttcgtgtggaccgccctgctgatcacctgccaccagcccagagccagactgggccaggtgtag

SEQ ID NO: 23355 - DNA, 1053 bp, Artificial Sequence
  Description of Artificial Sequence: Synthetic coding sequence
atgaaccccagaggcctgttccaggacttcaaccccagcaagttcctgatctacacctgcctgctgctgttcagcgtgctgctgcccctgagactggacggcatcatccagtggagctactgggccgtgttcgcccccatctggctgtggaagctgctggtggtggccggcgccagcgtgggcgccggcgtgtgggccagaaaccccagatacagaaccgagggcgaggcctgcgtggagttcaaggccatgctgatcgccgtgggcatccacctgctgctgctgatgttcgaggtgctggtgtgcgacagagtggagagaggcacccacttctggctgctggtgttcatgcccctgttcttcgtgagccccgtgagcgtggccgcctgcgtgtggggcttcagacacgacagaagcctggagctggagatcctgtgcagcgtgaacatcctgcagttcatcttcatcgccctgaagctggacagaatcatccactggccctggctggtggtgttcgtgcccctgtggatcctgatgagcttcctgtgcctggtggtgctgtactacatcgtgtggagcctgctgttcctgagaagcctggacgtggtggccgagcagagaagaacccacgtgaccatggccatcagctggatcaccatcgtggtgcccctgctgaccttcgaggtgctgctggtgcacagactggacggccacaacaccttcagctacgtgagcatcttcgtgcccctgtggctgagcctgctgaccctgatggccaccaccttcagaagaaagggcggcaaccactggtggttcggcatcagaagagacttctgccagttcctgctggagatcttccccttcctgagagagtacggcaacatcagctacgacctgcaccacgaggacagcgaggacgccgaggagaccagcgtgcccgaggcccccaagatcgcccccatcttcggcaagaaggccagagtggtgatcacccagagccccggcaagtacgtgccccccccccccaagctgaacatcgacatgcccgactag

SEQ ID NO: 23356 - DNA, 642 bp, Artificial Sequence
  Description of Artificial Sequence: Synthetic coding sequence
atggccgccctgctgagagccgtgagaagattcagaggcaaggccgtgtgggagagacccctgcacggcctgtggtgctgcagcggccaggaggaccccaagagatgggtgggcagcagcagccccatcagcaaggagaagctgcccaacgccgagaccgagaagttctggatgttctacagattcgacgccatcagaaccttcggcttcctgagcagactgaagctggcccagaccgccctgaccgtggtggccctgccccccggctactacctgtacagccagggcctgctgaccctgaacaccgtgtgcctgatgagcggcatcagcggcttcgccctgaccatgctgtgctggatgagctacttcctgagaagactggtgggcatcctgtacctgaacgagagcggcaccatgctgagagtggcccacctgaacttctggggctggagacaggacacctactgccccatggccgacgtgatccccctgaccgagaccaaggacagaccccaggagatgttcgtgagaatccagagatacagcggcaagcagaccttctacgtgaccctgagatacggcagaatcctggacagagagagattcacccaggtgttcggcgtgcaccagatgctgaagtag

SEQ ID NO: 23357 - DNA, 786 bp, Artificial Sequence
  Description of Artificial Sequence: Synthetic coding sequence
atgaaccccgagtggggccaggccttcgtgcacgtggccgtggccggcggcctgtgcgccgtggccgtgttcaccggcatcttcgacagcgtgagcgtgcaggtgggctacgagcactacgccgaggcccccgtggccggcctgcccgccttcctggccatgcccttcaacagcctggtgaacatggcctacaccctgctgggcctgagctggctgcacagaggcggcgccatgggcctgggccccagatacctgaaggacgtgttcgccgccatggccctgctgtacggccccgtgcagtggctgagactgtggacccagtggagaagagccgccgtgctggaccagtggctgaccctgcccatcttcgcctggcccgtggcctggtgcctgtacctggacagaggctggagaccctggctgttcctgagcctggagtgcgtgagcctggccagctacggcctggccctgctgcacccccagggcttcgaggtggccctgggcgcccacgtggtggccgccgtgggccaggccctgagaacccacagacactacggcagcaccaccagcgccacctacctggccctgggcgtgctgagctgcctgggcttcgtggtgctgaagctgtgcgaccaccagctggccagatggagactgttccagtgcctgaccggccacttctggagcaaggtgtgcgacgtgctgcagttccacttcgccttcctgttcctgacccacttcaacacccaccccagattccaccccagcggcggcaagaccagatag

SEQ ID NO: 23358 - DNA, 201 bp, Artificial Sequence
  Description of Artificial Sequence: Synthetic coding sequence
atgaaccccgagtggggccaggccttcgtgcacgtggccgtggccggcggcctgtgcgccgtggccgtgttcaccggcatcttcgacagcgtgagcgtgcaggtgggctacgagcactacgccgaggcccccgtggccggcctgcccgccttcctggccatgcccttcaacagcctggtgaacatggcctacaccctgtag

SEQ ID NO: 23359 - DNA, 102 bp, Artificial Sequence
  Description of Artificial Sequence: Synthetic coding sequence
atgaaccccgagtggggccaggccttcgtgcacgtggccgtggccggcggcctgtgcgccgtggccgtgttcaccggcatcttcgacagcgtgagcgtgtag

SEQ ID NO: 23360 - DNA, 144 bp, Artificial Sequence
  Description of Artificial Sequence: Synthetic coding sequence
atgaacagcctggagcaggccgaggacctgaaggccttcgagagaagactgaccgagtacatccactgcctgcagcccgccaccggcagatggagaagcgtgctgctgcacatcatcatggagagccccatcttccaccactag

SEQ ID NO: 23361 - DNA, 378 bp, Artificial Sequence
  Description of Artificial Sequence: Synthetic coding sequence
atgaacagcctggagcaggccgaggacctgaaggccttcgagagaagactgaccgagtacatccactgcctgcagcccgccaccggcagatggagaatgctgctgatcgtggtgagcgtgtgcaccgccaccggcgcctggaactggctgatcgaccccgagacccagaaggtgagcttcttcaccagcctgtggaaccaccccttcttcaccatcagctgcatcaccctgatcggcctgttcttcgccggcatccacaagagagtggtggcccccagcatcatcgccgccagatgcagaaccgtgctggccgagtacaacatgagctgcgacgacaccggcaagctgatcctgaagcccagaccccacgtgcagtag

SEQ ID NO: 23362 - DNA, 429 bp, Artificial Sequence
  Description of Artificial Sequence: Synthetic coding sequence
atgaacagcctggagcaggccgaggcccccagagtggtgagcctgatccccgccgtggtgagcggcaactgccaggacctgaaggccttcgagagaagactgaccgagtacatccactgcctgcagcccgccaccggcagatggagaatgctgctgatcgtggtgagcgtgtgcaccgccaccggcgcctggaactggctgatcgaccccgagacccagaaggtgagcttcttcaccagcctgtggaaccaccccttcttcaccatcagctgcatcaccctgatcggcctgttcttcgccggcatccacaagagagtggtggcccccagcatcatcgccgccagatgcagaaccgtgctggccgagtacaacatgagctgcgacgacaccggcaagctgatcctgaagcccagaccccacgtgcagtag

SEQ ID NO: 23363 - DNA, 804 bp, Artificial Sequence
  Description of Artificial Sequence: Synthetic coding sequence
atggccggcgccgagaactggcccggccagcagctggagctggacgaggacgaggccagctgctgcagatggggcgcccagcacgccggcgccagagagctggccgccctgtacagccccggcaagagactgcaggagtggtgcagcgtgatcctgtgcttcagcctgatcgcccacaacctggtgcacctgctgctgctggccagatgggaggacacccccctggtgatcctgggcgtggtggccggcgccctgatcgccgacttcctgagcggcctggtgcactggggcgccgacacctggggcagcgtggagctgcccatcgccttcatcagacccttcagagagcaccacatcgaccccaccgccatcaccagacacgacttcatcgagaccaacggcgacaactgcctggtgaccctgctgcccctgctgaacatggcctacaagttcagaacccacagccccgaggccctggagcagctgtacccctgggagtgcttcgtgttctgcctgatcatcttcggcaccttcaccaaccagatccacaagtggagccacacctacttcggcctgcccagatgggtgaccctgctgcaggactggcacgtgatcctgcccagaaagcaccacagaatccaccacgtgagcccccacgagacctacttctgcatcaccaccggctggctgaactaccccctggagaagatcggcttctggagaagactggaggacctgatccagggcctgaccggcgagaagcccagagccgacgacatgaagtgggcccagaagatcaagtag

SEQ ID NO: 23364 - DNA, 813 bp, Artificial Sequence
  Description of Artificial Sequence: Synthetic coding sequence
atggccggcgccgagaactggcccggccagcagctggagctggacgaggacgaggccagctgctgcagatggggcgcccagcacgccggcgccagagagctggccgccctgtacagccccggcaagagactgcaggagtggtgcagcgtgatcctgtgcttcagcctgatcgcccacaacctggtgcacctgctgctgctggccagatgggaggacacccccctggtgatcctgggcgtggtggccggcgccctgatcgccgacttcctgagcggcctggtgcactggggcgccgacacctggggcagcgtggagctgcccatcgtgggcaaggccttcatcagacccttcagagagcaccacatcgaccccaccgccatcaccagacacgacttcatcgagaccaacggcgacaactgcctggtgaccctgctgcccctgctgaacatggcctacaagttcagaacccacagccccgaggccctggagcagctgtacccctgggagtgcttcgtgttctgcctgatcatcttcggcaccttcaccaaccagatccacaagtggagccacacctacttcggcctgcccagatgggtgaccctgctgcaggactggcacgtgatcctgcccagaaagcaccacagaatccaccacgtgagcccccacgagacctacttctgcatcaccaccggctggctgaactaccccctggagaagatcggcttctggagaagactggaggacctgatccagggcctgaccggcgagaagcccagagccgacgacatgaagtgggcccagaagatcaagtag

SEQ ID NO: 23365 - DNA, 588 bp, Artificial Sequence
  Description of Artificial Sequence: Synthetic coding sequence
atgaacgagagagccatcgccggcgccctgatcgccgacttcctgagcggcctggtgcactggggcgccgacacctggggcagcgtggagctgcccatcgtgggcaaggccttcatcagacccttcagagagcaccacatcgaccccaccgccatcaccagacacgacttcatcgagaccaacggcgacaactgcctggtgaccctgctgcccctgctgaacatggcctacaagttcagaacccacagccccgaggccctggagcagctgtacccctgggagtgcttcgtgttctgcctgatcatcttcggcaccttcaccaaccagatccacaagtggagccacacctacttcggcctgcccagatgggtgaccctgctgcaggactggcacgtgatcctgcccagaaagcaccacagaatccaccacgtgagcccccacgagacctacttctgcatcaccaccggctggctgaactaccccctggagaagatcggcttctggagaagactggaggacctgatccagggcctgaccggcgagaagcccagagccgacgacatgaagtgggcccagaagatcaagtag

SEQ ID NO: 23366 - DNA, 1113 bp, Artificial Sequence
  Description of Artificial Sequence: Synthetic coding sequence
atggccggcgccgagaactggcccggccagcagctggagctggacgaggacgaggccagctgctgcagatggggcgcccagcacgccggcgccagagagctggccgccctgtacagccccggcaagagactgcaggagtggtgcagcgtgatcctgtgcttcagcctgatcgcccacaacctggtgcacctgctgctgctggccagatgggaggacacccccctggtgatcctgggcgtggtggccggcgccctgatcgccgacttcctgagcggcctggtgcactggggcgccgacacctggggcagcgtggagctgcccatcgtgggcaaggccttcatcagacccttcagagagcaccacatcgaccccaccgccatcaccagacacgacttcatcgagaccaacggcgacaactgcctggtgaccctgctgcccctgctgaacatggcctacaagttcagaacccacagccccgaggccctggagcagctgtacccctgggagtgcttcgtgttctgcctgatcatcttcggcaccttcaccaaccagatccacaagtggagccacacctacttcggcctgcccagatgggtgaccctgctgcaggactggcacgtgatcctgcccagaaagcaccacagaatccaccacgtgagcccccacgagacctacttctgcatcaccaccggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagaaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 23367 - DNA, 1011 bp, Artificial Sequence
  Description of Artificial Sequence: Synthetic coding sequence
atgaccgacctgaacgacaacatctgcaagagatacatcaagatgatcaccaacatcgtgatcctgagcctgatcatctgcatcagcctggccttctggatcatcagcatgaccgccagcacctactacggcaacctgagacccatcagcccctggagatggctgttcagcgtggtggtgcccgtgctgatcgtgagcaacggcctgaagaagaagagcctggaccacagcggcgccctgggcggcctggtggtgggcttcatcctgaccatcgccaacttcagcttcttcaccagcctgctgatgttcttcctgagcagcagcaagctgaccaagtggaagggcgaggtgaagaagagactggacagcgagtacaaggagggcggccagagaaactgggtgcaggtgttctgcaacggcgccgtgcccaccgagctggccctgctgtacatgatcgagaacggccccggcgagatccccgtggacttcagcaagcagtacagcgccagctggatgtgcctgagcctgctggccgccctggcctgcagcgccggcgacacctgggccagcgaggtgggccccgtgctgagcaagagcagccccagactgatcaccacctgggagaaggtgcccgtgggcaccaacggcggcgtgaccgtggtgggcctggtgagcagcctgctgggcggcaccttcgtgggcatcgcctacttcctgacccagctgatcttcgtgaacgacctggacatcagcgccccccagtggcccatcatcgccttcggcggcctggccggcctgctgggcagcatcgtggacagctacctgggcgccaccatgcagtacaccggcctggacgagagcaccggcatggtggtgaacagccccaccaacaaggccagacacatcgccggcaagcccatcctggacaacaacgccgtgaacctgttcagcagcgtgctgatcgccctgctgctgcccaccgccgcctggggcttctggcccagaggctag

SEQ ID NO: 23368 - DNA, 1011 bp, Artificial Sequence; identical to SEQ ID NO: 23367
  Description of Artificial Sequence: Synthetic coding sequence

SEQ ID NO: 23369 - DNA, 897 bp, Artificial Sequence
  Description of Artificial Sequence: Synthetic coding sequence
atgaccgacctgaacgacaacatctgcaagagatacatcaagatgatcaccaacatcgtgatcctgagcctgatcatctgcatcagcctggccttctggatcatcagcatgaccgccagcacctactacggcaacctgagacccatcagcccctggagatggctgttcagcgtggtggtgcccgtgctgatcgtgagcaacggcctgaagaagaagagcctggaccacagcggcgccctgggcggcctggtggtgggcttcatcctgaccatcgccaacttcagcttcttcaccagcctgctgatgttcttcctgagcagcagcaagctgaccaagtggaagggcgaggtgaagaagagactggacagcgagtacaaggagggcggccagagaaactgggtgcaggtgttctgcaacggcgccgtgcccaccgagctggccctgctgtacatgatcgagaacggccccggcgagatccccgtggacttcagcaagcagtacagcgccagctggatgtgcctgagcctgctggccgccctggcctgcagcgccggcgacacctgggccagcgaggtgggccccgtgctgagcaagagcagccccagactgatcaccacctgggagaaggtgcccgtgggcaccaacggcggcgtgaccgtggtgggcctggtgagcagcctgctgggcggcaccttcgtgggcatcgcctacttcctgacccagctgatcttcgtgaacgacctggacatcagcgccccccagtggcccatcatcgccttcggcggcctggccggcctgctgggcagcatcgtggacagctacctgggcgccaccatgcagtacaccggcaagaacatccccagcttcctgcagctgatcggcatgctgaagaagtag

SEQ ID NO: 23370 - DNA, 513 bp, Artificial Sequence
  Description of Artificial Sequence: Synthetic coding sequence
atgaccgacctgaacgacaacatctgcaagagatacatcaagatgatcaccaacatcgtgatcctgagcctgatcatctgcatcagcctggccttctggatcatcagcatgaccgccagcacctactacggcaacctgagacccatcagcccctggagatggctgttcagcgtggtggtgcccgtgctgatcgtgagcaacggcctgaagaagaagagcctggaccacagcggcgccctgggcggcctggtggtgggcttcatcctgaccatcgccaacttcagcttcttcaccagcctgctgatgttcttcctgagcagcagcaagctgaccaagtggaagggcgaggtgaagaagagactggacagcgagtacaaggagggcggccagagaaactgggtgcaggtgttctgcaacggcgccgtgcccaccgagctggccctgctgtacatgatcgagaacggccccggcgagatccccgtggacttcagcaagcagtacagcgccagctag

SEQ ID NO: 23371 - DNA, 459 bp, Artificial Sequence
  Description of Artificial Sequence: Synthetic coding sequence
tgagacacctgggccagcgaggtgggccccgtgctgagcaagagcagccccagactgatcaccacctgggagaaggtgcccgtgggcaccaacggcggcgtgaccgtggtgggcctggtgagcagcctgctgggcggcaccttcgtgggcatcgcctacttcctgacccagctgatcttcgtgaacgacctggacatcagcgccccccagtggcccatcatcgccttcggcggcctggccggcctgctgggcagcatcgtggacagctacctgggcgccaccatgcagtacaccggcctggacgagagcaccggcatggtggtgaacagccccaccaacaaggccagacacatcgccggcaagcccatcctggacaacaacgccgtgaacctgttcagcagcgtgctgatcgccctgctgctgcccaccgccgcctggggcttctggcccagaggctag

SEQ ID NO: 23372 - DNA, 534 bp, Artificial Sequence
  Description of Artificial Sequence: Synthetic coding sequence
atgctgggctgcggcatccccgccctgggcctgctgctgctgctgcagggcagcgccgacggcaacggcatccagggcttcttctacccctggagctgcgagggcgacatctgggacagagagagctgcggcggccaggccgccatcgacagccccaacctgtgcctgagactgagatgctgctacagaaacggcgtgtgctaccaccagagacccgacgagaacgtgagaagaaagcacatgtgggccctggtgtggacctgcagcggcctgctgctgctgagctgcagcatctgcctgttctggtgggccaagagaagagacgtgctgcacatgcccggcttcctggccggcccctgcgacatgagcaagagcgtgagcctgctgagcaagcacagaggcaccaagaagacccccagcaccggcagcgtgcccgtggccctgagcaaggagagcagagacgtggagggcggcaccgagggcgagggcaccgaggagggcgaggagaccgagggcgaggaggaggaggactag

SEQ ID NO: 23373 - DNA, 816 bp, Artificial Sequence
  Description of Artificial Sequence: Synthetic coding sequence
atggccgccggcggcagaatggaggacggcagcctggacatcacccagagcatcgaggacgaccccctgctggacgcccagctgctgccccaccacagcctgcaggcccacttcagacccagattccaccccctgcccaccgtgatcatcgtgaacctgctgtggttcatccacctggtgttcgtggtgctggccttcctgaccggcgtgctgtgcagctaccccaaccccaacgaggacaagtgccccggcaactacaccaaccccctgaaggtgcagaccgtgatcatcctgggcaaggtgatcctgtggatcctgcacctgctgctggagtgctacatccagtaccaccacagcaagatcagaaacagaggctacaacctgatctacagaagcaccagacacctgaagagactggccctgatgatccagagcagcggcaacaccgtgctgctgctgatcctgtgcatgcagcacagcttccccgagcccggcagactgtacctggacctgatcctggccatcctggccctggagctgatctgcagcctgatctgcctgctgatctacaccgtgaagatcagaagattcaacaaggccaagcccgagcccgacatcctggaggaggagaagatctacgcctaccccagcaacatcaccagcgagaccggcttcagaaccatcagcagcctggaggagatcgtggagaagcagggcgacaccatcgagtacctgaagagacacaacgccctgctgagcaagagactgctggccctgaccagcagcgacctgggctgccagcccagcagaacctag

SEQ ID NO: 23374 - DNA, 804 bp, Artificial Sequence
  Description of Artificial Sequence: Synthetic coding sequence
atgaacaaggccaccggcagcctggacatcacccagagcatcgaggacgaccccctgctggacgcccagctgctgccccaccacagcctgcaggcccacttcagacccagattccaccccctgcccaccgtgatcatcgtgaacctgctgtggttcatccacctggtgttcgtggtgctggccttcctgaccggcgtgctgtgcagctaccccaaccccaacgaggacaagtgccccggcaactacaccaaccccctgaaggtgcagaccgtgatcatcctgggcaaggtgatcctgtggatcctgcacctgctgctggagtgctacatccagtaccaccacagcaagatcagaaacagaggctacaacctgatctacagaagcaccagacacctgaagagactggccctgatgatccagagcagcggcaacaccgtgctgctgctgatcctgtgcatgcagcacagcttccccgagcccggcagactgtacctggacctgatcctggccatcctggccctggagctgatctgcagcctgatctgcctgctgatctacaccgtgaagatcagaagattcaacaaggccaagcccgagcccgacatcctggaggaggagaagatctacgcctaccccagcaacatcaccagcgagaccggcttcagaaccatcagcagcctggaggagatcgtggagaagcagggcgacaccatcgagtacctgaagagacacaacgccctgctgagcaagagactgctggccctgaccagcagcgacctgggctgccagcccagcagaacctag

SEQ ID NO: 23375 - DNA, 1335 bp, Artificial Sequence
  Description of Artificial Sequence: Synthetic coding sequence
atggccggcggcatgaaggtggccgtgagccccgccgtgggccccggcccctggggcagcggcgtgggcggcggcggcaccgtgagactgctgctgatcctgagcggctgcctggtgtacggcaccgccgagaccgacgtgaacgtggtgatgctgcaggagagccaggtgtgcgagaagagagccagccagcagttctgctacaccaacgtgctgatccccaagtggcacgacatctggaccagaatccagatcagagtgaacagcagcagactggtgagagtgacccaggtggagaacgaggagaagctgaaggagctggagcagttcagcatctggaacttcttcagcagcttcctgaaggagaagctgaacgacacctacgtgaacgtgggcctgtacagcaccaagacctgcctgaaggtggagatcatcgagaaggacaccaagtacagcgtgatcgtgatcagaagattcgaccccaagctgttcctggtgttcctgctgggcctgatgctgttcttctgcggcgacctgctgagcagaagccagatcttctactacagcaccggcatgaccgtgggcatcgtggccagcctgctgatcatcatcttcatcctgagcaagttcatgcccaagaagagccccatctacgtgatcctggtgggcggctggagcttcagcctgtacctgatccagctggtgttcaagaacctgcaggagatctggagatgctactggcagtacctgctgagctacgtgctgaccgtgggcttcatgagcttcgccgtgtgctacaagtacggccccctggagaacgagagaagcatcaacctgctgacctggaccctgcagctgatgggcctgtgcttcatgtacagcggcatccagatcccccacatcgccctggccatcatcatcatcgccctgtgcaccaagaacctggagcaccccatccagtggctgtacatcacctgcagaaaggtgtgcaagggcgccgagaagcccgtgccccccagactgctgaccgaggaggagtacagaatccagggcgaggtggagaccagaaaggccctggaggagctgagagagttctgcaacagccccgactgcagcgcctggaagaccgtgagcagaatccagagccccaagagattcgccgacttcgtggagggcagcagccacctgacccccaacgaggtgagcgtgcacgagcaggagtacggcctgggcagcatcatcgcccaggacgagatctacgaggaggccagcagcgaggaggaggacagctacagcagatgccccgccatcacccagaacaacttcctgacctag

SEQ ID NO: 23376 - DNA, 1116 bp, Artificial Sequence
  Description of Artificial Sequence: Synthetic coding sequence
atggccggcggcatgaaggtggccgtgagccccgccgtgggccccggcccctggggcagcggcgtgggcggcggcggcaccgtgagactgctgctgatcctgagcggctgcctggtgtacggcaccgccgagaccgacgtgaacgtggtgatgctgcaggagagccaggtgtgcgagaagagagccagccagcagttctgctacaccaacgtgctgatccccaagtggcacgacatctggaccagaatccagatcagagtgaacagcagcagactggtgagagtgacccaggtggagaacgaggagaagctgaaggagctggagcagagccagatcttctactacagcaccggcatgaccgtgggcatcgtggccagcctgctgatcatcatcttcatcctgagcaagttcatgcccaagaagagccccatctacgtgatcctggtgggcggctggagcttcagcctgtacctgatccagctggtgttcaagaacctgcaggagatctggagatgctactggcagtacctgctgagctacgtgctgaccgtgggcttcatgagcttcgccgtgtgctacaagtacggccccctggagaacgagagaagcatcaacctgctgacctggaccctgcagctgatgggcctgtgcttcatgtacagcggcatccagatcccccacatcgccctggccatcatcatcatcgccctgtgcaccaagaacctggagcaccccatccagtggctgtacatcacctgcagaaaggtgtgcaagggcgccgagaagcccgtgccccccagactgctgaccgaggaggagtacagaatccagggcgaggtggagaccagaaaggccctggaggagctgagagagttctgcaacagccccgactgcagcgcctggaagaccgtgagcagaatccagagccccaagagattcgccgacttcgtggagggcagcagccacctgacccccaacgaggtgagcgtgcacgagcaggagtacggcctgggcagcatcatcgcccaggacgagatctacgaggaggccagcagcgaggaggaggacagctacagcagatgccccgccatcacccagaacaacttcctgacctag

SEQ ID NO: 23377 - DNA, 519 bp, Artificial Sequence
  Description of Artificial Sequence: Synthetic coding sequence
atgtgcaccagcggccagatcatcggcagcctgctggtgctgagcgtgctggagatcggcctgggcgtgagcagcgtggccgtgggcgccgtgagcttcagcctggccctgagagagcacaagccccagctgggcgacagcagccccttcctgctgtgcggcatctgcggcatcctgtgcgccaagaagaagagcggcctggtgatgatcctgttcagcgcctgctgcatctgcggcctgatcggcggcatcctgaacttccagttcctgagagccgtgaccaagaagaccagcagcctgtaccccctgcacctggccagcatgagcctggcctgcatcggcatcggcggctgcaccctgagcagctggctgacctgcagactggccagctacgagcagagaagaatgttcagcgagagagagcacagcctgcaccacagccacgagatggccgagaaggagatcaccgacaacatgagcaacggcggcccccagctgatcttcaacggcagagtgtag

SEQ ID NO: 23378 - DNA, 270 bp, Artificial Sequence
  Description of Artificial Sequence: Synthetic coding sequence
atgatcctgttcagcgcctgctgcatctgcggcctgatcggcggcatcctgaacttccagttcctgagagccgtgaccaagaagaccagcagcctgtaccccctgcacctggccagcatgagcctggcctgcatcggcatcggcggctgcaccctgagcagctggctgacctgcagactggccagctacgagcagagaagaatgttcagcgagagagagcacagcctgcaccacagccacgagatggccgagaagatcgagggctactag

SEQ ID NO: 23379 - DNA, 1083 bp, Artificial Sequence
  Description of Artificial Sequence: Synthetic coding sequence
atgcccggcaccgtggccaccctgagattccagctgctgccccccgagcccgacgacgccttctggggcgccccctgcgagcagcccctggagagaagataccaggccctgcccgccctggtgtgcatcatgtgctgcctgttcggcgtggtgtactgcttcttcggctacagatgcttcaaggccgtgctgttcctgaccggcctgctgttcggcagcgtggtgatcttcctgctgtgctacagagagagagtgctggagacccagctgagcgccggcgccagcgccggcatcgccctgggcatcggcctgctgtgcggcctggtggccatgctggtgagaagcgtgggcctgttcctggtgggcctgctgctgggcctgctgctggccgccgccgccctgctgggcagcgccccctactaccagcccggcagcgtgtggggccccctgggcctgctgctgggcggcggcctgctgtgcgccctgctgaccctgagatggcccagacccctgaccaccctggccaccgccgtgaccggcgccgccctgatcgccaccgccgccgactacttcgccgagctgctgctgctgggcagatacgtggtggagagactgagagccgcccccgtgccccccctgtgctggagaagctgggccctgctggccctgtggcccctgctgagcctgatgggcgtgctggtgcagtggagagtgaccgccgagggcgacagccacaccgaggtggtgatcagcagacagagaagaagagtgcagctgatgagaatcagacagcaggaggacagaaaggagaagagaagaaagaagagaccccccagagcccccctgagaggccccagagccccccccagacccggcccccccgaccccgcctacagaagaagacccgtgcccatcaagagattcaacggcgacgtgctgagccccagctacatccagagcttcagagacagacagaccggcagcagcctgagcagcttcatggccagccccaccgacgccgactacgagtacggcagcagaggccccctgaccgcctgcagcggcccccccgtgagagtgtag

SEQ ID NO: 23380 - DNA, 1083 bp, Artificial Sequence; identical to SEQ ID NO: 23379
  Description of Artificial Sequence: Synthetic coding sequence

SEQ ID NO: 23381 - DNA, 684 bp, Artificial Sequence
  Description of Artificial Sequence: Synthetic coding sequence
atgcccggcaccgtggccaccctgagattccagctgctgccccccgagcccgacgacgccttctggggcgccccctgcgagcagcccctggagagaagataccaggccctgcccgccctggtgtgcatcatgtgctgcctgttcggcgtggtgtactgcttcttcggctacagatgcttcaaggccgtgctgttcctgaccggcctgctgttcggcagcgtggtgatcttcctgctgtgctacagagagagagtgctggagacccagctgagcgccggcgccagcgccggcatcgccctgggcatcggcctgctgtgcggcctggtggccatgctggtgagaagcgtgggcctgttcctggtgggcctgctgctgggcctgctgctggccgccgccgccctgctgggcagcgccccctactaccagcccggcagcgtgtggggccccctgggcctgctgctgggcggcggcctgctgtgcgccctgctgaccctgagatggcccagacccctgaccaccctggccaccgccgtgaccggcgccgccctgatcgccaccgccgccgactacttcgccgagctgctgctgctgggcagatacgtggtggagagactgagagccgcccccgtgccccccctgtgctggagaagctgggccctgctggccctgtggcccctgctgtag

SEQ ID NO: 23382 - DNA, 627 bp, Artificial Sequence
  Description of Artificial Sequence: Synthetic coding sequence
atggccagcagcctgctggccggcgagagactggtgagagccctgggccccggcggcgagctggagcccgagagactgcccagaaagctgagagccgagctggaggccgccctgggcaagaagcacaagggcggcgacagcagcagcggcccccagagactggtgagcttcagactgatcagagacctgcaccagcacctgagagagagagacagcaagctgtacctgcacgagctgctggagggcagcgagatctacctgcccgaggtggtgaagccccccagaaaccccgagctggtggccagactggagaagatcaagatccagctggccaacgaggagtacaagagaatcaccagaaacgtgacctgccaggacaccagacacggcggcaccctgagcgacctgggcaagcaggtgagaagcctgaaggccctggtgatcaccatcttcaacttcatcgtgaccgtggtggccgccttcgtgtgcacctacctgggcagccagtacatcttcaccgagatggccagcagagtgctggccgccctgatcgtggccagcgtggtgggcctggccgagctgtacgtgatggtgagagccatggagggcgagctgggcgagctgtag

SEQ ID NO: 23383 - DNA, 900 bp, Artificial Sequence
  Description of Artificial Sequence: Synthetic coding sequence
atggccagcagcctgctggccggcgagagactggtgagagccctgggccccggcggcgagctggagcccgagagactgcccagaaagctgagagccgagctggaggccgccctgggcaagaagcacaagggcggcgacagcagcagcggcccccagagactggtgagcttcagactgatcagagacctgcaccagcacctgagagagagagacagcaagctgtacctgcacgagctgctggagggcagcgagatctacctgcccgaggtggtgaagccccccagaaaccccgagctggtggccagactggagaagatcaagatccagctggccaacgaggagtacaagagaatcaccagaaacgtgacctgccaggacaccagacacggcggcaccctgagcgacctgggcaagcaggtgagaagcctgaaggccctggtgatcaccatcttcaacttcatcgtgaccgtggtggccgccttcgtgtgcacctacctgggcagccagtacatcttcaccgagatggccagcagacccagaggcgcccactgggccggcagagaccccgagcccggcgagggcaccagaaccagaagagccggcgccgagtgggtgagacacctgggcgcccacgtgcaggccttcggcggcgacatgcccgaggccggcggcggcagaagacccggcagaggcgccgtgctggtgcccccccacggccccagagccgccgcccccctgagagccggcgccggccagctgagagccgccagaggccccggcggcgccgccacccacggcagagaggccagaagcagagtggccctgcccgccagactgctgcagggcggcagagccgccttcgccgccagactgcccagaagcagcggcgtgggcgactag

SEQ ID NO: 23384 - DNA, 1476 bp, Artificial Sequence
  Description of Artificial Sequence: Synthetic coding sequence
atgatcgccaccggcggcgtgatcaccggcctggccgccctgaagagacaggacagcgccagaagccagcagcacgtgaacctgagccccagccccgccacccaggagaagaagcccatcagaagaagacccagagccgacgtggtggtggtgagaggcaagatcagactgtacagccccagcggcttcttcctgatcctgggcgtgctgatcagcatcatcggcatcgccatggccgtgctgggctactggccccagaaggagcacttcatcgacgccgagaccaccctgagcaccaacgagacccaggtgatcagaaacgagggcggcgtggtggtgagattcttcgagcagcacctgcacagcgacaagatgaagatgctgggccccttcaccatgggcatcggcatcttcatcttcatctgcgccaacgccatcctgcacgagaacagagacaaggagaccaagatcatccacatgagagacatctacagcaccgtgatcgacatccacaccctgagaatcaaggagcagagacagatgaacggcatgtacaccggcctgatgggcgagaccgaggtgaagcagaacggcagcagctgcgccagcagactggccgccaacaccatcgccagcttcagcggcttcagaagcagcttcagaatggacagcagcgtggaggaggacgagctgatgctgaacgagggcaagagcagcggccacctgatgccccccctgctgagcgacagcagcgtgagcgtgttcggcctgtaccccccccccagcaagaccaccgacgacaagaccagcggcagcaagaagtgcgagaccaagagcatcgtgagcagcagcatcagcgccttcaccctgcccgtgatcaagctgaacaactgcgtgatcgacgagcccagcatcgacaacatcaccgaggacgccgacaacctgaagagcagaagcagaaacctgagcatggacagcctggtggtgcccctgcccaacaccagcgagagcttccagcccgtgagcaccgtgctgcccagaaacaacagcatcggcgagagcctgagcagccagtacaagagcagcatggccctgggccccggcgccggccagctgctgagccccggcgccgccagaagacagttcggcagcaacaccagcctgcacctgctgagcagccacagcaagagcctggacctggacagaggccccagcaccctgaccgtgcaggccgagcagagaaagcaccccagctggcccagactggacagaaacaacagcaagggctacatgaagctggagaacaaggaggaccccatggacagactgctggtgccccaggtggccatcaagaaggacttcaccaacaaggagaagctgctgatgatcagcagaagccacaacaacctgagcttcgagcacgacgagttcctgagcaacaacctgaagagaggcaccagcgagaccagattctag

SEQ ID NO: 23385 - DNA, 1476 bp, Artificial Sequence; identical to SEQ ID NO: 23384
  Description of Artificial Sequence: Synthetic coding sequence

SEQ ID NO: 23386 - DNA, 1476 bp, Artificial Sequence; identical to SEQ ID NO: 23384
  Description of Artificial Sequence: Synthetic coding sequence

SEQ ID NO: 23387 - DNA, 924 bp, Artificial Sequence
  Description of Artificial Sequence: Synthetic coding sequence
atgaccgccggcagccccgaggagtgcggcgaggtgagaagaagccccgagggcagagtgagcagactgggcagaagactgggcagaagaagaagacccagaagcccccccgagcccctgagagtgagagccagactgagactgagaagccccagcggcgccttcgccgccctgggcgccctggtggtgctggtgggcatgggcatcgccgtggccggctactggccccacagagccggcgcccccggcagcagagccgccaacgccagcagcccccagatgagcgagctgagaagagagggcagaggcggcggcagagcccacggcccccacgagagactgagactgctgggccccgtgatcatgggcgtgggcctgttcgtgttcatctgcgccaacaccctgctgtacgagaacagagacctggagaccagaagactgagacagggcgtgctgagagcccaggccctgagaccccccgacggccccggctgggactgcgccctgctgcccagccccggccccagaagccccagagccgtgggctgcgccgagcccgagatctgggaccccagccccagaagaggcaccagccccgtgcccagcgtgagaagcctgagaagcgagcccgccaaccccagactgggcctgcccgccctgctgaacagctaccccctgaagggccccggcctgccccccccctggggccccagaacccagaccggccacgtgatcatcaccgtgcagcccagcggcagctgcatcgagcacagcaagagcctggacctgggcctgggcgagctgctgctgggcgcccccgccgccagagactgcgcccacagaagctggcccagactggacagactgagcctgggcggctacgccaagctgggcggcggcggcgacctgggcgccagagtgtag

SEQ ID NO: 23388 - DNA, 924 bp, Artificial Sequence; identical to SEQ ID NO: 23387
  Description of Artificial Sequence: Synthetic coding sequence

SEQ ID NO: 23389 - DNA, 1866 bp, Artificial Sequence
  Description of Artificial Sequence: Synthetic coding sequence
atgatcgccaccggcggcctgctgagaatcagcgccagaaagcaggaccccctgagaccccccagccagatccccaagagaaagagaaaggccaagaagagaagaaagaacgacgtggtggtggtgaagggcaagctgaagctgtgcagcatcagcggcctgatcgccctgtgcggcatcctggtgctgctggtgggcatcgccatggccgtggtgggctactggcccaaggccaccggcaccaacagagagggcggcaagcagctgccccccgccggcagcagccacagagtgcccaccaccgccaacagcagcagcagcggcagcaagaacagaagcagaagccaccccagagcccccggcggcgtgaacagcagcagcgccggcgcccccagaagcaccccccccgccagagccgccagccccagcagcagcagcaccagcgtgggcttcttcttcagaatcttcagcggctacctgcacagcgacaagctgaaggtgttcggccccctgatcatgggcatcggcatcttcctgttcatctgcgccaacgccgtgctgcacgagaacagagacaagaagaccaagatcatcaacctgagagacctgtacagcaccgtgatcgacgtgcacagcctgagagccaaggacctggccgccgccgccgccgccgccgccgccgccgccgccagcagcagcagcagcgcccccgccgccgccccccccggcgccatccccctgaacggcttcctgagctacgtgcagagcagaggcctggagctgaagcccggcggctgcggcggcagcggcgacgccttcggcgccgccgccatgctggccaagggcagctggcccccccaccccgccgcccccagcggcggcagacccagaggcgccgccagcccccccgacctggccagcagccccagatgccccagagagccccccagcctggccgaggccgtgtacagcgtgtacagagagagaagcggcgtggccggcagcagaagagccgccgccgccaccgccgccgccgccgccagcagctgcagcagccccgccccctgcagcccccccgagagctggggcagacagagcaccgccagcagcttcgtggacagcagcctgagcgccttcgccctgctgcccctgcagggcggcagagacagaggcggcgacgccgagggcgccagctgcagctggcagagaccccccggcgagagaggcagccaggagatccccagaggcgagctggacctgagcatgaccaacctgagaggcgccgagggcagcatgagaggcgccagaagagagcccgaggagcccgagggcgccgtggccgccagagccgccagaggccagggcggcagactgcccagaaccggcagatacgccgccctgagaagaagaagcaccagcggcctgcccgactacagagccccccccagccccgagcccccccccagccccggcagcgccgaccccgacagcagccccctggccaaggccgccagccccagcccccccctgagactggagggcagcccccccaccagaagagacagcggcagcagccagagcgacgaccccagcagcagcaacaagggctacacccccctgagagaggccggcaccagcaccgagagcgtgctggacgccgtggccggccagaccagagacagcgccgtggccgcccccgtgctgggcgccgagcagagcagccccgagggcgccagccaggagccccccaccgccgagcagccccagcccgtgcagagacagttcaccaacaaggagaagctgatcatgatcagcagaagccacgccatcggcgtggaggaggagctggagagcaccggcatctag

SEQ ID NO: 23390 - DNA, 1866 bp, Artificial Sequence; identical to SEQ ID NO: 23389
  Description of Artificial Sequence: Synthetic coding sequence

SEQ ID NO: 23391 - DNA, 1179 bp, Artificial Sequence
  Description of Artificial Sequence: Synthetic coding sequence
atggagggcgtgagcgccctgctggccagatgccccaccgccggcctggccggcggcctgggcgtgaccgcctgcgccgccgccggcgtgctgctgtacagaatcgccagaagaatgaagcccacccacaccatggtgaactgctggttctgcaaccaggacaccctggtgccctacggcaacagaaactgctgggactgcccccactgcgagcagtacaacggcttccaggagaacggcgactacaacaagcccatccccgcccagtacctggagcacctgaaccacgtggtgagcagcgcccccagcctgagagaccccagccagccccagcagtgggtgagcagccaggtgctgctgtgcaagagatgcaaccaccaccagaccaccaagatcaagcagctggccgccttcgcccccagagaggagggcagatacgacgaggaggtggaggtgtacagacaccacctggagcagatgtacaagctgtgcagaccctgccaggccgccgtggagtactacatcaagcaccagaacagacagctgagagccctgctgctgagccaccagttcaagagaagagaggccgaccagacccacgcccagaacttcagcagcgccgtgaagagccccgtgcaggtgatcctgctgagagccctggccttcctggcctgcgccttcctgctgaccaccgccctgtacggcgccagcggccacttcgcccccggcaccaccgtgcccctggccctgccccccggcggcaacggcagcgccacccccgacaacggcaccacccccggcgccgagggctggagacagctgctgggcctgctgcccgagcacatggccgagaagctgtgcgaggcctgggccttcggccagagccaccagaccggcgtggtggccctgggcctgctgacctgcctgctggccatgctgctggccggcagaatcagactgagaagaatcgacgccttctgcacctgcctgtgggccctgctgctgggcctgcacctggccgagcagcacctgcaggccgccagccccagctggctggacaccctgaagttcagcaccaccagcctgtgctgcctggtgggcttcaccgccgccgtggccaccagaaaggccaccggccccagaagattcagacccagaagaagcgagaagcagccctag

SEQ ID NO: 23392 - DNA, 2001 bp, Artificial Sequence
  Description of Artificial Sequence: Synthetic coding sequence
atggagggcgtgagcgccctgctggccagatgccccaccgccggcctggccggcggcctgggcgtgaccgcctgcgccgccgccggcgtgctgctgtacagaatcgccagaagaatgaagcccacccacaccatggtgaactgctggttctgcaaccaggacaccctggtgccctacggcaacagaaactgctgggactgcccccactgcgagcagtacaacggcttccaggagaacggcgactacaacaagcccatccccgcccagtacctggagcacctgaaccacgtggtgagcagcgcccccagcctgagagaccccagccagccccagcagtgggtgagcagccaggtgctgctgtgcaagagatgcaaccaccaccagaccaccaagatcaagcagctggccgccttcgcccccagagaggagggcagatacgacgaggaggtggaggtgtacagacaccacctggagcagatgtacaagctgtgcagaccctgccaggccgccgtggagtactacatcaagcaccagaacagacagctgagagccctgctgctgagccaccagttcaagagaagagaggccgaccagacccacgcccagaacttcagcagcgccgtgaagagccccgtgcaggtgatcctgctgagagccctggccttcctggcctgcgccttcctgctgaccaccgccctgtacggcgccagcggccacttcgcccccggcaccaccgtgcccctggccctgccccccggcggcaacggcagcgccacccccgacaacggcaccacccccggcgccgagggctggagacagctgctgggcctgctgcccgagcacatggccgagaagctgtgcgaggcctgggccttcggccagagccaccagaccggcgtggtggccctgggcctgctgacctgcctgctggccatgctgctggccggcagaatcagactgagaagaatcgacgccttctgcacctgcctgtgggccctgctgctgggcctgcacctggccgagcagcacctgcaggccgccagccccagctggctggacaccctgaagttcagcaccaccagcctgtgctgcctggtgggcttcaccgccgccgtggccaccagaaaggccaccggccccagaagattcagacccagaagattcttccccggcgacagcgccggcctgttccccaccagccccagcctggccatcccccaccccagcgtgggcggcagccccgccagcctgttcatccccagcccccccagcttcctgcccctggccaaccagcagctgttcagaagccccagaagaaccagccccagcagcctgcccggcagactgagcagagccctgagcctgggcaccatccccagcctgaccagagccgacagcggctacctgttcagcggcagcagaccccccagccaggtgagcagaagcggcgagttccccgtgagcgactacttcagcctgctgagcggcagctgccccagcagccccctgcccagccccgcccccagcgtggccggcagcgtggccagcagcagcggcagcctgagacacagaagacccctgatcagccccgccagactgaacctgaagggccagaagctgctgctgttccccagcccccccggcgaggcccccaccacccccagcagcagcgacgagcacagcccccacaacggcagcctgttcaccatggagcccccccacgtgcccagaaagccccccctgcaggacgtgaagcacgccctggacctgagaagcaagctggagagaggcagcgcctgcagcaacagaagcatcaagaaggaggacgacagcagccagagcagcacctgcgtggtggacaccaccaccagaggctgcagcgaggaggccgccacctggagaggcagattcggccccagcctggtgagaggcctgctggccgtgagcctggccgccaacgccctgttcaccagcgtgttcctgtaccagagcctgagatag

SEQ ID NO: 23393 - DNA, 1929 bp, Artificial Sequence
  Description of Artificial Sequence: Synthetic coding sequence
atggagggcgtgagcgccctgctggccagatgccccaccgccggcctggccggcggcctgggcgtgaccgcctgcgccgccgccggcgtgctgctgtacagaatcgccagaagaatgaagcccacccacaccatggtgaactgctggttctgcaaccaggacaccctggtgccctacggcaacagaaactgctgggactgcccccactgcgagcagtacaacggcttccaggagaacggcgactacaacaagcccatccccgcccagtacctggagcacctgaaccacgtggtgagcagcgcccccagcctgagagaccccagccagccccagcagtgggtgagcagccaggtgctgctgtgcaagagatgcaaccaccaccagaccaccaagatcaagcagctggccgccttcgcccccagagaggagggcagatacgacgaggaggtggaggtgtacagacaccacctggagcagatgtacaagctgtgcagaccctgccaggccgccgtggagtactacatcaagcaccagaacagacagctgagagccctgctgctgagccaccagttcaagagaagagaggccgaccagacccacgcccagaacttcagcagcgccgtgaagagccccgtgcaggtgatcctgctgagagccctggccttcctggcctgcgccttcctgctgaccaccgccctgtacggcgccagcggccacttcgcccccggcaccaccgtgcccctggccctgccccccggcggcaacggcagcgccacccccgacaacggcaccacccccggcgccgagggctggagacagctgctgggcctgctgcccgagcacatggccgagaagctgtgcgaggcctgggccttcggccagagccaccagaccggcgtggtggccctgggcctgctgacctgcctgctggccatgctgctggccggcagaatcagactgagaagaatcgacgccttctgcacctgcctgtgggccctgctgctgggcctgcacctggccgagcagcacctgcaggccgccagccccagctggctggacaccctgaagttcagcaccaccagcctgtgctgcctggtgggcttcaccgccgccgtggccaccagaaaggccaccggccccagaagattcagacccagaagattcttccccggcgacagcgccggcctgttccccaccagccccagcctggccatcccccaccccagcgtgggcggcagccccgccagcctgttcatccccagcccccccagcttcctgcccctggccaaccagcagctgttcagaagccccagaagaaccagccccagcagcctgcccggcagactgagcagagccctgagcctgggcaccatccccagcctgaccagagccgactacttcagcctgctgagcggcagctgccccagcagccccctgcccagccccgcccccagcgtggccggcagcgtggccagcagcagcggcagcctgagacacagaagacccctgatcagccccgccagactgaacctgaagggccagaagctgctgctgttccccagcccccccggcgaggcccccaccacccccagcagcagcgacgagcacagcccccacaacggcagcctgttcaccatggagcccccccacgtgcccagaaagccccccctgcaggacgtgaagcacgccctggacctgagaagcaagctggagagaggcagcgcctgcagcaacagaagcatcaagaaggaggacgacagcagccagagcagcacctgcgtggtggacaccaccaccagaggctgcagcgaggaggccgccacctggagaggcagattcggccccagcctggtgagaggcctgctggccgtgagcctggccgccaacgccctgttcaccagcgtgttcctgtaccagagcctgagatag

SEQ ID NO: 23394 - DNA, 411 bp, Artificial Sequence
  Description of Artificial Sequence: Synthetic coding sequence
atgctgttcagcctgagagagctggtgcagtggctgggcttcgccaccttcgagatcttcgtgcacctgctggccctgctggtgttcagcgtgctgctggccctgagagtggacggcctggtgcccggcctgagctggtggaacgtgttcgtgcccttcttcgccgccgacggcctgagcacctacttcaccaccatcgtgagcgtgagactgttccaggacggcgagaagagactggccgtgctgagactgttctgggtgctgaccgtgctgagcctgaagttcgtgttcgagatgctgctgtgccagaagctggccgagcagaccagagagctgtggttcggcctgatcaccagccccctgttcatcctgctgcagctgctgatgatcagagcctgcagagtgaactag

SEQ ID NO: 23395 - DNA, 411 bp, Artificial Sequence; identical to SEQ ID NO: 23394
  Description of Artificial Sequence: Synthetic coding sequence

SEQ ID NO: 23396 - DNA, 681 bp, Artificial Sequence
  Description of Artificial Sequence: Synthetic coding sequence
atgaccgtgcagagactggtggccgccgccgtgctggtggccctggtgagcctgatcctgaacaacgtggccgccttcaccagcaactgggtgtgccagaccctggaggacggcagaagaagaagcgtgggcctgtggagaagctgctggctggtggacagaaccagaggcggccccagccccggcgccagagccggccaggtggacgcccacgactgcgaggccctgggctggggcagcgaggccgccggcttccaggagagcagaggcaccgtgaagctgcagttcgacatgatgagagcctgcaacctggtggccaccgccgccctgaccgccggccagctgaccttcctgctgggcctggtgggcctgcccctgctgagccccgacgccccctgctgggaggaggccatggccgccgccttccagctggccagcttcgtgctggtgatcggcctggtgaccttctacagaatcggcccctacaccaacctgagctggagctgctacctgaacatcggcgcctgcctgctggccaccctggccgccgccatgctgatctggaacatcctgcacaagagagaggactgcatggcccccagagtgatcgtgatcagcagaagcctgaccgccagattcagaagaggcctggacaacgactacgtggagagcccctgctag

SEQ ID NO: 23397 - DNA, 681 bp, Artificial Sequence; identical to SEQ ID NO: 23396
  Description of Artificial Sequence: Synthetic coding sequence

SEQ ID NO: 23398 - DNA, 1053 bp, Artificial Sequence
  Description of Artificial Sequence: Synthetic coding sequence
atgatcagacaggagagaagcaccagctaccaggagctgagcgaggagctggtgcaggtggtggagaacagcgagctggccgacgagcaggacaaggagaccgtgagagtgcagggccccggcatcctgcccggcctggacagcgagagcgccagcagcagcatcagattcagcaaggcctgcctgaagaacgtgttcagcgtgctgctgatcttcatctacctgctgctgatggccgtggccgtgttcctggtgtacagaaccatcaccgacttcagagagaagctgaagcaccccgtgatgagcgtgagctacaaggaggtggacagatacgacgcccccggcatcgccctgtaccccggccaggcccagctgctgagctgcaagcaccactacgaggtgatcccccccctgaccagccccggccagcccggcgacatgaactgcaccacccagagaatcaactacaccgaccccttcagcaaccagaccgtgaagagcgccctgatcgtgcagggccccagagaggtgaagaagagagagctggtgttcctgcagttcagactgaacaagagcagcgaggacttcagcgccatcgactacctgctgttcagcagcttccaggagttcctgcagagccccaacagagtgggcttcatgcaggcctgcgagagcgcctacagcagctggaagttcagcggcggcttcagaacctgggtgaagatgagcctggtgaagaccaaggaggaggacggcagagaggccgtggagttcagacaggagaccagcgtggtgaactacatcgaccagagacccgccgccaagaagagcgcccagctgttcttcgtggtgttcgagtggaaggaccccttcatccagaaggtgcaggacatcgtgaccgccaacccctggaacaccatcgccctgctgtgcggcgccttcctggccctgttcaaggccgccgagttcgccaagctgagcatcaagtggatgatcaagatcagaaagagatacctgaagagaagaggccaggccaccagccacatcagctag

SEQ ID NO: 23399 - DNA, 1236 bp, Artificial Sequence
  Description of Artificial Sequence: Synthetic coding sequence
atgatcagacaggagagaagcaccagctaccaggaggccgtgagacccgccctgcccagcagcaagccctgcctgctgaccagccccgccgtgctggtgaagctgctgagcagcagcgccagcaccagcagaccccccaacctgggccacctgtggcagcccagcagcagcgtgcccctgcacagagccgccagcctggccaaggtgagacagttccagctgagcgaggagctggtgcaggtggtggagaacagcgagctggccgacgagcaggacaaggagaccgtgagagtgcagggccccggcatcctgcccggcctggacagcgagagcgccagcagcagcatcagattcagcaaggcctgcctgaagaacgtgttcagcgtgctgctgatcttcatctacctgctgctgatggccgtggccgtgttcctggtgtacagaaccatcaccgacttcagagagaagctgaagcaccccgtgatgagcgtgagctacaaggaggtggacagatacgacgcccccggcatcgccctgtaccccggccaggcccagctgctgagctgcaagcaccactacgaggtgatcccccccctgaccagccccggccagcccggcgacatgaactgcaccacccagagaatcaactacaccgaccccttcagcaaccagaccgtgaagagcgccctgatcgtgcagggccccagagaggtgaagaagagagagctggtgttcctgcagttcagactgaacaagagcagcgaggacttcagcgccatcgactacctgctgttcagcagcttccaggagttcctgcagagccccaacagagtgggcttcatgcaggcctgcgagagcgcctacagcagctggaagttcagcggcggcttcagaacctgggtgaagatgagcctggtgaagaccaaggaggaggacggcagagaggccgtggagttcagacaggagaccagcgtggtgaactacatcgaccagagacccgccgccaagaagagcgcccagctgttcttcgtggtgttcgagtggaaggaccccttcatccagaaggtgcaggacatcgtgaccgccaacccctggaacaccatcgccctgctgtgcggcgccttcctggccctgttcaaggccgccgagttcgccaagctgagcatcaagtggatgatcaagatcagaaagagatacctgaagagaagaggccaggccaccagccacatcagctag

SEQ ID NO: 23400 - DNA, 441 bp, Artificial Sequence
  Description of Artificial Sequence: Synthetic coding sequence
atgagcagaagcagactgttcagcgtgaccagcgccatcagcaccatcggcatcctgtgcctgcccctgttccagctggtgctgagcgacctgccctgcgaggaggacgagatgtgcgtgaactacaacgaccagcaccccaacggctggtacatctggatcctgctgctgctggtgctggtggccgccctgctgtgcggcgccgtggtgctgtgcctgcagtgctggctgagaagacccagaatcgacagccacagaagaaccatggccgtgttcgccgtgggcgacctggacagcatctacggcaccgaggccgccgtgagccccaccgtgggcatccacctgcagacccagacccccgacctgtaccccgtgcccgccccctgcttcggccccctgggcagcccccccccctacgaggagatcgtgaagaccacctag

SEQ ID NO: 23401 - DNA, 522 bp, Artificial Sequence
  Description of Artificial Sequence: Synthetic coding sequence
atggcccccaagggcaaggtgggcaccagaggcaagaagcagatcttcgaggagaacagagagaccctgaagttctacctgagaatcatcctgggcgccaacgccatctactgcctggtgaccctggtgttcttctacagcagcgccagcttctgggcctggctggccctgggcttcagcctggccgtgtacggcgccagctaccacagcatgagcagcatggccagagccgccttcagcgaggacggcgccctgatggacggcggcatggacctgaacatggagcagggcatggccgagcacctgaaggacgtgatcctgctgaccgccatcgtgcaggtgctgagctgcttcagcctgtacgtgtggagcttctggctgctggcccccggcagagccctgtacctgctgtgggtgaacgtgctgggcccctggttcaccgccgacagcggcacccccgcccccgagcacaacgagaagagacagagaagacaggagagaagacagatgaagagactgtag

SEQ ID NO: 23402 - DNA, 1557 bp, Artificial Sequence
  Description of Artificial Sequence: Synthetic coding sequence
atgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaacgtgacctactggcccctgtggtacatcgagctggccctggccagcctgttcagcctgaacgccctgttcgacttctggagatacttcaagtacaccgtggcccccaccagcctggtggtgagccccggccagcagaccctgctgggcctgaagaccgccgtggtgcagaccacccccccccacgacctggccgccacccagatcccccccgccccccccagccccagcatccagggccagagcgtgctgagctacagccccagcagaagccccagcaccagccccaagttcaccaccagctgcatgaccggctacagcccccagctgcagggcctgagcagcggcggcagcggcagctacagccccggcgtgacctacagccccgtgagcggctacaacaagctggccagcttcagccccagcccccccagcccctaccccaccaccgtgggccccgtggagagcagcggcctgagaagcagatacagaagcagccccaccgtgtacaacagccccaccgacaaggaggactacatgaccgacctgagaaccctggacaccttcctgagaagcgaggaggagaagcagcacagagtgaagctgggcagccccgacagcaccagccccagcagcagccccaccttctggaactacagcagaagcatgggcgactacgcccagaccctgaagaagttccagtaccagctggcctgcagaagccaggccccctgcgccaacaaggacgaggccgacctgagcagcaagcaggccgccgaggaggtgtgggccagagtggccatgaacagacagctgctggaccacatggacagctggaccgccaagttcagaaactggatcaacgagaccatcctggtgcccctggtgcaggagatcgagagcgtgagcacccagatgagaagaatgggctgccccgagctgcagatcggcgagctgagccagggcggctgcatgagcagcttcagatggaacagaggcggcgacttcaagggcagaaagtgggacaccgacctgcccaccgacagcgccatcatcatgcacgtgttctgcacctacctggacagcagactgcccccccaccccaagtaccccgacggcaagaccttcaccagccagcacttcgtgcagacccccaacaagcccgacgtgaccaacgagaacgtgttctgcatctaccagagcgccatcaaccccccccactacgagctgatctaccagagacacgtgtacaacctgcccaagggcagaaacaacatgttccacaccctgctgatgttcctgtacatcatcaagaccaaggagagcggcatgctgggcagagtgaacctgggcctgagcggcgtgaacatcctgtggatcttcggcgagtag

SEQ ID NO: 23403 - DNA, 1686 bp, Artificial Sequence
  Description of Artificial Sequence: Synthetic coding sequence
atgatgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaacgtgacctactggcccctgtggtacatcgagctggccctggccagcctgttcagcctgaacgccctgttcgacttctggagatacttcaagtacaccgtggcccccaccagcctggtggtgagccccggccagcagaccctgctgggcctgaagaccgccgtggtgcagaccacccccccccacgacctggccgccacccagatcccccccgccccccccagccccagcatccagggccagagcgtgctgagctacagccccagcagaagccccagcaccagccccaagttcaccaccagctgcatgaccggctacagcccccagctgcagggcctgagcagcggcggcagcggcagctacagccccggcgtgacctacagccccgtgagcggctacaacaagctggccagcttcagccccagcccccccagcccctaccccaccaccgtgggccccgtggagagcagcggcctgagaagcagatacagaagcagccccaccgtgtacaacagccccaccgacaaggaggactacatgaccgacctgagaaccctggacaccttcctgagaagcgaggaggagaagcagcacagagtgaagctgggcagccccgacagcaccagccccagcagcagccccaccttctggaactacagcagaagcatgggcgactacgcccagaccctgaagaagttccagtaccagctggcctgcagaagccaggccccctgcgccaacaaggacgaggccgacctgagcagcaagcaggccgccgaggaggtgtgggccagagtggccatgaacagacagctgctggaccacatggacagctggaccgccaagttcagaaactggatcaacgagaccatcctggtgcccctggtgcaggagatcgagagcgtgagcacccagatgagaagaatgggctgccccgagctgcagatcggcgaggccagcatcaccagcctgaagcaggccgccctggtgaaggcccccctgatccccaccctgaacaccatcgtgcagtacctggacctgacccccaaccaggagtacctgttcgagagaatcaaggagctgagccagggcggctgcatgagcagcttcagatggaacagaggcggcgacttcaagggcagaaagtgggacaccgacctgcccaccgacagcgccatcatcatgcacgtgttctgcacctacctggacagcagactgcccccccaccccaagtaccccgacggcaagaccttcaccagccagcacttcgtgcagacccccaacaagcccgacgtgaccaacgagaacgtgttctgcatctaccagagcgccatcaaccccccccactacgagctgatctaccagagacacgtgtacaacctgcccaagggcagaaacaacatgttccacaccctgctgatgttcctgtacatcatcaagaccaaggagagcggcatgctgggcagagtgaacctgggcctgagcggcgtgaacatcctgtggatcttcggcgagtag

SEQ ID NO: 23404 - DNA, 1683 bp, Artificial Sequence
  Description of Artificial Sequence: Synthetic coding sequence
atgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaacgtgacctactggcccctgtggtacatcgagctggccctggccagcctgttcagcctgaacgccctgttcgacttctggagatacttcaagtacaccgtggcccccaccagcctggtggtgagccccggccagcagaccctgctgggcctgaagaccgccgtggtgcagaccacccccccccacgacctggccgccacccagatcccccccgccccccccagccccagcatccagggccagagcgtgctgagctacagccccagcagaagccccagcaccagccccaagttcaccaccagctgcatgaccggctacagcccccagctgcagggcctgagcagcggcggcagcggcagctacagccccggcgtgacctacagccccgtgagcggctacaacaagctggccagcttcagccccagcccccccagcccctaccccaccaccgtgggccccgtggagagcagcggcctgagaagcagatacagaagcagccccaccgtgtacaacagccccaccgacaaggaggactacatgaccgacctgagaaccctggacaccttcctgagaagcgaggaggagaagcagcacagagtgaagctgggcagccccgacagcaccagccccagcagcagccccaccttctggaactacagcagaagcatgggcgactacgcccagaccctgaagaagttccagtaccagctggcctgcagaagccaggccccctgcgccaacaaggacgaggccgacctgagcagcaagcaggccgccgaggaggtgtgggccagagtggccatgaacagacagctgctggaccacatggacagctggaccgccaagttcagaaactggatcaacgagaccatcctggtgcccctggtgcaggagatcgagagcgtgagcacccagatgagaagaatgggctgccccgagctgcagatcggcgaggccagcatcaccagcctgaagcaggccgccctggtgaaggcccccctgatccccaccctgaacaccatcgtgcagtacctggacctgacccccaaccaggagtacctgttcgagagaatcaaggagctgagccagggcggctgcatgagcagcttcagatggaacagaggcggcgacttcaagggcagaaagtgggacaccgacctgcccaccgacagcgccatcatcatgcacgtgttctgcacctacctggacagcagactgcccccccaccccaagtaccccgacggcaagaccttcaccagccagcacttcgtgcagacccccaacaagcccgacgtgaccaacgagaacgtgttctgcatctaccagagcgccatcaaccccccccactacgagctgatctaccagagacacgtgtacaacctgcccaagggcagaaacaacatgttccacaccctgctgatgttcctgtacatcatcaagaccaaggagagcggcatgctgggcagagtgaacctgggcctgagcggcgtgaacatcctgtggatcttcggcgagtag

SEQ ID NO: 23405 - DNA, 171 bp, Artificial Sequence
  Description of Artificial Sequence: Synthetic coding sequence
atgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaactag

SEQ ID NO: 23406 - DNA, 1560 bp, Artificial Sequence
  Description of Artificial Sequence: Synthetic coding sequence
atgatgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaacgtgacctactggcccctgtggtacatcgagctggccctggccagcctgttcagcctgaacgccctgttcgacttctggagatacttcaagtacaccgtggcccccaccagcctggtggtgagccccggccagcagaccctgctgggcctgaagaccgccgtggtgcagaccacccccccccacgacctggccgccacccagatcccccccgccccccccagccccagcatccagggccagagcgtgctgagctacagccccagcagaagccccagcaccagccccaagttcaccaccagctgcatgaccggctacagcccccagctgcagggcctgagcagcggcggcagcggcagctacagccccggcgtgacctacagccccgtgagcggctacaacaagctggccagcttcagccccagcccccccagcccctaccccaccaccgtgggccccgtggagagcagcggcctgagaagcagatacagaagcagccccaccgtgtacaacagccccaccgacaaggaggactacatgaccgacctgagaaccctggacaccttcctgagaagcgaggaggagaagcagcacagagtgaagctgggcagccccgacagcaccagccccagcagcagccccaccttctggaactacagcagaagcatgggcgactacgcccagaccctgaagaagttccagtaccagctggcctgcagaagccaggccccctgcgccaacaaggacgaggccgacctgagcagcaagcaggccgccgaggaggtgtgggccagagtggccatgaacagacagctgctggaccacatggacagctggaccgccaagttcagaaactggatcaacgagaccatcctggtgcccctggtgcaggagatcgagagcgtgagcacccagatgagaagaatgggctgccccgagctgcagatcggcgagctgagccagggcggctgcatgagcagcttcagatggaacagaggcggcgacttcaagggcagaaagtgggacaccgacctgcccaccgacagcgccatcatcatgcacgtgttctgcacctacctggacagcagactgcccccccaccccaagtaccccgacggcaagaccttcaccagccagcacttcgtgcagacccccaacaagcccgacgtgaccaacgagaacgtgttctgcatctaccagagcgccatcaaccccccccactacgagctgatctaccagagacacgtgtacaacctgcccaagggcagaaacaacatgttccacaccctgctgatgttcctgtacatcatcaagaccaaggagagcggcatgctgggcagagtgaacctgggcctgagcggcgtgaacatcctgtggatcttcggcgagtag

SEQ ID NO: 23407 - DNA, 612 bp, Artificial Sequence
  Description of Artificial Sequence: Synthetic coding sequence
atgatgcagggcgaggcccaccccagcgccagcctgatcgacagaaccatcaagatgagaaaggagaccgaggccagaaaggtggtgctggcctggggcctgctgaacgtgagcatggccggcatgatctacaccgagatgaccggcaagctgatcagcagctactacaacgtgacctactggcccctgtggtacatcgagctggccctggccagcctgttcagcctgaacgccctgttcgacttctggagatacttcaagtacaccgtggcccccaccagcctggtggtgagccccggccagcagaccctgctgggcctgaagaccgccgtggtgcagaccacccccccccacgacctggccgccacccagatcccccccgccccccccagccccagcatccagggccagagcgtgctgagctacagccccagcagaagccccagcaccagccccaagttcaccaccagctgcatgaccggctacagcccccagctgcagggcctgagcagcggcggcagcggcagctacagccccggcgtgacctacagccccgtgagcggctacaacaaggtgatgaccctgttcagctgcctggtgaccctgttctag

SEQ ID NO: 23408 - DNA, 390 bp, Artificial Sequence
  Description of Artificial Sequence: Synthetic coding sequence
atgctgctgggcggctggctgctgctggccttcaacgccatcttcctgctgagctgggccgtggcccccaagggcctgtgccccagaagaagcagcgtgcccatgcccggcgtgcaggccgtggccgccaccgccatgatcgtgggcctgctgatcttccccatcggcctggccagccccttcatcaaggaggtgtgcgaggccagcagcatgtactacggcggcaagtgcagactgggctggggctacatgaccgccatcctgaacgccgtgctggccagcctgctgcccatcatcagctggccccacaccaccaaggtgcagggcagaaccatcatcttcagcagcgccaccgagagaatcatcttcgtgcccgagatgaacaagtag

SEQ ID NO: 23409 - DNA, 390 bp, Artificial Sequence; identical to SEQ ID NO: 23408
  Description of Artificial Sequence: Synthetic coding sequence

SEQ ID NO: 23410 - DNA, 603 bp, Artificial Sequence
  Description of Artificial Sequence: Synthetic coding sequence
atgctgagcagcgtgtgggtggccctgggcctgagcctgacctgcaccagcgccttcagcctgatcagccccgcctggttccagacccccaccttcagcttcggcatcctgacctactgcagctggccccagggcaacagctggaaccagagctgcgtgaccttcagcagcctggaggacatccccgacttcgcctggaaggtgagcgccgtgatgctgctgggcggctggctgctgctggccttcaacgccatcttcctgctgagctgggccgtggcccccaagggcctgtgccccagaagaagcagcgtgcccatgcccggcgtgcaggccgtggccgccaccgccatgatcgtgggcctgctgatcttccccatcggcctggccagccccttcatcaaggaggtgtgcgaggccagcagcatgtactacggcggcaagtgcagactgggctggggctacatgaccgccatcctgaacgccgtgctggccagcctgctgcccatcatcagctggccccacaccaccaaggtgcagggcagaaccatcatcttcagcagcgccaccgagagaatcatcttcgtgcccgagatgaacaagtag

SEQ ID NO: 23411 - DNA, 474 bp, Artificial Sequence
  Description of Artificial Sequence: Synthetic coding sequence
atggtgttcccccccaacacccagcacaagttcaccagcggcagagtggccttccagctgctgcaggtgggcgtggacagccccgccgccggcaccagacacaacagcgccggccccgcccacctgcacagagccctgagcaccgccagcagcatgcagagactgcccgccgccaccagagccaccctgatcctgagcctggccttcgccagcctgcacagcgcctgcagcgccgccagcagcagcaacagcagcagcctgaccgcccaccaccccgaccccggcaccctggagcagtgcctgaacgtggacttctgcccccaggccgccagatgctgcagaaccggcgtggacgagtacggctggatcgccgccgccgtgggctggagcctgtggttcctgaccctgatcctgctgtgcgtggacaagctgatgaagctgacccccgacgagcccaaggacctgcaggcctag

SEQ ID NO: 23412 - DNA, 324 bp, Artificial Sequence
  Description of Artificial Sequence: Synthetic coding sequence
atgcagagactgcccgccgccaccagagccaccctgatcctgagcctggccttcgccagcctgcacagcgcctgcagcgccgaggccagcagcagcaacagcagcagcctgaccgcccaccaccccgaccccggcaccctggagcagtgcctgaacgtggacttctgcccccaggccgccagatgctgcagaaccggcgtggacgagtacggctggatcgccgccgccgtgggctggagcctgtggttcctgaccctgatcctgctgtgcgtggacaagctgatgaagctgacccccgacgagcccaaggacctgcaggcctag

SEQ ID NO: 23413 - DNA, 2070 bp, Artificial Sequence
  Description of Artificial Sequence: Synthetic coding sequence
atggccaccaagaccgccggcgtgggcagatgggaggtggtgaagaagggcagaagacccggcgtgggcgccggcgccggcggcagaggcggcggcagaaacagaagagccctgggcgaggccaacggcgtgtggaagtacgacctgacccccgccatccagaccaccagcaccctgtacgagagaggcttcgagaacatcatgaagagacagaacaaggagcaggtgcccccccccgccgtggagcccaagaagcccggcaacaagaagcagcccaagaaggtggccaccccccccaaccagaaccagaagcagggcagattcagaagcctggaggaggccctgaaggccctggacgtggccgacctgcagaaggagctggacaagagccagagcgtgttcagcggcaaccccagcatctggctgaaggacctggccagctacctgaactacaagctgcaggcccccctgagcgagcccaccctgagccagcacacccacgactacccctacagcctggtgagcagagagctgagaggcatcatcagaggcctgctggccaaggccgccggcagcctggagctgttcttcgaccactgcctgttcaccatgctgcaggagctggacaagacccccggcgagagcctgcacggctacagaatctgcatccaggccatcctgcaggacaagcccaagatcgccaccgccaacctgggcaagttcctggagctgctgagaagccaccagagcagacccgccaagtgcctgaccatcatgtgggccctgggccaggccggcttcgccaacctgaccgagggcctgaaggtgtggctgggcatcatgctgcccgtgctgggcatcaagagcctgagccccttcgccatcacctacctggacagactgctgctgatgcaccccaacctgaccaagggcttcggcatgatcggccccaaggacttcttccccctgctggacttcgcctacatgcccaacaacagcctgacccccagcctgcaggagcagctgtgccagctgtaccccagactgaaggtgctggccttcggcgccaagcccgacagcaccctgcacacctacttccccagcttcctgagcagagccacccccagctgcccccccgagatgaagaaggagctgctgagcagcctgaccgagtgcctgaccgtggaccccctgagcgccagcgtgtggagacagctgtaccccaagcacctgagccagagcagcctgctgctggagcacctgctgagcagctgggagcagatccccaagaaggtgcagaagagcctgcaggagaccatccagagcctgaagctgaccaaccaggagctgctgagaaagggcagcagcaacaaccaggacgtggtgacctgcgacatggcctgcaagggcctgctgcagcaggtgcagggccccagactgccctggaccagactgctgctgctgctgctggtgttcgccgtgggcttcctgtgccacgacctgagaagccacagcagcttccaggccagcctgaccggcagactgctgagaagcagcggcttcctgcccgccagccagcaggcctgcgccaagctgtacagctacagcctgcagggctacagctggctgggcgagaccctgcccctgtggggcagccacctgctgaccgtggtgagacccagcctgcagctggcctgggcccacaccaacgccaccgtgagcttcctgagcgcccactgcgccagccacctggcctggttcggcgacagcctgaccagcctgagccagagactgcagatccagctgcccgacagcgtgaaccagctgctgagatacctgagagagctgcccctgctgttccaccagaacgtgctgctgcccctgtggcacctgctgctggaggccctggcctgggcccaggagcactgccacgaggcctgcagaggcgaggtgacctgggactgcatgaagacccagctgagcgaggccgtgcactggacctggctgtgcctgcaggacatcaccgtggccttcctggactgggccctggccctgatcagccagcagtag

SEQ ID NO: 23414 - DNA, 2070 bp, Artificial Sequence; identical to SEQ ID NO: 23413
  Description of Artificial Sequence: Synthetic coding sequence

SEQ ID NO: 23415 - DNA, 1935 bp, Artificial Sequence
  Description of Artificial Sequence: Synthetic coding sequence
atggccaccaagaccgccggcgtgggcagatgggaggtggtgaagaagggcagaagacccggcgtgggcgccggcgccggcggcagaggcggcggcagaaacagaagagccctgggcgaggccaacggcgtgtggaagtacgacctgacccccgccatccagaccaccagcaccctgtacgagagaggcttcgagaacatcatgaagagacagaacaaggagcaggtgcccccccccgccgtggagcccaagaagcccggcaacaagaagcagcccaagaaggtggccaccccccccaaccagaaccagaagcagggcagattcagaagcctggaggaggccctgaaggccctggacgtggccgacctgcagaaggagctggacaagagccagagcgtgttcagcggcaaccccagcatctggctgaaggacctggccagctacctgaactacaagctgcaggcccccctgagcgagcccaccctgagccagcacacccacggcgagagcctgcacggctacagaatctgcatccaggccatcctgcaggacaagcccaagatcgccaccgccaacctgggcaagttcctggagctgctgagaagccaccagagcagacccgccaagtgcctgaccatcatgtgggccctgggccaggccggcttcgccaacctgaccgagggcctgaaggtgtggctgggcatcatgctgcccgtgctgggcatcaagagcctgagccccttcgccatcacctacctggacagactgctgctgatgcaccccaacctgaccaagggcttcggcatgatcggccccaaggacttcttccccctgctggacttcgcctacatgcccaacaacagcctgacccccagcctgcaggagcagctgtgccagctgtaccccagactgaaggtgctggccttcggcgccaagcccgacagcaccctgcacacctacttccccagcttcctgagcagagccacccccagctgcccccccgagatgaagaaggagctgctgagcagcctgaccgagtgcctgaccgtggaccccctgagcgccagcgtgtggagacagctgtaccccaagcacctgagccagagcagcctgctgctggagcacctgctgagcagctgggagcagatccccaagaaggtgcagaagagcctgcaggagaccatccagagcctgaagctgaccaaccaggagctgctgagaaagggcagcagcaacaaccaggacgtggtgacctgcgacatggcctgcaagggcctgctgcagcaggtgcagggccccagactgccctggaccagactgctgctgctgctgctggtgttcgccgtgggcttcctgtgccacgacctgagaagccacagcagcttccaggccagcctgaccggcagactgctgagaagcagcggcttcctgcccgccagccagcaggcctgcgccaagctgtacagctacagcctgcagggctacagctggctgggcgagaccctgcccctgtggggcagccacctgctgaccgtggtgagacccagcctgcagctggcctgggcccacaccaacgccaccgtgagcttcctgagcgcccactgcgccagccacctggcctggttcggcgacagcctgaccagcctgagccagagactgcagatccagctgcccgacagcgtgaaccagctgctgagatacctgagagagctgcccctgctgttccaccagaacgtgctgctgcccctgtggcacctgctgctggaggccctggcctgggcccaggagcactgccacgaggcctgcagaggcgaggtgacctgggactgcatgaagacccagctgagcgaggccgtgcactggacctggctgtgcctgcaggacatcaccgtggccttcctggactgggccctggccctgatcagccagcagtag

SEQ ID NO: 23416 - DNA, 483 bp, Artificial Sequence
  Description of Artificial Sequence: Synthetic coding sequence
atggccaccaagaccgccggcgtgggcagatgggaggtggtgaagaagggcagaagacccggcgtgggcgccggcgccggcggcagaggcggcggcagaaacagaagagccctgggcgaggccaacggcgtgtggaagtacgacctgacccccgccatccagaccaccagcaccctgtacgagagaggcttcgagaacatcatgaagagacagaacaaggagcaggtgcccccccccgccgtggagcccaagaagcccggcaacaagaagcagcccaagaaggtggccaccccccccaaccagaaccagaagcagggcagattcagaagcctggaggaggccctgaaggccctggacgtggccgacctgcagaaggagctggacaagagccagagcgtgttcagcggcaaccccagcatctggctgaaggacctggccagctacctgaactacaagctgcaggcccccgagcagcccgactag

SEQ ID NO: 23417 - DNA, 1290 bp, Artificial Sequence
  Description of Artificial Sequence: Synthetic coding sequence
atgtgggccctgggccaggccggcttcgccaacctgaccgagggcctgaaggtgtggctgggcatcatgctgcccgtgctgggcatcaagagcctgagccccttcgccatcacctacctggacagactgctgctgatgcaccccaacctgaccggcctgagacacgactggccccagggcctgctgcccaccagcggcctgtgcctgtacgccgagcagctgcccgacacccagcccgccggcgcctgccagctgtaccccagactgaaggtgctggccttcggcgccaagcccgacagcaccctgcacacctacttccccagcttcctgagcagagccacccccagctgcccccccgagatgaagaaggagctgctgagcagcctgaccgagtgcctgaccgtggaccccctgagcgccagcgtgtggagacagctgtaccccaagcacctgagccagagcagcctgctgctggagcacctgctgagcagctgggagcagatccccaagaaggtgcagaagagcctgcaggagaccatccagagcctgaagctgaccaaccaggagctgctgagaaagggcagcagcaacaaccaggacgtggtgacctgcgacatggcctgcaagggcctgctgcagcaggtgcagggccccagactgccctggaccagactgctgctgctgctgctggtgttcgccgtgggcttcctgtgccacgacctgagaagccacagcagcttccaggccagcctgaccggcagactgctgagaagcagcggcttcctgcccgccagccagcaggcctgcgccaagctgtacagctacagcctgcagggctacagctggctgggcgagaccctgcccctgtggggcagccacctgctgaccgtggtgagacccagcctgcagctggcctgggcccacaccaacgccaccgtgagcttcctgagcgcccactgcgccagccacctggcctggttcggcgacagcctgaccagcctgagccagagactgcagatccagctgcccgacagcgtgaaccagctgctgagatacctgagagagctgcccctgctgttccaccagaacgtgctgctgcccctgtggcacctgctgctggaggccctggcctgggcccaggagcactgccacgaggcctgcagaggcgaggtgacctgggactgcatgaagacccagctgagcgaggccgtgcactggacctggctgtgcctgcaggacatcaccgtggccttcctggactgggccctggccctgatcagccagcagtag

SEQ ID NO: 23418 - DNA, 708 bp, Artificial Sequence
  Description of Artificial Sequence: Synthetic coding sequence
atgagacccgacgacatcaaccccagaaccggcctggtggtggccctggtgagcgtgttcctggtgttcggcttcatgttcaccgtgagcggcatgaagggcgagaccctgggcaacatccccctgctggccatcggccccgccatctgcctgcccggcatcgccgccatcgccctggccagaaagaccgagggctgcaccaagtggcccgagaacgagctgctgtgggtgagaaagctgccctgcttcagaaagcccaaggacaaggaggtggtggagctgctgagaacccccagcgacctggagagcggcaagggcagcagcgacgagctggccaagaaggccggcctgagaggcaagccccccccccagagccagggcgaggtgagcgtggccagcagcatcaacagccccacccccaccgaggagggcgagtgccagagcctggtgcagaacggccaccaggaggagaccagcagatacctggacggctactgccccagcggcagcagcctgacctacagcgccctggacgtgaagtgcagcgccagagacagaagcgagtgccccgagcccgaggacagcatcttcttcgtgccccaggacagcatcatcgtgtgcagctacaagcagaacagcccctacgacagatactgctgctacatcaaccagatccagggcagatgggaccacgagaccatcgtgtag

SEQ ID NO: 23419 - DNA, 690 bp, Artificial Sequence
  Description of Artificial Sequence: Synthetic coding sequence
atgaagcagcagcagtggtgcggcatgaccgccaagatgggcaccgtgctgagcggcgtgttcaccatcatggccgtggacatgtacctgatcttcgagcagaagcacctgggcaacggcagctgcaccgagatcacccccaagtacagaggcgccagcaacatcatcaacaacttcatcatctgctggagcttcaagatcgtgctgttcctgagcttcatcaccatcctgatcagctgcttcctgctgtacagcgtgtacgcccagatcttcagaggcctggtgatctacatcgtgtggatcttcttctacgagaccgccaacgtggtgatccagatcctgaccaacaacgacttcgacatcaaggaggtgagaatcatgagatggttcggcctggtgagcagaaccgtgatgcactgcttctggatgttcttcgtgatcaactacgcccacatcacctacaagaacagaagccagggcaacatcatcagctacaagagaagaatcagcaccgccgagatcctgcacagcagaaacaagagactgagcatcagcagcggcttcagcggcagccacctggagagccagtacttcgagagacagagcttccacaccagcatcttcacctgcctgagccccgtgcccagcagcgcccccagcacctgcagatacaccatcgacgtgtgctag

SEQ ID NO: 23420 - DNA, 636 bp, Artificial Sequence
  Description of Artificial Sequence: Synthetic coding sequence
atgaagcagcagcagtggtgcggcatgaccgccaagatgggcaccgtgctgagcggcgtgttcaccatcatggccgtggacatgtacctgatcttcgagcagaagcacctgggcaacggcagctgcaccgagatcacccccaagtacagaggcgccagcaacatcatcaacaacttcatcatctgctggagcttcaagatcgtgctgttcctgagcttcatcaccatcctgatcagctgcttcctgctgtacagcgtgtacgcccagatcttcagaggcctggtgatctacatcgtgtggatcttcttctacgagaccgccaacgtggtgatccagatcctgaccaacaacgacttcgacatcaaggaggtgagaatcatgagatggttcggcctggtgagcagaaccgtgatgcactgcttctggatgttcttcgtgatcaactacgcccacatcacctacaagaacagaagccagggcaacatcatcagctacaagagaagaatcagcaccgccgagatcctgcacagcagaaacaagagactgagcatcagcagcggcttcagcggcagccacctggagagccagtacttcgagagacagagaagatgcagcggcaagaccagcatcaagtag

SEQ ID NO: 23421 - DNA, 348 bp, Artificial Sequence
  Description of Artificial Sequence: Synthetic coding sequence
atggccggcaccgtgctgggcgtgggcgccggcgtgttcatcctggccctgctgtgggtggccgtgctgctgctgtgcgtgctgctgagcagagccagcggcgccgccagattcagcgtgatcttcctgttcttcggcgccgtgatcatcaccagcgtgctgctgctgttccccagagccggcgagttccccgcccccgaggtggaggtgaagatcgtggacgacttcttcatcggcagatacgtgctgctggccttcctgagcgccatcttcctgggcggcctgttcctggtgctgatccactacgtgctggagcccatctacgccaagcccctgcacagctactag

SEQ ID NO: 23422 - DNA, 348 bp, Artificial Sequence; identical to SEQ ID NO: 23421
  Description of Artificial Sequence: Synthetic coding sequence

SEQ ID NO: 23423 - DNA, 348 bp, Artificial Sequence; identical to SEQ ID NO: 23421
  Description of Artificial Sequence: Synthetic coding sequence

SEQ ID NO: 23424 - DNA, 348 bp, Artificial Sequence; identical to SEQ ID NO: 23421
  Description of Artificial Sequence: Synthetic coding sequence

SEQ ID NO: 23425 - DNA, 348 bp, Artificial Sequence; identical to SEQ ID NO: 23421
  Description of Artificial Sequence: Synthetic coding sequence

SEQ ID NO: 23426 - DNA, 348 bp, Artificial Sequence; identical to SEQ ID NO: 23421
  Description of Artificial Sequence: Synthetic coding sequence

SEQ ID NO: 23427 - DNA, 348 bp, Artificial Sequence; identical to SEQ ID NO: 23421
  Description of Artificial Sequence: Synthetic coding sequence

SEQ ID NO: 23428 - DNA, 348 bp, Artificial Sequence; identical to SEQ ID NO: 23421
  Description of Artificial Sequence: Synthetic coding sequence

SEQ ID NO: 23429 - DNA, 723 bp, Artificial Sequence
  Description of Artificial Sequence: Synthetic coding sequence
atgggcaactgccaggccggccacaacctgcacctgtgcctggcccaccacccccccctggtgtgcgccaccctgatcctgctgctgctgggcctgagcggcctgggcctgggcagcttcctgctgacccacagaaccggcctgagaagccccgacatcccccaggactgggtgagcttcctgagaagcttcggccagctgaccctgtgccccagaaacggcaccgtgaccggcaagtggagaggcagccacgtggtgggcctgctgaccaccctgaacttcggcgacggccccgacagaaacaagaccagaaccttccaggccaccgtgctgggcagccagatgggcctgaagggcagcagcgccggccagctggtgctgatcaccgccagagtgaccaccgagagaaccgccggcacctgcctgtacttcagcgccgtgcccggcatcctgcccagcagccagccccccatcagctgcagcgaggagggcgccggcaacgccaccctgagccccagaatgggcgaggagtgcgtgagcgtgtggagccacgagggcctggtgctgaccaagctgctgaccagcgaggagctggccctgtgcggcagcagactgctggtgctgggcagcttcctgctgctgttctgcggcctgctgtgctgcgtgaccgccatgtgcttccaccccagaagagagagccactggagcagaaccagactgtag

SEQ ID NO: 23430 - DNA, 723 bp, Artificial Sequence; identical to SEQ ID NO: 23429
  Description of Artificial Sequence: Synthetic coding sequence

SEQ ID NO: 23431 - DNA, 1239 bp, Artificial Sequence
  Description of Artificial Sequence: Synthetic coding sequence
atggacaccagccccagcagaaagtaccccgtgaagaagagagtgaagatccaccccaacaccgtgatggtgaagtacaccagccactacccccagcccggcgacgacggctacgaggagatcaacgagggctacggcaacttcatggaggagaaccccaagaagggcctgctgagcgagatgaagaagaagggcagagccttcttcggcaccatggacaccctgcccccccccaccgaggaccccatgatcaacgagatcggccagttccagagcttcgccgagaagaacatcttccagagcagaaagatgtggatcgtgctgttcggcagcgccctggcccacggctgcgtggccctgatcaccagactggtgagcgacagaagcaaggtgcccagcctggagctgatcttcatcagaagcgtgttccaggtgctgagcgtgctggtggtgtgctactaccaggaggcccccttcggccccagcggctacagactgagactgttcttctacggcgtgtgcaacgtgatcagcatcacctgcgcctacaccagcttcagcatcgtgccccccagcaacggcaccaccatgtggagagccaccaccaccgtgttcagcgccatcctggccttcctgctggtggacgagaagatggcctacgtggacatggccaccgtggtgtgcagcatcctgggcgtgtgcctggtgatgatccccaacatcgtggacgaggacaacagcctgctgaacgcctggaaggaggccttcggctacaccatgaccgtgatggccggcctgaccaccgccctgagcatgatcgtgtacagaagcatcaaggagaagatcagcatgtggaccgccctgttcaccttcggctggaccggcaccatctggggcatcagcaccatgttcatcctgcaggagcccatcatccccctggacggcgagacctggagctacctgatcgccatctgcgtgtgcagcaccgccgccttcctgggcgtgtactacgccctggacaagttccaccccgccctggtgagcaccgtgcagcacctggagatcgtggtggccatggtgctgcagctgctggtgctgcacatcttccccagcatctacgacgtgttcggcggcgtgatcatcatgatcagcgtgttcgtgctggccggctacaagctgtactggagaaacctgagaaagcaggactaccaggagatcctggacagccccatcaagtag

SEQ ID NO: 23432 - DNA, 1239 bp, Artificial Sequence; identical to SEQ ID NO: 23431
  Description of Artificial Sequence: Synthetic coding sequence

SEQ ID NO: 23433 - DNA, 483 bp, Artificial Sequence
  Description of Artificial Sequence: Synthetic coding sequence
atggcccccgccctgtggagagcctgcaacggcctgatggccgccttcttcgccctggccgccctggtgcaggtgaacgaccccgacgccgaggtgtgggtggtggtgtacaccatccccgccgtgctgaccctgctggtgggcctgaaccccgaggtgaccggcaacgtgatctggaagagcatcagcgccatccacatcctgttctgcaccgtgtgggccgtgggcctggccagctacctgctgcacagaacccagcagaacatcctgcacgaggaggagggcagagagctgagcggcctggtgatcatcaccgcctggatcatcctgtgccacagcagcagcaagaaccccgtgggcggcagaatccagctggccatcgccatcgtgatcaccctgttccccttcatcagctgggtgtacatctacatcaacaaggagatgagaagcagctggcccacccactgcaagaccgtgatctag

SEQ ID NO: 23434 - DNA, 453 bp, Artificial Sequence
  Description of Artificial Sequence: Synthetic coding sequence
atggcccccgccctgtggagagcctgcaacggcctgatggccgccttcttcgccctggccgccctggtgcaggtggtgtacaccatccccgccgtgctgaccctgctggtgggcctgaaccccgaggtgaccggcaacgtgatctggaagagcatcagcgccatccacatcctgttctgcaccgtgtgggccgtgggcctggccagctacctgctgcacagaacccagcagaacatcctgcacgaggaggagggcagagagctgagcggcctggtgatcatcaccgcctggatcatcctgtgccacagcagcagcaagaaccccgtgggcggcagaatccagctggccatcgccatcgtgatcaccctgttccccttcatcagctgggtgtacatctacatcaacaaggagatgagaagcagctggcccacccactgcaagaccgtgatctag

SEQ ID NO: 23435 - DNA, 603 bp, Artificial Sequence
  Description of Artificial Sequence: Synthetic coding sequence
atgaagcagtaccagggcagcggcggcgtggccatggacgtggagagaagcagattcccctactgcgtggtgtggacccccatccccgtgctgacctggttcttccccatcatcggccacatgggcatctgcaccagcaccggcgtgatcagagacttcgccggcccctacttcgtgagcgaggacaacatggccttcggcaagcccgccaagtgccacctgcaggaggccttcagccaccccatcctggtgagaagcggctgccacaacaagatcagcagcatcggctactggaagctggaccccgcccaggtgtacgccagcggccccaacgcctgggacaccgccgtgcacgacgccagcgaggagtacaagcacagaatgcacaacctgtgctgcgacaactgccacagccacgtggccctggccctgaacctgatgagatacaacaacagcaccaactggaacatggtgaccctgtgcttcttctgcctgctgtacggcaagtacgtgagcgtgggcgccttcgtgaagacctggctgcccttcatcctgctgctgggcatcatcctgaccgtgagcctggtgttcaacctgagatag

SEQ ID NO: 23436 - DNA, 627 bp, Artificial Sequence
  Description of Artificial Sequence: Synthetic coding sequence
atggccgaggccgagggcagcagcctgctgctgctgcccccccccccccccccccccagaatggccgaggtggaggcccccaccgccgccgagaccgacatgaagcagtaccagggcagcggcggcgtggccatggacgtggagagaagcagattcccctactgcgtggtgtggacccccatccccgtgctgacctggttcttccccatcatcggccacatgggcatctgcaccagcaccggcgtgatcagagacttcgccggcccctacttcgtgagcgaggacaacatggccttcggcaagcccgccaagtactggaagctggaccccgcccaggtgtacgccagcggccccaacgcctgggacaccgccgtgcacgacgccagcgaggagtacaagcacagaatgcacaacctgtgctgcgacaactgccacagccacgtggccctggccctgaacctgatgagatacaacaacagcaccaactggaacatggtgaccctgtgcttcttctgcctgctgtacggcaagtacgtgagcgtgggcgccttcgtgaagacctggctgcccttcatcctgctgctgggcatcatcctgaccgtgagcctggtgttcaacctgagatag

SEQ ID NO: 23437 - DNA, 609 bp, Artificial Sequence
  Description of Artificial Sequence: Synthetic coding sequence
atggccgccccctggagaagatggcccaccggcctgctggccgtgctgagacccctgctgacctgcagacccctgcagggcaccaccctgcagagagacgtgctgctgttcgagcacgacagaggcagattcttcaccatcctgggcctgttctgcgccggccagggcgtgttctgggccagcatggccgtggccgccgtgagcagaccccccgtgcccgtgcagcccctggacgccgaggtgcccaacagaggccccttcgacctgagaagcgccctgtggagatacggcctggccgtgggctgcggcgccatcggcgccctggtgctgggcgccggcctgctgttcagcctgagaagcgtgagaagcgtggtgctgagagccggcggccagcaggtgaccctgaccacccacgcccccttcggcctgggcgcccacttcaccgtgcccctgaagcaggtgagctgcatggcccacagaggcgaggtgcccgccatgctgcccctgaaggtgaagggcagaagattctacttcctgctggacaagaccggccacttccccaacaccaagctgttcgacaacaccgtgggcgcctacagaagcctgtag

SEQ ID NO: 23438 - DNA, 678 bp, Artificial Sequence
  Description of Artificial Sequence: Synthetic coding sequence
atggtgcacgtgagcaacagaagcatccagggcatgaacatcctgttcagcagctgggccgtggtgctgatggtgatgggcatcaccctggacaagtgggtggagctgatcagcgaggacgagagagccaagatgaaccacagcccctggatgatgtgctgccccgccctgtggcccgaggacgacctgaaggtggtgagaatcatgatgaccagcagcctgggcctgagcttcctgctgaacctgatcctgggcatgaagttcacctacctgatcccccagaacaagtacatccagctgttcaccaccatcctgagcttcttcagcggcatcagcctgctgtgggccctgatcctgtaccacaacaagctgaagcagggccagagcatgcacttcagcaactacagaatcacctggatcatgtacaccgcctacctgaacgtgttcttcctgagcgtgtgcggcgtgctgagcctgctggagtgcaagctgagcaccagcagctgcacctgcctgaacatccacaagagcgacaacgagtgcaaggagagcgagaacagcatcgaggacatcagcctgcccgagtgcaccgccatgcccagaagcatcgtgagagcccacaccgtgaacagcctgaacaagaaggtgcagaccagacacgtgacctgggccctgtag

SEQ ID NO: 23439 - DNA, 1143 bp, Artificial Sequence
  Description of Artificial Sequence: Synthetic coding sequence
atggccggcagcgacgtggacagcgagggccccgccagaagaggcggcgccgccagaagacccggcgcccccggcggccccggcagcgaggccgccgccggctgccccgagcccctgagcaccgccgaggcccccgccgagagcgccaccctgcccgcctggatgagactgtacttctacggcatgcacggcatcaccctggacgtgctggtgagcagcgccagaagattcgccagaagccccgacctgagaatgctgggcttcagcagcccctacagatgcctgctgcacagcctgacccacttcgccctggagaaggtgtacctgcagcagagaagatgccccaacgccttcgtgttcaacttcctgctgtaccccagcgcccacgtgggcctgcagaccctggccggccaggccctgctgctgagcctgggcggcggcgccggcgtggccgtggcccccggcgccctggacctggccctgcagtacgtgctggccctgtaccactgccaggtgttcctgaagagattcctgagactgagatacggcagacagagaagaagacagcagcagcagcagcagcagcagcagcagcagcagagaagaggcgccctgcccgtgccccccggcgccagagtgcccaccgccgccggcgccagaagaagaagacccagaggccccagaggcgccggcggcgcccccagccagggcctgcccgacctgcccagattcctgttcttcggcatgcacggcttcctggacgagatcttcttcaccttcttcttcaacgtgctgggccagggcgacggcaccaccagcggccacaccagcctgtggagcttcttcatgtacggcagctgcagcttcgtggtggagaagctgtacttccacctgcactacagcagaggctggggcacctggaagagagtgcccatctacgtgatcttcatctacgtgtgggagctgagctggggcctgggcctgagaacctgcggcgcctgcagctgggactacagccactaccccctgaacttcatgggcctgatcaccctgatgtacctgcccggctggatcttcctgagcgtgtaccaggacctgatcagcaacgtgctgtggagagtgcagtacgtgcccgccaactag

SEQ ID NO: 23440 - DNA, 504 bp, Artificial Sequence
  Description of Artificial Sequence: Synthetic coding sequence
atggccagcgccgagcccctgaccgccctgagcagatggtacctgtacgccatccacggctacttctgcgaggtgatgttcaccgccgcctgggagttcgtggtgaacctgaactggaagttccccggcgtgaccagcgtgtgggccctgttcatctacggcaccagcatcctgatcgtggagagaatgtacctgagactgagaggcagatgccccctgctgctgagatgcctgatctacaccctgtggacctacctgtgggagttcaccaccggcttcatcctgagacagttcaacgcctgcccctgggactacagccagttcgacttcgacttcatgggcctgatcaccctggagtacgccgtgccctggttctgcggcgccctgatcatggagcagttcatcatcagaaacaccctgagactgagattcgacaaggacgccgagcccggcgagcccagcggcgccctggccctggccaacggccacgtgaagaccgactag

SEQ ID NO: 23441 - DNA, 405 bp, Artificial Sequence
  Description of Artificial Sequence: Synthetic coding sequence
atggccagcgccgagcccctgaccgccctgagcagatggtacctgtacgccatccacggctacttctgcgaggtgatgttcaccgccgcctgggagttcgtggtgaacctgaactggaagttccccggcgtgaccagcgtgtgggccctgttcatctacggcaccagcatcctgatcgtggagagaatgtacctgagactgagaggcagatgccccctgctgctgagatgcctgatctacaccctgtggacctacctgtgggagttcaccaccggcttcatcctgagacagttcaacgcctgcccctgggactacagccagttcgacttcgacttcatgggcctgatcaccctggagtacgccgtgccctggttctgcggcgccctgatcatggagcagttctag

SEQ ID NO: 23442 - DNA, 240 bp, Artificial Sequence
  Description of Artificial Sequence: Synthetic coding sequence
atggccagcgccgagcccctgaccgccctgagcagatggtacctgtacgccatccacggctacttctgcgaggtgatgttcaccgccgcctgggagttcgtggtgaacctgaactggaagttccccggcgtgaccagcgtgtgggccctgttcatctacggcaccagcatcctgatcgtggagagaatgtacctgagactgagaggcagatgccccctgctgctgagatgcctgatctag

SEQ ID NO: 23443 - DNA, 504 bp, Artificial Sequence; identical to SEQ ID NO: 23440
  Description of Artificial Sequence: Synthetic coding sequence

SEQ ID NO: 23444 - DNA, 171 bp, Artificial Sequence
  Description of Artificial Sequence: Synthetic coding sequence
atggccagcgccgagcccctgaccgccctgagcagatggtacctgtacgccatccacggctacttctgcgaggtgatgttcaccgccgcctgggagttcgtggtgaacctgaactggaagttccccggcgtgaccagcgtgtgggccctgttcatctacggcaccagctag

SEQ ID NO: 23445 - DNA, 504 bp, Artificial Sequence; identical to SEQ ID NO: 23440
  Description of Artificial Sequence: Synthetic coding sequence

SEQ ID NO: 23446 - DNA, 168 bp, Artificial Sequence
  Description of Artificial Sequence: Synthetic coding sequence
atggccagcgccgagcccctgaccgccctgagcagatggtacctgtacgccatccacggctacttctgcgaggtgatgttcaccgccgcctgggagttcgtggtgaacctgaactggaagttccccggcgtgaccagcgtgtgggccctgttcatctacggcacctag

SEQ ID NO: 23447 - DNA, 951 bp, Artificial Sequence
  Description of Artificial Sequence: Synthetic coding sequence
atggccctgtacgagctgttcagccaccccgtggagagaagctacagagccggcctgtgcagcaaggccgccctgttcctgctgctggccgccgccctgacctacatcccccccctgctggtggccttcagaagccacggcttctggctgaagagaagcagctacgaggagcagcccaccgtgagattccagcaccaggtgctgctggtggccctgctgggccccgagagcgacggcttcctggcctggagcaccttccccgccttcaacagactgcagggcgacagactgagagtgcccctggtgagcaccagagaggaggacagaaaccaggacggcaagaccgacatgctgcacttcaagctggagctgcccctgcagagcaccgagcacgtgctgggcgtgcagctgatcctgaccttcagctacagactgcacagaatggccaccctggtgatgcagagcatggccttcctgcagagcagcttccccgtgcccggcagccagctgtacgtgaacggcgacctgagactgcagcagaagcagcccctgagctgcggcggcctggacgccagatacaacatcagcgtgatcaacggcaccagccccttcgcctacgactacgacctgacccacatcgtggccgcctaccaggagagaaacgtgaccaccgtgctgaacgaccccaaccccatctggctggtgggcagagccgccgacgcccccttcgtgatcaacgccatcatcagataccccgtggaggtgatcagctaccagcccggcttctgggagatggtgaagttcgcctgggtgcagtacgtgagcatcctgctgatcttcctgtgggtgttcgagagaatcaagatcttcgtgttccagaaccaggtggtgaccaccatccccgtgaccgtgacccccagaggcgacctgtgcaaggagcacctgagctag

SEQ ID NO: 23448 - DNA, 1038 bp, Artificial Sequence
  Description of Artificial Sequence: Synthetic coding sequence
atgagcagcagcctgaccagaagcagcgccgtgaccgccagaggcagcgcccccaagcccagatgcagctgctgctggcccctgagaagcagaaccagcagaagatgctggtggcccagcggcgccaccgtgagcctgcccagacccctgtgccacgaggcccccagagccagaagcgccagagccggcctgcccaacagactgcccaccgccctgttcaacagcggcttctggctgaagagaagcagctacgaggagcagcccaccgtgagattccagcaccaggtgctgctggtggccctgctgggccccgagagcgacggcttcctggcctggagcaccttccccgccttcaacagactgcagggcgacagactgagagtgcccctggtgagcaccagagaggaggacagaaaccaggacggcaagaccgacatgctgcacttcaagctggagctgcccctgcagagcaccgagcacgtgctgggcgtgcagctgatcctgaccttcagctacagactgcacagaatggccaccctggtgatgcagagcatggccttcctgcagagcagcttccccgtgcccggcagccagctgtacgtgaacggcgacctgagactgcagcagaagcagcccctgagctgcggcggcctggacgccagatacaacatcagcgtgatcaacggcaccagccccttcgcctacgactacgacctgacccacatcgtggccgcctaccaggagagaaacgtgaccaccgtgctgaacgaccccaaccccatctggctggtgggcagagccgccgacgcccccttcgtgatcaacgccatcatcagataccccgtggaggtgatcagctaccagcccggcttctgggagatggtgaagttcgcctgggtgcagtacgtgagcatcctgctgatcttcctgtgggtgttcgagagaatcaagatcttcgtgttccagaaccaggtggtgaccaccatccccgtgaccgtgacccccagaggcgacctgtgcaaggagcacctgagctag

SEQ ID NO: 23449 - DNA, 1521 bp, Artificial Sequence
  Description of Artificial Sequence: Synthetic coding sequence
atgaacatgcccgtgaacaagagccccatgatcaacacctgcggcggcatcagcagcccctaccacgaggagctgtggaagctgaacttccagcacctgagcggcgagagaggccacaagagcagacccaccttcagcatcaccaaggagttcatcctgagattcaaccagacccagaacagcaaggagaaggaggagctgctggagctggccagaaagatcatcctgagatgcaagagaaagctgggcctgaagaccctgggcagcggcagacacgtgcacctgcccgccgcctggaccgaggtgatctacctggcccagtgcaagggcgagatccaggacgagagcctgaacatgctgtacgccagcctggaccacgccagcttcgactacgaccacctgcccgccctgttcttcgtggccgagagcgtgctgtacagactgtgctgcgacgccagcctgaagacctacctgtacagcgtggagatcaagctggccaagatcggctacctggtgttcctgagactgttcatcttcttcctgcacggccacctggagagcttcaagcagcacctgctgagactgcagccctacctgtacgccctgagcttcagcggcgccagctaccacaagtaccccaacatcttcagcaacgtgcagttcatcctgaaggccagcgagatcatcggcaagagagagctgagaagcgagagcatcttcagacccgtggaggacaagaagagatacgagaacaccgacagcgacatgggcggctacgagatcaaccacctgctgtggcactgcgtggccgcctggagctgcgtgcagaacaacagcccccagctgaacaacgtgctggagcacctggtgttccacaagacccagctgcagaagaagtgctggctggacagcgtgctggccctgctggtgctgggcgaggccgccaagctgaacatggcctgcctgaaggccctgatggacgtggtgagagacttcgtgagcagcatcatgagcgtgcagaaccaggaggagagctgcaaggtggacgacttcagctgggcctggaacgtggtgtacatctacaccgtgatcctggccgagatctgcctgtacgccgccaccagcgacctgagaaagaccgccctgatcggcttctgccactgcaagagcagccagaagaacatcctgtacctggacaagagcgtgccccccgagctgaaggagaccagcatcctgagcctgctggagtacttcagcagcaagatgagcgagaactgcgaccaggtggtgtggaccggctactacggcctggtgtacaacctggtgaagatcagctgggagctgcagggcgacgaggagcaggacggcctgagaaacatgatctggcagaccctgcagaagaccaaggactacgaggaggacgtgagaatccagaacgccatcaacatcgcccagggcaccagcttctgcatcagaaacagccacgtgagcatcagcagattcctgcaccagggcagatag

SEQ ID NO: 23450 - DNA, 1974 bp, Artificial Sequence
  Description of Artificial Sequence: Synthetic coding sequence
atgaacatgcccgtgaacaagagccccatgatcaacacctgcggcggcatcagcagcccctaccacgaggagctgtggaagctgaacttccagcacctgagcggcgagagaggccacaagagcagacccaccttcagcatcaccaaggagttcatcctgagattcaaccagacccagaacagcaaggagaaggaggagctgctggagctggccagaaagatcatcctgagatgcaagagaaagctgggcctgaagaccctgggcagcggcagacacgtgcacctgcccgccgcctggaccgaggtgatctacctggcccagtgcaagggcgagatccaggacgagagcctgaacatgctgtacgccagcctggaccacgccagcttcgactacgaccacctgcccgccctgttcttcgtggccgagagcgtgctgtacagactgtgctgcgacgccagcctgaagacctacctgtacagcgtggagatcaagctggccaagatcggctacctggtgttcctgagactgttcatcttcttcctgcacggccacctggagagcttcaagcagcacctgctgagactgcagccctacctgtacgccctgagcttcagcggcgccagctaccacaagtaccccaacatcttcagcaacgtgcagttcatcctgaaggccagcgagatcatcggcaagagagagctgagaagcgagagcatcttcagacccgtggaggacaagaagagatacgagaacaccgacagcgacatgggcggctacgagatcaaccacctgctgtggcactgcgtggccgcctggagctgcgtgcagaacaacagcccccagctgaacaacgtgctggagcacctggtgttccacaagacccagctgcagaagaagtgctggctggacagcgtgctggccctgctggtgctgggcgaggccgccaagctgaacatggcctgcctgaaggccctgatggacgtggtgagagacttcgtgagcagcatcatgagcgtgcagaaccaggaggagagctgcaaggtggacgacttcagctgggcctggaacgtggtgtacatctacaccgtgatcctggccgagatctgcctgtacgccgccaccagcgacctgagaaagaccgccctgatcggcttctgccactgcaagagcagccagaagaacatcctgtacctggacaagagcgtgccccccgagctgaaggagaccagcatcctgagcctgctggagtacttcagcagcaagatgagcgagaactgcgaccaggtggtgtggaccggctactacggcctggtgtacaacctggtgaagatcagctgggagctgcagggcgacgaggagcaggacggcctgagaaacatgatctggcagaccctgcagaagaccaaggactacgaggaggacgtgagaatccagaacgccatcaacatcgcccaggccgagctgaacgaccccaccgaccccttcaccagatacagcaccaacatcagcagcaacgtgggcgaggaggtgttcagcaagtacatcggctggagaatcgccaacaccctgagcaagctgttcttcccccccatcgaggcccacttcctgcccctgaagaagcccagcatcaagaaggaccagaccaagtaccccaacaagaagctggagagcgtgaagaagcaggtgctgcacttcaccgtgagagagcaccccagcgtgagcgagatccccatgttcccctaccccgacttcttcaccaaggccgacaaggagctggccaagatcatcgaccaccactggcaggaggagctgaagatcagagagaaggaggacgccatctgcaaggcccaggagctgaaggacaagaagctggccgagaagaaccacttccaggaggtgatgaagaagagagaggagaagctgcacaagcagaccaagccctacgagctgccctacagaaaggaggtgatctag

SEQ ID NO: 23451 - DNA, 330 bp, Artificial Sequence
  Description of Artificial Sequence: Synthetic coding sequence
atgagccagtacgcccccagccccgacttcaagagagccctggacagcagccccgaggccaacaccgaggacgacaagaccgaggaggacgtgcccatgcccaagaactacctgtggctgaccatcgtgagctgcttctgccccgcctaccccatcaacatcgtggccctggtgttcagcatcatgagcctgaacagctacaacgacggcgactacgagggcgccagaagactgggcagaaacgccaagtgggtggccatcgccagcatcatcatcggcctgctgatcatcggcatcagctgcgccgtgcacttcaccagaaacgcctag

SEQ ID NO: 23452 - DNA, 423 bp, Artificial Sequence
  Description of Artificial Sequence: Synthetic coding sequence
atggccgccagcctgggccaggtgctggccctggtgctggtggccgccctgtggggcggcacccagcccctgctgaagagagccagcgccggcctgcagagagtgcacgagcccacctgggcccagcagctgctgcaggagatgaagaccctgttcctgaacaccgagtacctgatgcccttcctgctgaaccagtgcggcagcctgctgtactacctgaccctggccagcaccgacctgaccctggccgtgcccatctgcaacagcctggccatcatcttcaccctgatcgtgggcaaggccctgggcgaggacatcggcggcaagagagccgtggccggcatggtgctgaccgtgatcggcatcagcctgtgcatcaccagcagcgtgagcaagacccagggccagcagagcaccctgtag

SEQ ID NO: 23453 - DNA, 495 bp, Artificial Sequence
  Description of Artificial Sequence: Synthetic coding sequence
atggccgccagcctgggccaggtgctggccctggtgctggtggccgccctgtggggcggcacccagcccctgctgaagagagccagcgccggcctgcagagagtgcacgagcccacctgggcccagcagctgctgcaggagatgaagaccctgttcctgaacaccgagtacctgatgcccttcctgctgaaccagtgcggcagcctgctgtactacctgaccctggccagcaccgacctgaccctggccgtgcccatctgcaacagcctggccatcatcttcaccctgatcgtgggcaaggccctgggcgaggacatcggcggcaagagagccgtggccggcatggtgctgaccgtgatcggcatcagcctgtgcatcaccagcagcgtgccctggaccgccgagctgcagctgcacggcaagggccagctgcagaccctgagccagaagtgcaagagagaggccagcggcacccagagcgagagattcggctag

SEQ ID NO: 23454 - DNA, 495 bp, Artificial Sequence; identical to SEQ ID NO: 23453
  Description of Artificial Sequence: Synthetic coding sequence

SEQ ID NO: 23455 - DNA, 495 bp, Artificial Sequence; identical to SEQ ID NO: 23453
  Description of Artificial Sequence: Synthetic coding sequence

SEQ ID NO: 23456 - DNA, 495 bp, Artificial Sequence; identical to SEQ ID NO: 23453
  Description of Artificial Sequence: Synthetic coding sequence

SEQ ID NO: 23457 - DNA, 486 bp, Artificial Sequence
  Description of Artificial Sequence: Synthetic coding sequence
atggccgccagcctgggccaggtgctggccctggtgctggtggccgccctgtggggcggcacccagcccctgctgaagagagccagcgccggcctgcagagagtgcacgagcccacctgggcccagcagctgctgcaggagatgaagaccctgttcctgaacaccgagtacctgatgcccttcctgctgaaccagtgcggcagcctgctgtactacctgaccctggccagcaccgacctgaccctggccgtgcccatctgcaacagcctggccatcatcttcaccctgatcgtgggcaaggccctgggcgaggacatcggcggcaagcccgtgctgctgccctgcggccaccagagcagcctgcccctggacagcctggagaaggacagaggctggggcctgggcctgaagaccagaccccacctgagccccagcagcagccccgtgcccgcccccaccggcatggccgagctgagacccagctag

SEQ ID NO: 23458 - DNA, 591 bp, Artificial Sequence
  Description of Artificial Sequence: Synthetic coding sequence
atggccagactgggcgccctgctgctggccgccgccctgggcgccctgctgagcttcgccctgctggccgccgccgtggccagcgactactggtacatcctggaggtggccgacgccggcaacggcagcgcctggcccggcagagccgagctgctgagcagccacagcggcctgtggagaatctgcgaggtgctgcacagagccgtgatcgtggtgctgcccctgagcctggtgctgctggtgtgcggctggatctgcggcctgctgagcagcctggcccagagcgtgagcctgctgctgttcaccggctgctacttcctgctgggcagcgtgctgaccctggccggcgtgagcatctacatcagctacagccacctggccttcgccgagaccgtgcagcagtacggcccccagcacatgcagggcgtgagagtgagcttcggctggagcatggccctggcctggggcagctgcgccctggaggccttcagcggcaccctgctgctgagcgccgcctggaccctgagcctgagcccccccatctgcggccacctgagcccccagcaggtgggcggcagaggcggcgactag

SEQ ID NO: 23459 - DNA, 1185 bp, Artificial Sequence
  Description of Artificial Sequence: Synthetic coding sequence
atgcccagcggctggagcagcggcctgatccagaccagaacccccggccccgccagagccagactgctgtgcttccaggagcacggctgggtggtgctgctgcccggcagacccagcagctggggcagaagcctggccgacccccccagcagcagccaggccctgcacagccccgccagacaggtgcacctggtgtggctgctgagaagcagaggcttcagagagatcaaggagagagcccagggccccggcgccagcccctggggcagatgggactggagccccagccccagattcgccgccagactgagcaccagcagccccttcccccagggcagagcccagagaccccagagaggcggcgtggacctgcccgccacccccggcggccccagaggccagtgcgccggcagaagcggcgacgtgctgagaagagccggcagaagaagagccagacccccccccgtgcccagactgcccgcccccagagcccccagaagacccagaggccccgccacccccgaccccagcccccccgccggcagaccccacggccccgccggcagagccgcccccggcagaagacccggctgcaccgcccagctgagagcccccggcagaagaggcagacagagactgctggtgcaccccggcggcggcggcagaagacagtggcagagactggccagagccagaagagccgccctgctggccctgggcgccctggcccacctgagaagatgccccgacaccggcggcggccagcacctgcaccagctgctggcccccggcctgtgcggcgacggcgccgccgtgtggcccgccgcccacgccggcagacccagacagctgagactggtgcacggccccggcctgggcctgctgtgcctgggcggcatccagagaaacccccccgccctgagctgcctggacccccagcccgagccccccaacctgtggagcagcgagagccccgccggcggcagagagagaggcagactgagacccagagccgccgagggccccacccagatcgcctggagacagagagacgccgtgagcggccagggcctgcccggcctgtgcagcgtgcacagccccagaagagccggcctggtggagaagagactgatgagaggccccgagagccccagcgacctgcagggctggggcgccagaagctag

SEQ ID NO: 23460 - DNA, 453 bp, Artificial Sequence
  Description of Artificial Sequence: Synthetic coding sequence
atggccagactgggcgccctgctgctggccgccgccctgggcgccctgctgagcttcgccctgctggccgccgccgtggccagcgactactggtacatcctggaggtggccgacgccggcaacggcagcgcctggcccggcagagccgagctgctgagcagccacagcggcctgtggagaatctgcgagggcgtgctgaccctggccggcgtgagcatctacatcagctacagccacctggccttcgccgagaccgtgcagcagtacggcccccagcacatgcagggcgtgagagtgagcttcggctggagcatggccctggcctggggcagctgcgccctggaggccttcagcggcaccctgctgctgagcgccgcctggaccctgagcctgagcccccccatctgcggccacctgagcccccagcaggtgggcggcagaggcggcgactag

SEQ ID NO: 23461 - DNA, 591 bp, Artificial Sequence; identical to SEQ ID NO: 23458
  Description of Artificial Sequence: Synthetic coding sequence

SEQ ID NO: 23462 - DNA, 672 bp, Artificial Sequence
  Description of Artificial Sequence: Synthetic coding sequence
atggccagactgggcgccctgctgctggccgccgccctgggcgccctgctgagcttcgccctgctggccgccgccgtggccagcgactactggtacatcctggaggtggccgacgccggcaacggcagcgcctggcccggcagagccgagctgctgagcagccacagcggcctgtggagaatctgcgagggccagaacggctgcatccccctggtggaccccttcgccagcgagagcctggacgtgagcaccagcgtgcagcacctgatcctgctgcacagagccgtgatcgtggtgctgcccctgagcctggtgctgctggtgtgcggctggatctgcggcctgctgagcagcctggcccagagcgtgagcctgctgctgttcaccggctgctacttcctgctgggcagcgtgctgaccctggccggcgtgagcatctacatcagctacagccacctggccttcgccgagaccgtgcagcagtacggcccccagcacatgcagggcgtgagagtgagcttcggctggagcatggccctggcctggggcagctgcgccctggaggccttcagcggcaccctgctgctgagcgccgcctggaccctgagcctgagcccccccatctgcggccacctgagcccccagcaggtgggcggcagaggcggcgactag

SEQ ID NO: 23463 - DNA, 453 bp, Artificial Sequence; identical to SEQ ID NO: 23460
  Description of Artificial Sequence: Synthetic coding sequence

SEQ ID NO: 23464 - DNA, 1056 bp, Artificial Sequence
  Description of Artificial Sequence: Synthetic coding sequence
atggccagcggcagactgatcaagttcgtggtgttcgagctgctggagttcgccgccttcagcatccccaccctggtgatcaccgagcagttcgccaccgcctaccagggcaccagagccagaagcgacaacacccactactggctgatcatcagctgcagcatcgcctacgtggccctggtgaccctgctgatctgggtgcccgtgaaggtgatcctgcacaagaagagatacatctacagaaagatcaagggctggagacccgtgctgatgatgtgcgtggtgctgaccaccctgccctgcctgaccttcagcatcgccgtgaccgaggtgcagaagagcatcaacggcagcgccgacgtgctgcccgacatgctgcccgacctgcccgtgagcctggtgctgctgagcctgatcatggtggacatcatcgagaagctgagaatctaccccctgagaggcagccagaagagcagcgagaacggccacatccacagcaccagcctgcagcacatcaagaccgtgaccgagcaggtgagacagagccccgagaacgccgccagcccccaggccaccaacagcacccaggtgagccagcccagcggcgccatgaccagaagccaggagagcgtgttcatgggcccccaggagcccagctgcgacagcggcatcctgagaatgatgagcagaagagacgtgagagccgagctgttcctgtggagcttcctgctgtggagcgacaccatcgagatggtgagagtggccggccaccccaacgtgtacaagagcagctggctgtaccccgtgtacatcttcagcttcatcagcctgctgagaatcaccttcaccccccagaaccccctgctgaacagcctgagcgtgctgctgcaggacctgcccttcgtgttcgtgagactgggcctgatcatcgccctgggcaccatcacccccgtgctgggcctgtgcaagaacatcctggtgaccctgagctacatctacttcaactacctgaccagaatcagaatcttcagcgccttcgagatgagccccttctag

SEQ ID NO: 23465 - DNA, 1056 bp, Artificial Sequence; identical to SEQ ID NO: 23464
  Description of Artificial Sequence: Synthetic coding sequence

SEQ ID NO: 23466 - DNA, 1056 bp, Artificial Sequence; identical to SEQ ID NO: 23464
  Description of Artificial Sequence: Synthetic coding sequence

SEQ ID NO: 23467 - DNA, 1056 bp, Artificial Sequence; identical to SEQ ID NO: 23464
  Description of Artificial Sequence: Synthetic coding sequence

SEQ ID NO: 23468 - DNA, 522 bp, Artificial Sequence
  Description of Artificial Sequence: Synthetic coding sequence
atgagcatgagcgccaacaccatgatcttcatgatcctgggcgccagcgtggtgatggccatcgcctgcctgatggacatgaacgccctgctggacagattccacaactacatcctgccccacctgagaggcgaggacagagtgtgccactgcaactgcggcagacaccacatccactacgtgatcccctacgacggcgaccagagcgtggtggacgccagcgagaactacttcgtgaccgacagcgtgaccaagcaggagatcgacctgatgctgggcctgctgctgggcttctgcatcagctggttcctggtgtggatggacggcgtgctgcactgcgccgtgagagcctggagagccggcagaagatacgacggcagctggacctggctgcccaagctgtgcagcctgagagagctgggcagaagaccccacagacccttcgaggaggccgccggcaacatggtgcacgtgaagcagaagctgtaccacaacggccaccccagccccagacacctgtag

SEQ ID NO: 23469 - DNA, 522 bp, Artificial Sequence; identical to SEQ ID NO: 23468
  Description of Artificial Sequence: Synthetic coding sequence

SEQ ID NO: 23470 - DNA, 891 bp, Artificial Sequence
  Description of Artificial Sequence: Synthetic coding sequence
atgtgcgtgagaagaagcctggtgggcctgaccttctgcacctgctacctggccagctacctgaccaacaagtacgtgctgagcgtgctgaagttcacctaccccaccctgttccagggctggcagaccctgatcggcggcctgctgctgcacgtgagctggaagctgggctgggtggagatcaacagcagcagcagaagccacgtgctggtgtggctgcccgccagcgtgctgttcgtgggcatcatctacgccggcagcagagccctgagcagactggccatccccgtgttcctgaccctgcacaacgtggccgaggtgatcatctgcggctaccagaagtgcttccagaaggagaagaccagccccgccaagatctgcagcgccctgctgctgctggccgccgccggctgcctgcccttcaacgacagccagttcaaccccgacggctacttctgggccatcatccacctgctgtgcgtgggcgcctacaagatcctgcagaagagccagaagcccagcgccctgagcgacatcgaccagcagtacctgaactacatcttcagcgtggtgctgctggccttcgccagccaccccaccggcgacctgttcagcgtgctggacttccccttcctgtacttctacagattccacggcagctgctgcgccagcggcttcctgggcttcttcctgatgttcagcaccgtgaagctgaagaacctgctggcccccggccagtgcgccgcctggatcttcttcgccaagatcatcaccgccggcctgagcatcctgctgttcgacgccatcctgaccagcgccaccaccggctgcctgctgctgggcgccctgggcgaggccctgctggtgttcagcgagagaaagagcagctag

SEQ ID NO: 23471 - DNA, 372 bp, Artificial Sequence
  Description of Artificial Sequence: Synthetic coding sequence
atgtgcgtgagaagaagcctggtgggcctgaccttctgcacctgctacctggccagctacctgaccaacaagtacgtgctgagcgtgctgaagttcacctaccccaccctgttccagggcagccacgtgctggtgtggctgcccgccagcgtgctgttcgtgggcatcatctacgccggcagcagagccctgagcagactggccatccccgtgttcctgaccctgcacaacgtggccgaggtgatcatctgcggctaccagaagtgcttccagaaggagaagaccagccccgccaagatctgcagactgcacctggagagaaccagacagaaccagaccagcagactgagcagctgcctgaagggcgactag

SEQ ID NO: 23472 - DNA, 468 bp, Artificial Sequence
  Description of Artificial Sequence: Synthetic coding sequence
atgatccccgacgtgatcagcgccctgctgctgctggccgccgccggctgcctgcccttcaacgacagccagttcaaccccgacggctacttctgggccatcatccacctgctgtgcgtgggcgcctacaagatcctgcagaagagccagaagcccagcgccctgagcgacatcgaccagcagtacctgaactacatcttcagcgtggtgctgctggccttcgccagccaccccaccggcgacctgttcagcgtgctggacttccccttcctgtacttctacagattccacggcagctgctgcgccagcggcttcctgggcttcttcctgatgttcagcaccgtgaagctgaagaacctgctggcccccggccagtgcgccgcctggatcttcttcgccaagatcatcaccgccggcctgagcatcctgctgttcgacgccatcctgaccagcgccaccaccggctag

SEQ ID NO: 23473 - DNA, 507 bp, Artificial Sequence
  Description of Artificial Sequence: Synthetic coding sequence
atgtgcgtgagaagaagcctggtgggcctgaccttctgcacctgctacctggccagctacctgaccaacaagtacgtgctgagcgtgctgaagttcacctaccccaccctgttccagggctggcagaccctgatcggcggcctgctgctgcacgtgagctggaagctgggctgggtggagatcaacagcagcagcagaagccacgtgctggtgtggctgcccgccagcgtgctgttcgtgggcatcatctacgccggcagcagagccctgagcagactggccatccccgtgttcctgaccctgcacaacgtggccgaggtgatcatctgcggctaccagaagtgcttccagaaggagaagaccagccccgccaagatctgcagcgccctgctgctgctggccgccgccggctgcctgcccttcaacgacagccagttcaaccccgacggctacttctgggccatcatccacctgctgtgcgtggtgaccctgaccagcaacacctag

SEQ ID NO: 23474 - DNA, 387 bp, Artificial Sequence
  Description of Artificial Sequence: Synthetic coding sequence
atggagaccgccggcgccgccaccggccagcccgccagcggcctggaggcccccggcagcaccaacgacagactgttcctggtgaagggcggcatcttcctgggcaccgtggccgccgccggcatgctggccggcttcatcaccaccctgagcctggccaagaagaagagccccgagtggttcaacaagggcagcatggccaccgccgccctgcccgagagcggcagcagcctggccctgagagccctgggctggggcagcctgtacgcctggtgcggcgtgggcgtgatcagcttcgccgtgtggaaggccctgggcgtgcacagcgtgagcaactactgcctggtgcccggcatctacatgttcatcctgctgaccgtgttctag

SEQ ID NO: 23475 - DNA, 426 bp, Artificial Sequence
  Description of Artificial Sequence: Synthetic coding sequence
atggagaccgccggcgccgccaccggccagcccgccagcggcctggaggcccccggcagcaccaacgacagactgttcctggtgaagggcggcatcttcctgggcaccgtggccgccgccggcatgctggccggcttcatcaccaccctgagcctggccaagaagaagagccccgagtggttcaacaagggcagcatggccaccgccgccctgcccgagagcggcagcagcctggccctgagagccctgggctggggcagcctgtacgcctggtgcggcgtgggcgtgatcagcttcgccgtgtggaaggccctgggcgtgcacagcatgaacgacttcagaagcaagatgcagagcatcttccccaccatccccaagaacagcgagagcgccgtggagtgggaggagaccctgaagagcaagtag

SEQ ID NO: 23476 - DNA, 651 bp, Artificial Sequence
  Description of Artificial Sequence: Synthetic coding sequence
atgcccaagggcagagccggcagcctgcccaccaccagcatcggctggagattccagctgtggttcctgggcctgacctgccccgagagacacctggccagaagactgaagaacaacagcttctaccccttcgtgcagcaggagcccaacggcgccgaggccagagacctgggcctgcccagagtgagaagaggcagaggccccgtggccagagacctggtggccgccgccgccccccccggcgccgagccccacgccagaagagtgcccctgctgcaccccggcccccacagagtgcccggccccctggccagcggcctgagagcccccggcgcccagctgagatgccccagaaaggtgctgctgccccccggccccagaagaccccaggtgggcgcccccggcgccggcgccgccgtgggcgccctgagagccaacggcatcctgggccccctgcacagacccgagacccagcaccagctgctgagactgcccggccacctgctgcccgccagaggcagccccctggccaccccctggagatggcactgcgacggccaggagccccacggcagccaggcccagctgctgagcgtgcagcccggcggcgtgaccctgagagccagccccaccagcggcctgtgcagctag

SEQ ID NO: 23477 - DNA, 672 bp, Artificial Sequence
  Description of Artificial Sequence: Synthetic coding sequence
atggagggcctggtgttcctgaacgccctggccaccagactgctgttcctgctgcacagcctggtgggcgtgtggagagtgaccgaggtgaagaaggagcccagatactggctgctggccctgctgaacctgctgctgttcctggagaccgccctgaccctgaagttcaagagaggcagaggctacaagtggttcagccccgccatcttcctgtacctgatcagcatcgtgcccagcctgtggctgctggagctgcaccacgagacccagtactgcagcatccaggccgagggcaccagccagaacaccagcagaaaggaggacttcaaccagaccctgaccagcaacgagcagaccagcagagccgacgacctgatcgagaccgccaaggtgttcgtgaacaacctgagcaccgtgtgcgagaaggtgtggaccctgggcctgcaccagaccttcctgctgatgctgatcatcggcagatggctgctgcccatcggcggcggcatcaccagagaccagctgagccagctgctgctgatgttcgtgggcaccgccgccgacatcctggagttcaccagcgagaccctggaggagcagaacgtgagactgtgctggaagaacagcaccaacagaagacacaccaaccccaagtggcagctggtgctgttctag

SEQ ID NO: 23478 - DNA, 1107 bp, Artificial Sequence
  Description of Artificial Sequence: Synthetic coding sequence
atggagggcctggtgttcctgaacgccctggccaccagactgctgttcctgctgcacagcctggtgggcgtgtggagagtgaccgaggtgaagaaggagcccagatactggctgctggccctgctgaacctgctgctgttcctggagaccgccctgaccctgaagttcaagagaggcagaggctacaagtggttcagccccgccatcttcctgtacctgatcagcatcgtgcccagcctgtggctgctggagctgcaccacgagacccagtactgcagcatccaggccgagggcaccagccagaacaccagcagaaaggaggacttcaaccagaccctgaccagcaacgagcagaccagcagagccgacgacctgatcgagaccgccaaggtgttcgtgaacaacctgagcaccgtgtgcgagaaggtgtggaccctgggcctgcaccagaccttcctgctgatgctgatcatcggcagatggctgctgcccatcggcggcggcatcaccagagaccagctgagccagctgctgctgatgttcgtgggcaccgccgccgacatcctggagttcaccagcgagaccctggaggagcagaacgtgagaaacagccccgccctggtgtacgccatcctggtgatctggacctggagcatgctgcagttccccctggacctggccgtgcagaacgtggtgtgccccgtgagcgtgaccgagagaggcttccccagcctgttcttctgccagtacagcgccgacctgtggaacatcggcatcagcgtgttcatccaggacggccccttcctggtggtgagactgatcctgatgacctacttcaaggtgatcaaccagatgctggtgttcttcgccgccaagaacttcctggtggtggtgctgcagctgtacagactggtggtgctggccctggccgtgagagccagcctgagaagccagagcgagggcctgaagggcgagcacggctgcagagcccagaccagcgagagcggccccagccagagagactggcagaacgagagcaaggagggcctggccatccccctgagaggcagccccgtgaccagcgacgacagccaccacaccccctag

SEQ ID NO: 23479 - DNA, 1107 bp, Artificial Sequence; identical to SEQ ID NO: 23478
  Description of Artificial Sequence: Synthetic coding sequence

SEQ ID NO: 23480 - DNA, 507 bp, Artificial Sequence
  Description of Artificial Sequence: Synthetic coding sequence
atgagactgaccgagaagagcgagggcgagcagcagctgaagcccaacaacagcaacgcccccaacgaggaccaggaggaggagatccagcagagcgagcagcacacccccgccagacagagaacccagagagccgacacccagcccagcagatgcagactgcccagcagaagaacccccaccaccagcagcgacagaaccatcaacctgctggaggtgctgccctggcccaccgagtggatcttcaacccctacagactgcccgccctgttcgagctgtaccccgagttcctgctggtgttcaaggaggccttccacgacatcagccactgcctgaaggcccagatggagaagatcggcctgcccatcatcctgcacctgttcgccctgagcaccctgtacttctacaagttcttcctgcccaccatcctgagcctgagcttcttcatcctgctggtgctgctgctgctgctgttcatcatcgtgttcatcctgatcttcttctag

SEQ ID NO: 23481 - DNA, 744 bp, Artificial Sequence
  Description of Artificial Sequence: Synthetic coding sequence
atggccgacaccacccccaacggcccccagggcgccggcgccgtgcagttcatgatgaccaacaagctggacaccgccatgtggctgagcagactgttcaccgtgtactgcagcgccctgttcgtgctgcccctgctgggcctgcacgaggccgccagcttctaccagagagccctgctggccaacgccctgaccagcgccctgagactgcaccagagactgccccacttccagctgagcagagccttcctggcccaggccctgctggaggacagctgccactacctgctgtacagcctgatcttcgtgaacagctaccccgtgaccatgagcatcttccccgtgctgctgttcagcctgctgcacgccgccacctacaccaagaaggtgctggacgccagaggcagcaacagcctgcccctgctgagaagcgtgctggacaagctgagcgccaaccagcagaacatcctgaagttcatcgcctgcaacgagatcttcctgatgcccgccaccgtgttcatgctgttcagcggccagggcagcctgctgcagcccttcatctactacagattcctgaccctgagatacagcagcagaagaaacccctactgcagaaccctgttcaacgagctgagaatcgtggtggagcacatcatcatgaagcccgcctgccccctgttcgtgagaagactgtgcctgcagagcatcgccttcatcagcagactggcccccaccgtgccctag

SEQ ID NO: 23482 - DNA, 744 bp, Artificial Sequence; identical to SEQ ID NO: 23481
  Description of Artificial Sequence: Synthetic coding sequence

SEQ ID NO: 23483 - DNA, 669 bp, Artificial Sequence
  Description of Artificial Sequence: Synthetic coding sequence
atggccgacaccacccccaacggcccccagggcgccggcgccgtgcagttcatgatgaccaacaagctggacaccgccatgtggctgagcagactgttcaccgtgtactgcagcgccctgttcgtgctgcccctgctgggcctgcacgaggccgccagcttctaccagagagccctgctggccaacgccctgaccagcgccctgagactgcaccagagactgccccacttccagctgagcagagccttcctggcccaggccctgctggaggacagctgccactacctgctgtacagcctgatcttcgtgaacagctaccccgtgaccatgagcatcttccccgtgctgctgttcagcctgctgcacgccgccacctacaccaagaaggtgctggacgccagaggcagcaacagcctgcccctgctgagaagcgtgctggacaagctgagcgccaaccagcagaacatcctgaagttcatcgcctgcaacgagatcttcctgatgcccgccaccgtgttcatgctgttcagcggccagggcagcctgctgcagcccttcatctactacagattcctgaccctgagatacagcagcagaagaaacccctactgcagaaccctgttcaacgagctgagaatcgtggtggagcacatcatcatgaagccctag

SEQ ID NO: 23484 - DNA, 744 bp, Artificial Sequence; identical to SEQ ID NO: 23481
  Description of Artificial Sequence: Synthetic coding sequence

SEQ ID NO: 23485 - DNA, 504 bp, Artificial Sequence
  Description of Artificial Sequence: Synthetic coding sequence
atggccagccccagaaccgtgaccatcgtggccctgagcgtggccctgggcctgttcttcgtgttcatgggcaccatcaagctgacccccagactgagcaaggacgcctacagcgagatgaagagagcctacaagagctacgtgagagccctgcccctgctgaagaagatgggcatcaacagcatcctgctgagaaagagcatcggcgccctggaggtggcctgcggcatcgtgatgaccctggtgcccggcagacccaaggacgtggccaacttcttcctgctgctgctggtgctggccgtgctgttcttccaccagctggtgggcgaccccctgaagagatacgcccacgccctggtgttcggcatcctgctgacctgcagactgctgatcgccagaaagcccgaggacagaagcagcgagaagaagcccctgcccggcaacgccgaggagcagcccagcctgtacgagaaggccccccagggcaaggtgaaggtgagctag

SEQ ID NO: 23486 - DNA, 381 bp, Artificial Sequence
  Description of Artificial Sequence: Synthetic coding sequence
atggccagccccagaaccgtgaccatcgtggccctgagcgtggccctgggcctgttcttcgtgttcatgggcaccatcaagctgacccccagactgagcaaggacgcctacagcgagatgaagagagcctacaagagctacgtgagagccctgcccctgctgaagaagatgggcatcaacagcatcctgcaccagctggtgggcgaccccctgaagagatacgcccacgccctggtgttcggcatcctgctgacctgcagactgctgatcgccagaaagcccgaggacagaagcagcgagaagaagcccctgcccggcaacgccgaggagcagcccagcctgtacgagaaggccccccagggcaaggtgaaggtgagctag

SEQ ID NO: 23487 - DNA, 573 bp, Artificial Sequence
  Description of Artificial Sequence: Synthetic coding sequence
atgaccgccgtgggcgtgcaggcccagagacccctgggccagagacagcccagaagaagcttcttcgagagcttcatcagaaccctgatcatcacctgcgtggccctggccgtggtgctgagcagcgtgagcatctgcgacggccactggctgctggccgaggacagactgttcggcctgtggcacttctgcaccaccaccaaccagaccatctgcttcagagacctgggccaggcccacgtgcccggcctggccgtgggcatgggcctggtgagaagcgtgggcgccctggccgtggtggccgccatcttcggcctggagttcctgatggtgagccagctgtgcgaggacaagcacagccagtgcaagtgggtgatgggcagcatcctgctgctggtgagcttcgtgctgagcagcggcggcctgctgggcttcgtgatcctgctgagaaaccaggtgaccctgatcggcttcaccctgatgttctggtgcgagttcaccgccagcttcctgctgttcctgaacgccatcagcggcctgcacatcaacagcatcacccacccctgggagtag

SEQ ID NO: 23488 - DNA, 900 bp, Artificial Sequence
  Description of Artificial Sequence: Synthetic coding sequence
atggagctgctgagcgccctgagcctgggcgagctggccctgagcttcagcagagtgcccctgttccccgtgttcgacctgagctacttcatcgtgagcatcctgtacctgaagtacgagcccggcgccgtggagctgagcagaagacaccccatcgccagctggctgtgcgccatgctgcactgcttcggcagctacatcctggccgacctgctgctgggcgagcccctgatcgactacttcagcaacaacagcagcatcctgctggccagcgccgtgtggtacctgatcttcttctgccccctggacctgttctacaagtgcgtgtgcttcctgcccgtgaagctgatcttcgtggccatgaaggaggtggtgagagtgagaaagatcgccgtgggcatccaccacgcccaccaccactaccaccacggctggttcgtgatgatcgccaccggctgggtgaagggcagcggcgtggccctgatgagcaacttcgagcagctgctgagaggcgtgtggaagcccgagaccaacgagatcctgcacatgagcttccccaccaaggccagcctgtacggcgccatcctgttcaccctgcagcagaccagatggctgcccgtgagcaaggccagcctgatcttcatcttcaccctgttcatggtgagctgcaaggtgttcctgaccgccacccacagccacagcagccccttcgacgccctggagggctacatctgccccgtgctgttcggcagcgcctgcggcggcgaccaccaccacgacaaccacggcggcagccacagcggcggcggccccggcgcccagcacagcgccatgcccgccaagagcaaggaggagctgagcgagggcagcagaaagaagaaggccaagaaggccgactag

SEQ ID NO: 23489 - DNA, 714 bp, Artificial Sequence
  Description of Artificial Sequence: Synthetic coding sequence
atgctgcactgcttcggcggcggcatcctgagctgcctgctgctggccgagccccccctgaagttcctggccaaccacaccaacatcctgctggccagcagcatctggtacatcaccttcttctgcccccacgacctggtgagccagggctacagctacctgcccgtgcagctgctggccagcggcatgaaggaggtgaccagaacctggaagatcgtgggcggcgtgacccacgccaacagctactacaagaacggctggatcgtgatgatcgccatcggctgggccagaggcgccggcggcaccatcatcaccaacttcgagagactggtgaagggcgactggaagcccgagggcgacgagtggctgaagatgagctaccccgccaaggtgaccctgctgggcagcgtgatcttcaccttccagcacacccagcacctggccatcagcaagcacaacctgatgttcctgtacaccatcttcatcgtggccaccaagatcaccatgatgaccacccagaccagcaccatgaccttcgcccccttcgaggacaccctgagctggatgctgttcggctggcagcagcccttcagcagctgcgagaagaagagcgaggccaagagccccagcaacggcgtgggcagcctggccagcaagcccgtggacgtggccagcgacaacgtgaagaagaagcacaccaagaagaacgagtag

SEQ ID NO: 23490 - DNA, 876 bp, Artificial Sequence
  Description of Artificial Sequence: Synthetic coding sequence
atggacagcccctgggacgagctggccctggccttcagcagaaccagcatgttccccttcttcgacatcgcccactacctggtgagcgtgatggccgtgaagagacagcccggcgccgccgccctggcctggaagaaccccatcagcagctggttcaccgccatgctgcactgcttcggcggcggcatcctgagctgcctgctgctggccgagccccccctgaagttcctggccaaccacaccaacatcctgctggccagcagcatctggtacatcaccttcttctgcccccacgacctggtgagccagggctacagctacctgcccgtgcagctgctggccagcggcatgaaggaggtgaccagaacctggaagatcgtgggcggcgtgacccacgccaacagctactacaagaacggctggatcgtgatgatcgccatcggctgggccagaggcgccggcggcaccatcatcaccaacttcgagagactggtgaagggcgactggaagcccgagggcgacgagtggctgaagatgagctaccccgccaaggtgaccctgctgggcagcgtgatcttcaccttccagcacacccagcacctggccatcagcaagcacaacctgatgttcctgtacaccatcttcatcgtggccaccaagatcaccatgatgaccacccagaccagcaccatgaccttcgcccccttcgaggacaccctgagctggatgctgttcggctggcagcagcccttcagcagctgcgagaagaagagcgaggccaagagccccagcaacggcgtgggcagcctggccagcaagcccgtggacgtggccagcgacaacgtgaagaagaagcacaccaagaagaacgagtag

SEQ ID NO: 23491 - DNA, 108 bp, Artificial Sequence
  Description of Artificial Sequence: Synthetic coding sequence
atgctgcactgcttcggcggcggcatcctgagctgcctgctgctggccgagccccccctgaagttcctggccaaccacaccaacatcctgctggccagcagcatctag

SEQ ID NO: 23492 - DNA, 489 bp, Artificial Sequence
  Description of Artificial Sequence: Synthetic coding sequence
tgaagctgcctgctgctggccgagccccccctgaagttcctggccaaccacaccaacatcctgctggccagcagcatctggtacatcaccttcttctgcccccacgacctggtgagccagggctacagctacctgcccgtgcagctgctggccagcggcatgaaggaggtgaccagaacctggaagatcgtgggcggcgtgacccacgccaacagctactacaagaacggctggatcgtgatgatcgccatcggctgggccagaggcgccggcggcaccatcatcaccaacttcgagagactggtgaagggcgactggaagcccgagggcgacgagtggctgaagatgagctaccccgccaaggtgaccctgctgggcagcgtgatcttcaccttccagcacacccagcacctggccatcagcaagcacaacctgatgttcctgtacaccatcttcatcgtggccaccaagagcctgaactggagatag

SEQ ID NO: 23493 - DNA, 246 bp, Artificial Sequence
  Description of Artificial Sequence: Synthetic coding sequence
tgatggatcgtgatgatcgccatcggctgggccagaggcgccggcggcaccatcatcaccaacttcgagagactggtgaagggcgactggaagcccgagggcgacgagtggctgaagatgagctaccccgccaaggtgaccctgctgggcagcgtgatcttcaccttccagcacacccagcacctggccatcagcaagcacaacctgatgttcctgtacaccatcttcatcgtggccaccaagtag

SEQ ID NO: 23494 - DNA, 1467 bp, Artificial Sequence
  Description of Artificial Sequence: Synthetic coding sequence
atgcccggcggcagaagaggccccagcagacagcagctgagcagaagcgccctgcccagcctgcagaccctggtgggcggcggctgcggcaacggcaccggcctgagaaacagaaacggcagcgccatcggcctgcccgtgccccccatcaccgccctgatcacccccggccccgtgagacactgccagatccccgacctgcccgtggacggcagcctgctgttcgagttcctgttcttcatctacctgctggtggccctgttcatccagtacatcaacatctacaagaccgtgtggtggtacccctacaaccaccccgccagctgcaccagcctgaacttccacctgatcgactaccacctggccgccttcatcaccgtgatgctggccagaagactggtgtgggccctgatcagcgaggccaccaaggccggcgccgccagcatgatccactacatggtgctgatcagcgccagactggtgctgctgaccctgtgcggctgggtgctgtgctggaccctggtgaacctgttcagaagccacagcgtgctgaacctgctgttcctgggctaccccttcggcgtgtacgtgcccctgtgctgcttccaccaggacagcagagcccacctgctgctgaccgactacaactacgtggtgcagcacgaggccgtggaggagagcgccagcaccgtgggcggcctggccaagagcaaggacttcctgagcctgctgctggagagcctgaaggagcagttcaacaacgccacccccatccccacccacagctgccccctgagccccgacctgatcagaaacgaggtggagtgcctgaaggccgacttcaaccacagaatcaaggaggtgctgttcaacagcctgttcagcgcctactacgtggccttcctgcccctgtgcttcgtgaagagcacccagtactacgacatgagatggagctgcgagcacctgatcatggtgtggatcaacgccttcgtgatgctgaccacccagctgctgcccagcaagtactgcgacctgctgcacaagagcgccgcccacctgggcaagtggcagaagctggagcacggcagctacagcaacgccccccagcacatctggagcgagaacaccatctggccccagggcgtgctggtgagacacagcagatgcctgtacagagccatgggcccctacaacgtggccgtgcccagcgacgtgagccacgccagattctacttcctgttccacagacccctgagactgctgaacctgctgatcctgatcgagggcagcgtggtgttctaccagctgtacagcctgctgagaagcgagaagtggaaccacaccctgagcatggccctgatcctgttctgcaactactacgtgctgttcaagctgctgagagacagaatcgtgctgggcagagcctacagctaccccctgaacagctacgagctgaaggccaactag

SEQ ID NO: 23495 - DNA, 339 bp, Artificial Sequence
  Description of Artificial Sequence: Synthetic coding sequence
atgcccggcggcagaagaggccccagcagacagcagctgagcagaagcgccctgcccagcctgcagaccctggtgggcggcggctgcggcaacggcaccggcctgagaaacagaaacggcagcgccatcggcctgcccgtgccccccatcaccgccctgatcacccccggccccgtgagacactgccagatccccgacctgcccgtggacggcagcctgctgttcgagttcctgttcttcatctacctgctggtggccctgttcatccagtacatcaacatctacaagaccgtgtggtggtacccctacaaccaccccgccagctgcaccagcctgtag

SEQ ID NO: 23496 - DNA, 579 bp, Artificial Sequence
  Description of Artificial Sequence: Synthetic coding sequence
atgcccggcggcagaagaggccccagcagacagcagctgagcagaagcgccctgcccagcctgcagaccctggtgggcggcggctgcggcaacggcaccggcctgagaaacagaaacggcagcgccatcggcctgcccgtgccccccatcaccgccctgatcacccccggccccgtgagacactgccagatccccgacctgcccgtggacggcagcctgctgttcgagttcctgttcttcatctacctgctggtggccctgttcatccagtacatcaacatctacaagaccgtgtggtggtacccctacaaccaccccgccagctgcaccagcctgaacttccacctgatcgactaccacctggccgccttcatcaccgtgatgctggccagaagactggtgtgggccctgatcagcgaggccaccaaggccggcgccgccagcatgatccactacatggtgctgatcagcgccagactggtgctgctgaccctgtgcggctgggtgctgtgctggaccctggtgaacctgttcagaagccacagcgtgctgaacctgctgttcctgggctacccctag

SEQ ID NO: 23497 - DNA, 423 bp, Artificial Sequence
  Description of Artificial Sequence: Synthetic coding sequence
atgcccggcggcagaagaggccccagcagacagcagctgagcagaagcgccctgcccagcctgcagaccctggtgggcggcggctgcggcaacggcaccggcctgagaaacagaaacggcagcgccatcggcctgcccgtgccccccatcaccgccctgatcacccccggccccgtgagacactgccagatccccgacctgcccgtggacggcagcctgctgttcgagttcctgttcttcatctacctgctggtggccctgttcatccagtacatcaacatctacaagaccgtgtggtggtacccctacaaccaccccgccagctgcaccagcctgaacttccacctgatcgactaccacctggccgccttcatcaccgtgatgctggccagaagactggtgtgggccctgatcagcgagtag

SEQ ID NO: 23498 - DNA, 1479 bp, Artificial Sequence
  Description of Artificial Sequence: Synthetic coding sequence
atgggcggcagaagaggccccaacagaaccagctactgcagaaaccccctgtgcgagcccggcagcagcggcggcagcagcggcagccacaccagcagcgccagcgtgaccagcgtgagaagcagaaccagaagcagcagcggcaccggcctgagcagcccccccctggccacccagaccgtggtgcccctgcagcactgcaagatccccgagctgcccgtgcaggccagcatcctgttcgagctgcagctgttcttctgccagctgatcgccctgttcgtgcactacatcaacatctacaagaccgtgtggtggtacccccccagccacccccccagccacaccagcctgaacttccacctgatcgacttcaacctgctgatggtgaccaccatcgtgctgggcagaagattcatcggcagcatcgtgaaggaggccagccagagaggcaaggtgagcctgttcagaagcatcctgctgttcctgaccagattcaccgtgctgaccgccaccggctggagcctgtgcagaagcctgatccacctgttcagaacctacagcttcctgaacctgctgttcctgtgctaccccttcggcatgtacatccccttcctgcagctgaactgcgacctgagaaagaccagcctgttcaaccacatggccagcatgggccccagagaggccgtgagcggcctggccaagagcagagactacctgctgaccctgagagagacctggaagcagcacaccagacagctgtacggccccgacgccatgcccacccacgcctgctgcctgagccccagcctgatcagaagcgaggtggagttcctgaagatggacttcaactggagaatgaaggaggtgctggtgagcagcatgctgagcgcctactacgtggccttcgtgcccgtgtggttcgtgaagaacacccactactacgacaagagatggagctgcgagctgttcctgctggtgagcatcagcaccagcgtgatcctgatgcagcacctgctgcccgccagctactgcgacctgctgcacaaggccgccgcccacctgggctgctggcagaaggtggaccccgccctgtgcagcaacgtgctgcagcacccctggaccgaggagtgcatgtggccccagggcgtgctggtgaagcacagcaagaacgtgtacaaggccgtgggccactacaacgtggccatccccagcgacgtgagccacttcagattccacttcttcttcagcaagcccctgagaatcctgaacatcctgctgctgctggagggcgccgtgatcgtgtaccagctgtacagcctgatgagcagcgagaagtggcaccagaccatcagcctggccctgatcctgttcagcaactactacgccttcttcaagctgctgagagacagactggtgctgggcaaggcctacagctacagcgccagcccccagagagacctggaccacagattcagctag

SEQ ID NO: 23499 - DNA, 579 bp, Artificial Sequence
  Description of Artificial Sequence: Synthetic coding sequence
atgggcggcagaagaggccccaacagaaccagctactgcagaaaccccctgtgcgagcccggcagcagcggcggcagcagcggcagccacaccagcagcgccagcgtgaccagcgtgagaagcagaaccagaagcagcagcggcaccggcctgagcagcccccccctggccacccagaccgtggtgcccctgcagcactgcaagatccccgagctgcccgtgcaggccagcatcctgttcgagctgcagctgttcttctgccagctgatcgccctgttcgtgcactacatcaacatctacaagaccgtgtggtggtacccccccagccacccccccagccacaccagcctggccagccagagaggcaaggtgagcctgttcagaagcatcctgctgttcctgaccagattcaccgtgctgaccgccaccggctggagcctgtgcagaagcctgatccacctgttcagaacctacagcttcctgaacctgctgttcctgtgctaccccttcggcatgtacatccccttcctgcagctgaactgcgacctgagaaagaccagcctgttcaaccacatgtag

SEQ ID NO: 23500 - DNA, 882 bp, Artificial Sequence
  Description of Artificial Sequence: Synthetic coding sequence
atgtacatccccttcctgcagctgaactgcgacctgagaaagaccagcctgttcaaccacatggccagcatgggccccagagaggccgtgagcggcctggccaagagcagagactacctgctgaccctgagagagacctggaagcagcacaccagacagctgtacggccccgacgccatgcccacccacgcctgctgcctgagccccagcctgatcagaagcgaggtggagttcctgaagatggacttcaactggagaatgaaggaggtgctggtgagcagcatgctgagcgcctactacgtggccttcgtgcccgtgtggttcgtgaagaacacccactactacgacaagagatggagctgcgagctgttcctgctggtgagcatcagcaccagcgtgatcctgatgcagcacctgctgcccgccagctactgcgacctgctgcacaaggccgccgcccacctgggctgctggcagaaggtggaccccgccctgtgcagcaacgtgctgcagcacccctggaccgaggagtgcatgtggccccagggcgtgctggtgaagcacagcaagaacgtgtacaaggccgtgggccactacaacgtggccatccccagcgacgtgagccacttcagattccacttcttcttcagcaagcccctgagaatcctgaacatcctgctgctgctggagggcgccgtgatcgtgtaccagctgtacagcctgatgagcagcgagaagtggcaccagaccatcagcctggccctgatcctgttcagcaactactacgccttcttcaagctgctgagagacagactggtgctgggcaaggcctacagctacagcgccagcccccagagagacctggaccacagattcagctag

SEQ ID NO: 23501 - DNA, 1029 bp, Artificial Sequence
  Description of Artificial Sequence: Synthetic coding sequence
atgaagaacttccacctgatcgacttcaacctgctgatggtgaccaccatcgtgctgggcagaagattcatcggcagcatcgtgaaggaggccagccagagaggcaaggtgagcctgttcagaagcatcctgctgttcctgaccagattcaccgtgctgaccgccaccggctggagcctgtgcagaagcctgatccacctgttcagaacctacagcttcctgaacctgctgttcctgtgctaccccttcggcatgtacatccccttcctgcagctgaactgcgacctgagaaagaccagcctgttcaaccacatggccagcatgggccccagagaggccgtgagcggcctggccaagagcagagactacctgctgaccctgagagagacctggaagcagcacaccagacagctgtacggccccgacgccatgcccacccacgcctgctgcctgagccccagcctgatcagaagcgaggtggagttcctgaagatggacttcaactggagaatgaaggaggtgctggtgagcagcatgctgagcgcctactacgtggccttcgtgcccgtgtggttcgtgaagaacacccactactacgacaagagatggagctgcgagctgttcctgctggtgagcatcagcaccagcgtgatcctgatgcagcacctgctgcccgccagctactgcgacctgctgcacaaggccgccgcccacctgggctgctggcagaaggtggaccccgccctgtgcagcaacgtgctgcagcacccctggaccgaggagtgcatgtggccccagggcgtgctggtgaagcacagcaagaacgtgtacaaggccgtgggccactacaacgtggccatccccagcgacgtgagccacttcagattccacgtgagcctgctgcccggcgagggcggcctgggccccgagagagtgggcggcagcgccggccaggagtgcgacgtgatcgccagagagagctacttccagtacttccccaaccccaaggaggacagcgcccacatgtag

SEQ ID NO: 23502 - DNA, 579 bp, Artificial Sequence; identical to SEQ ID NO: 23499
  Description of Artificial Sequence: Synthetic coding sequence

SEQ ID NO: 23503 - DNA, 666 bp, Artificial Sequence
  Description of Artificial Sequence: Synthetic coding sequence
atgggcggcagaagaggccccaacagaaccagctactgcagaaaccccctgtgcgagcccggcagcagcggcggcagcagcggcagccacaccagcagcgccagcgtgaccagcgtgagaagcagaaccagaagcagcagcggcaccggcctgagcagcccccccctggccacccagaccgtggtgcccctgcagcactgcaagatccccgagctgcccgtgcaggccagcatcctgttcgagctgcagctgttcttctgccagctgatcgccctgttcgtgcactacatcaacatctacaagaccgtgtggtggtacccccccagccacccccccagccacaccagcctgaacttccacctgatcgacttcaacctgctgatggtgaccaccatcgtgctgggcagaagattcatcggcagcatcgtgaaggaggtgtgggacgtgcacagcgtgcccgccgccgagctgagacccccccaggacaagcccctgcagccccacggcctgcacggcgcccccggcggcggccagtggcccggcaaggagcccggcctgccccccgacaccgccggcgacgtggaggccgcccacaagaccgccgtgtggcccggcagacacgcccacccctgcctgctgcccgtgacccagccccacccccagtag

SEQ ID NO: 23504 - DNA, 702 bp, Artificial Sequence
  Description of Artificial Sequence: Synthetic coding sequence
atggagaccagcgccagcagcagccagccccaggacaacagccaggtgcacagagagaccgaggacgtggactacggcgagaccgacttccacaagcaggacggcaaggccggcctgttcagccaggagcagtacgagagaaacaagagcagcagcagcagcagcagcagcagcagcagcagcagcagcagcagcagcagcagcagcagcgagagcaacgacgaggaccagcagcccagagccaccggcaagcacagaagaagcctgggcgccggctacccccacggcaacggcagccccggccccggccacggcgagcccgacgtgctgaaggacgagctgcagctgtacggcgacgcccccggcgaggtggtgcccagcggcgagagcggcctgagaagaagaggcagcgaccccgccagcggcgaggtggaggccagccagctgagaagactgaacatcaagaaggacgacgagttcttccacttcgtgctgctgtgcttcgccatcggcgccctgctggtgtgctaccactactacgccgactggttcatgagcctgggcgtgggcctgctgaccttcgccagcctggagaccgtgggcatctacttcggcctggtgtacagaatccacagcgtgctgcagggcttcatccccctgttccagaagttcagactgaccggcttcagaaagaccgactag

SEQ ID NO: 23505 - DNA, 702 bp, Artificial Sequence; identical to SEQ ID NO: 23504
  Description of Artificial Sequence: Synthetic coding sequence

SEQ ID NO: 23506 - DNA, 750 bp, Artificial Sequence
  Description of Artificial Sequence: Synthetic coding sequence
atggccgaggccggcgccggcagcctgagcctgcccggcggcaaggccatggagaccagcgccagcagcagccagccccaggacaacagccaggtgcacagagagaccgaggacgtggactacggcgagaccgacttccacaagcaggacggcaaggccggcctgttcagccaggagcagtacgagagaaacaagagcagcagcagcagcagcagcagcagcagcagcagcagcagcagcagcagcagcagcagcagcgagagcaacgacgaggaccagcagcccagagccaccggcaagcacagaagaagcctgggcgccggctacccccacggcaacggcagccccggccccggccacggcgagcccgacgtgctgaaggacgagctgcagctgtacggcgacgcccccggcgaggtggtgcccagcggcgagagcggcctgagaagaagaggcagcgaccccgccagcggcgaggtggaggccagccagctgagaagactgaacatcaagaaggacgacgagttcttccacttcgtgctgctgtgcttcgccatcggcgccctgctggtgtgctaccactactacgccgactggttcatgagcctgggcgtgggcctgctgaccttcgccagcctggagaccgtgggcatctacttcggcctggtgtacagaatccacagcgtgctgcagggcttcatccccctgttccagaagttcagactgaccggcttcagaaagaccgactag

SEQ ID NO: 23507 - DNA, 612 bp, Artificial Sequence
  Description of Artificial Sequence: Synthetic coding sequence
atggagaccagcgccagcagcagccagccccaggacaacagccaggtgcacagagagaccgaggacgtggactacggcgagaccgacttccacaagcaggacggcaaggccggcctgttcagccaggagcagtacgagagaaacaagagcagcagcagcagcagcagcagcagcagcagcagcagcagcagcagcagcagcagcagcagcggccccggccacggcgagcccgacgtgctgaaggacgagctgcagctgtacggcgacgcccccggcgaggtggtgcccagcggcgagagcggcctgagaagaagaggcagcgaccccgccagcggcgaggtggaggccagccagctgagaagactgaacatcaagaaggacgacgagttcttccacttcgtgctgctgtgcttcgccatcggcgccctgctggtgtgctaccactactacgccgactggttcatgagcctgggcgtgggcctgctgaccttcgccagcctggagaccgtgggcatctacttcggcctggtgtacagaatccacagcgtgctgcagggcttcatccccctgttccagaagttcagactgaccggcttcagaaagaccgactag

SEQ ID NO: 23508 - DNA, 474 bp, Artificial Sequence
  Description of Artificial Sequence: Synthetic coding sequence
atggagaccagcgccagcagcagccagccccaggacaacagccaggtgcacagagagaccgaggacgtggactgccccggccacggcgagcccgacgtgctgaaggacgagctgcagctgtacggcgacgcccccggcgaggtggtgcccagcggcgagagcggcctgagaagaagaggcagcgaccccgccagcggcgaggtggaggccagccagctgagaagactgaacatcaagaaggacgacgagttcttccacttcgtgctgctgtgcttcgccatcggcgccctgctggtgtgctaccactactacgccgactggttcatgagcctgggcgtgggcctgctgaccttcgccagcctggagaccgtgggcatctacttcggcctggtgtacagaatccacagcgtgctgcagggcttcatccccctgttccagaagttcagactgaccggcttcagaaagaccgactag

SEQ ID NO: 23509 - DNA, 795 bp, Artificial Sequence
  Description of Artificial Sequence: Synthetic coding sequence
atgagacccctgctgggcctgctgctggtgttcgccggctgcaccttcgccctgtacctgctgagcaccagactgcccagaggcagaagactgggcagcaccgaggaggccggcggcagaagcctgtggttccccagcgacctggccgagctgagagagctgagcgaggtgctgagagagtacagaaaggagcaccaggcctacgtgttcctgctgttctgcggcgcctacctgtacaagcagggcttcgccatccccggcagcagcttcctgaacgtgctggccggcgccctgttcggcccctggctgggcctgctgctgtgctgcgtgctgaccagcgtgggcgccacctgctgctacctgctgagcagcatcttcggcaagcagctggtggtgagctacttccccgacaaggtggccctgctgcagagaaaggtggaggagaacagaaacagcctgttcttcttcctgctgttcctgagactgttccccatgacccccaactggttcctgaacctgagcgcccccatcctgaacatccccatcgtgcagttcttcttcagcgtgctgatcggcctgatcccctacaacttcatctgcgtgcagaccggcagcatcctgagcaccctgaccagcctggacgccctgttcagctgggacaccgtgttcaagctgctggccatcgccatggtggccctgatccccggcaccctgatcaagaagttcagccagaagcacctgcagctgaacgagaccagcaccgccaaccacatccacagcagaaaggacacctag

SEQ ID NO: 23510 - DNA, 876 bp, Artificial Sequence
  Description of Artificial Sequence: Synthetic coding sequence
atggccaagggcagagtggccgagagaagccagctgggcgcccaccacaccacccccgtgggcgacggcgccgccggcaccagaggcctggccgcccccggcagcagagaccaccagaaggagaagagctgggtggaggccggcagcgccagaatgagcctgctgatcctggtgagcatcttcctgagcgccgccttcgtgatgttcctggtgtacaagaacttcccccagctgagcgaggaggagagagtgaacatgaaggtgcccagagacatggacgacgccaaggccctgggcaaggtgctgagcaagtacaaggacaccttctacgtgcaggtgctggtggcctacttcgccacctacatcttcctgcagaccttcgccatccccggcagcatcttcctgagcatcctgagcggcttcctgtaccccttccccctggccctgttcctggtgtgcctgtgcagcggcctgggcgccagcttctgctacatgctgagctacctggtgggcagacccgtggtgtacaagtacctgaccgagaaggccgtgaagtggagccagcaggtggagagacacagagagcacctgatcaactacatcatcttcctgagaatcacccccttcctgcccaactggttcatcaacatcaccagccccgtgatcaacgtgcccctgaaggtgttcttcatcggcaccttcctgggcgtggccccccccagcttcgtggccatcaaggccggcaccaccctgtaccagctgaccaccgccggcgaggccgtgagctggaacagcatcttcatcctgatgatcctggccgtgctgagcatcctgcccgccatcttccagaagaagctgaagcagaagttcgagtag

SEQ ID NO: 23511 - DNA, 876 bp, Artificial Sequence; identical to SEQ ID NO: 23510
  Description of Artificial Sequence: Synthetic coding sequence

SEQ ID NO: 23512 - DNA, 384 bp, Artificial Sequence
  Description of Artificial Sequence: Synthetic coding sequence
atggccaagggcagagtggccgagagaagccagctgggcgcccaccacaccacccccgtgggcgacggcgccgccggcaccagaggcctggccgcccccggcagcagagaccaccagaaggagaagagctgggtggaggccggcagcgccagaatgagcctgctgatcctggtgagcatcttcctgagcgccgccttcgtgatgttcctggtgtacaagaacttcccccagctgagcgaggaggagagagtgaacatgaaggtgcccagagacatggacgacgccaaggccctgggcaaggtgctgagcaagtacaaggacaccttctacgtgcaggtgctggtggcctacttcgccacctacatcctgtaccccttcaactag

SEQ ID NO: 23513 - DNA, 480 bp, Artificial Sequence
  Description of Artificial Sequence: Synthetic coding sequence
atggccgagagacccggcccccccggcggcgccgtgagcgccaccgcctaccccgacacccccgccgagttccccccccacctgcaggccggcgccatgagaagaagattctggggcgtgttcaactgcctgtgcgccggcgccttcggcgccctggccgccgccagcgccaagctggccttcggcagcgaggtgagcatgggcctgtgcgtgctgggcatcatcgtgatggccagcaccaacagcctgatgtggaccttcttcagcagaggcctgagcttcagcatgagcagcgccatcgccagcgtgaccgtgaccttcagcaacatcctgagcagcgccttcctgggctacgtgctgtacggcgagtgccaggaggtgctgtggtggggcggcgtgttcctgatcctgtgcggcctgaccctgatccacagaaagctgccccccacctggaagcccctgccccacaagcagcagtag

SEQ ID NO: 23514 - DNA, 828 bp, Artificial Sequence
  Description of Artificial Sequence: Synthetic coding sequence
atgggcaacttcagaggccacgccctgcccggcaccttcttcttcatcatcggcctgtggtggtgcaccaagagcatcctgaagtacatctgcaagaagcagaagagaacctgctacctgggcagcaagaccctgttctacagactggagatcctggagggcatcaccatcgtgggcatggccctgaccggcatggccggcgagcagttcatccccggcggcccccacctgatgctgtacgactacaagcagggccactggaaccagctgctgggctggcaccacttcaccatgtacttcttcttcggcctgctgggcgtggccgacatcctgtgcttcaccatcagcagcctgcccgtgagcctgaccaagctgatgctgagcaacgccctgttcgtggaggccttcatcttctacaaccacacccacggcagagagatgctggacatcttcgtgcaccagctgctggtgctggtggtgttcctgaccggcctggtggccttcctggagttcctggtgagaaacaacgtgctgctggagctgctgagaagcagcctgatcctgctgcagggcagctggttcttccagatcggcttcgtgctgtacccccccagcggcggccccgcctgggacctgatggaccacgagaacatcctgttcctgaccatctgcttctgctggcactacgccgtgaccatcgtgatcgtgggcatgaactacgccttcatcacctggctggtgaagagcagactgaagagactgtgcagcagcgaggtgggcctgctgaagaacgccgagagagagcaggagagcgaggaggagatgtag

SEQ ID NO: 23515 - DNA, 876 bp, Artificial Sequence
  Description of Artificial Sequence: Synthetic coding sequence
atgaccaacgacagcgagggcaagatgggcttcaagcaccccaagatcatgggcaacttcagaggccacgccctgcccggcaccttcttcttcatcatcggcctgtggtggtgcaccaagagcatcctgaagtacatctgcaagaagcagaagagaacctgctacctgggcagcaagaccctgttctacagactggagatcctggagggcatcaccatcgtgggcatggccctgaccggcatggccggcgagcagttcatccccggcggcccccacctgatgctgtacgactacaagcagggccactggaaccagctgctgggctggcaccacttcaccatgtacttcttcttcggcctgctgggcgtggccgacatcctgtgcttcaccatcagcagcctgcccgtgagcctgaccaagctgatgctgagcaacgccctgttcgtggaggccttcatcttctacaaccacacccacggcagagagatgctggacatcttcgtgcaccagctgctggtgctggtggtgttcctgaccggcctggtggccttcctggagttcctggtgagaaacaacgtgctgctggagctgctgagaagcagcctgatcctgctgcagggcagctggttcttccagatcggcttcgtgctgtacccccccagcggcggccccgcctgggacctgatggaccacgagaacatcctgttcctgaccatctgcttctgctggcactacgccgtgaccatcgtgatcgtgggcatgaactacgccttcatcacctggctggtgaagagcagactgaagagactgtgcagcagcgaggtgggcctgctgaagaacgccgagagagagcaggagagcgaggaggagatgtag

SEQ ID NO: 23516 - DNA, 828 bp, Artificial Sequence
  Description of Artificial Sequence: Synthetic coding sequence
atggccaacttcaagggccacgccctgcccggcagcttcttcctgatcatcggcctgtgctggagcgtgaagtaccccctgaagtacttcagccacaccagaaagaacagccccctgcactactaccagagactggagatcgtggaggccgccatcagaaccctgttcagcgtgaccggcatcctggccgagcagttcgtgcccgacggcccccacctgcacctgtaccacgagaaccactggatcaagctgatgaactggcagcacagcaccatgtacctgttcttcgccgtgagcggcatcgtggacatgctgacctacctggtgagccacgtgcccctgggcgtggacagactggtgatggccgtggccgtgttcatggagggcttcctgttctactaccacgtgcacaacagaccccccctggaccagcacatccacagcctgctgctgtacgccctgttcggcggctgcgtgagcatcagcctggaggtgatcttcagagaccacatcgtgctggagctgttcagaaccagcctgatcatcctgcagggcacctggttctggcagatcggcttcgtgctgttcccccccttcggcacccccgagtgggaccagaaggacgacgccaacctgatgttcatcaccatgtgcttctgctggcactacctggccgccctgagcatcgtggccgtgaactacagcctggtgtactgcctgctgaccagaatgaagagacacggcagaggcgagatcatcggcatccagaagctgaacagcgacgacacctaccagaccgccctgctgagcggcagcgacgaggagtag

SEQ ID NO: 23517 - DNA, 828 bp, Artificial Sequence; identical to SEQ ID NO: 23516
  Description of Artificial Sequence: Synthetic coding sequence

SEQ ID NO: 23518 - DNA, 474 bp, Artificial Sequence
  Description of Artificial Sequence: Synthetic coding sequence
atgagcggcttcctggagggcctgagatgcagcgagtgcatcgactggggcgagaagagaaacaccatcgccagcatcgccgccggcgtgctgttcttcaccggctggtggatcatcatcgacgccgccgtgatctaccccaccatgaaggacttcaaccacagctaccacgcctgcggcgtgatcgccaccatcgccttcctgatgatcaacgccgtgagcaacggccaggtgagaggcgacagctacagcgagggctgcctgggccagaccggcgccagaatctggctgttcgtgggcttcatgctggccttcggcagcctgatcgccagcatgtggatcctgttcggcggctacgtggccaaggagaaggacatcgtgtaccccggcatcgccgtgttcttccagaacgccttcatcttcttcggcggcctggtgttcaagttcggcagaaccgaggacctgtggcagtag

SEQ ID NO: 23519 - DNA, 477 bp, Artificial Sequence
  Description of Artificial Sequence: Synthetic coding sequence
atggccggcttcctggacaacttcagatggcccgagtgcgagtgcatcgactggagcgagagaagaaacgccgtggccagcgtggtggccggcatcctgttcttcaccggctggtggatcatgatcgacgccgccgtggtgtaccccaagcccgagcagctgaaccacgccttccacacctgcggcgtgttcagcaccctggccttcttcatgatcaacgccgtgagcaacgcccaggtgagaggcgacagctacgagagcggctgcctgggcagaaccggcgccagagtgtggctgttcatcggcttcatgctgatgttcggcagcctgatcgccagcatgtggatcctgttcggcgcctacgtgacccagaacaccgacgtgtaccccggcctggccgtgttcttccagaacgccctgatcttcttcagcaccctgatctacaagttcggcagaaccgaggagctgtggacctag

SEQ ID NO: 23520 - DNA, 246 bp, Artificial Sequence
  Description of Artificial Sequence: Synthetic coding sequence
atggccggcttcctggacaacttcagatggcccgagtgcgagtgcatcgactggagcgagagaagaaacgccgtggccagcgtggtggccggcatcctgttcttcaccggctggtggatcatgatcgacgccgccgtggtgtaccccaagcccgagcagctgaaccacgccttccacacctgcggcgtgttcagcaccctggccttcttcatgatcaacgccgtgagcaacgcccaggtgagatag

SEQ ID NO: 23521 - DNA, 189 bp, Artificial Sequence
  Description of Artificial Sequence: Synthetic coding sequence
atggccggcttcctggacaacttcagatggcccgagtgcgagtgcatcgactggagcgagagaagaaacgccgtggccagcgtggtggccggcatcctgttcttcaccggctggtggatcatgatcgacgccgccgtggtgtaccccaagcccgagcagctgaaccacgccttccacacctgcggctag

SEQ ID NO: 23522 - DNA, 381 bp, Artificial Sequence
  Description of Artificial Sequence: Synthetic coding sequence
atggccggcttcctggacaacttcagatggcccgagtgcgagtgcatcgactggagcgagagaagaaacgccgtggccagcgtggtggccggcatcctgttcttcaccggctggtggatcatgatcgacgccgccgtggtgtaccccaagcccgagcagctgaaccacgccttccacacctgcggcgtgttcagcaccctggccttcttcatgatcaacgccgtgagcaacgcccaggtgagaggcgacagctacgagagcggctgcctgggcagaaccggcgccagagtgtggctgttcatcggcttcatgctgatgttcggcagcctgatcgccagcatgtggatcctgttcggcgcctacgtgacccagaacctgtag

SEQ ID NO: 23523 - DNA, 477 bp, Artificial Sequence; identical to SEQ ID NO: 23519
  Description of Artificial Sequence: Synthetic coding sequence

SEQ ID NO: 23524 - DNA, 762 bp, Artificial Sequence
  Description of Artificial Sequence: Synthetic coding sequence
atgatggcccagagcaaggccaacggcagccactacgccctgaccgccatcggcctgggcatgctggtgctgggcgtgatcatggccatgtggaacctggtgcccggcttcagcgccgccgagaagcccaccgcccagggcagcaacaagaccgaggtgggcggcggcatcctgaagagcaagaccttcagcgtggcctacgtgctggtgggcgccggcgtgatgctgctgctgctgagcatctgcctgagcatcagagacaagagaaagcagagacagggcgaggacctggcccacgtgcagcaccccaccggcgccggcccccacgcccaggaggaggacagccaggaggaggaggaggaggacgaggaggccgccagcagatactacgtgcccagctacgaggaggtgatgaacaccaactacagcgaggccagaggcgaggagcagaaccccagactgagcatcagcctgcccagctacgagagcctgaccggcctggacgagaccacccccaccagcaccagagccgacgtggaggccagccccggcaacccccccgacagacagaacagcaagctggccaagagactgaagcccctgaaggtgagaagaatcaagagcgagaagctgcacctgaaggacttcagaatcaacctgcccgacaagaacgtgcccccccccagcatcgagcccctgaccccccccccccagtacgacgaggtgcaggagaaggcccccgacaccagaccccccgactag

SEQ ID NO: 23525 - DNA, 762 bp, Artificial Sequence; identical to SEQ ID NO: 23524
  Description of Artificial Sequence: Synthetic coding sequence

SEQ ID NO: 23526 - DNA, 762 bp, Artificial Sequence; identical to SEQ ID NO: 23524
  Description of Artificial Sequence: Synthetic coding sequence

SEQ ID NO: 23527 - DNA, 762 bp, Artificial Sequence; identical to SEQ ID NO: 23524
  Description of Artificial Sequence: Synthetic coding sequence

SEQ ID NO: 23528 - DNA, 762 bp, Artificial Sequence; identical to SEQ ID NO: 23524
  Description of Artificial Sequence: Synthetic coding sequence

SEQ ID NO: 23529 - DNA, 762 bp, Artificial Sequence; identical to SEQ ID NO: 23524
  Description of Artificial Sequence: Synthetic coding sequence

SEQ ID NO: 23530 - DNA, 528 bp, Artificial Sequence
  Description of Artificial Sequence: Synthetic coding sequence
atgatggcccagagcaaggccaacggcagccactacgccctgaccgccatcggcctgggcatgctggtgctgggcgtgatcatggccatgtggaacctggtgcccggcttcagcgccgccgagaagcccaccgcccagggcagcaacaagaccgaggtgggcggcggcatcctgaagagcaagaccttcagcgtggcctacgtgctggtgggcgccggcgtgatgctgctgctgctgagcatctgcctgagcatcagagacaagagaaagcagagacagggcgaggacctggcccacgtgcagcaccccaccggcgccggcccccacgcccaggaggaggacagccaggaggaggaggaggaggacgaggaggccgccagcagatactacgtgcccagctacgaggaggtgatgaacaccaactacagcgaggccagaggcgaggagcagaaccccagactgagcatcagcctgcccagctacgagagcctgaccggcctggacgagaccacccccaccagcacctag

SEQ ID NO: 23531 - DNA, 630 bp, Artificial Sequence
  Description of Artificial Sequence: Synthetic coding sequence
atggccagaggccccctggccgccagaggcctgagactgctgctgcccctgctgcccctgctgcccctgctgcccctgccccaggtggccctgggcttcgccgacggcagctgcgaccccagcgaccagtgccccccccaggccagatggagcagcctgtggcacgtgggcctgatcctgctggccgtgctgctgctgctgctgtgcggcgtgaccgccggctgcgtgagattctgctgcctgagaaagcaggcccaggcccagccccacctgccccccgccagacagccctgcgacgtggccgtgatccccatggacagcgacagccccgtgcacagcaccgtgaccagctacagcagcgtgcagtaccccctgggcatgagactgcccctgcccttcggcgagctggacctggacagcatggccccccccgcctacagcctgtacacccccgagcccccccccagctacgacgaggccgtgaagatggccaagcccagagaggagggccccgccctgagccagaagcccagccccctgctgggcgccagcggcctggagaccacccccgtgccccaggagagcggccccaacacccagctgcccccctgcagccccggcgccccctag

SEQ ID NO: 23532 - DNA, 375 bp, Artificial Sequence
  Description of Artificial Sequence: Synthetic coding sequence
ggcggcagatggccccccgccgactgcggctgctgctgcagaagctgcagaagctgcagaagctgcagatgcagaagatgggtgggcagaagaagcctgagcgtgagaccccccagaggcggcagcctgctgggccccagacccagcagagcccacccctgcccccacagatggagatgggccagcagaaccgccgccgccacccccagaaccagcgccagacccagacccgccggcgccgcctgcggcacctgggcctgcacccccagaagcctgcacccccccaccatgaagctgagcagatggcccagccccgagagaaaggaccagcacagccccagaaaccccgccctgagcctgggccccagagcctag

SEQ ID NO: 23533 - DNA, 585 bp, Artificial Sequence
  Description of Artificial Sequence: Synthetic coding sequence
atggagagacactgcctgctgttcatcctgctgacctgcctgagatggctgtgccacgacatcccccagggcgccggcgccagatggcccagagtgagccccgtggtggagccctgcagccccagactgatcctgctggccgtgctgctgctgctgctgtgcggcgtgaccgccggctgcgtgagattctgctgcctgagaaagcaggcccaggcccagccccacctgccccccgccagacagccctgcgacgtggccgtgatccccatggacagcgacagccccgtgcacagcaccgtgaccagctacagcagcgtgcagtaccccctgggcatgagactgcccctgcccttcggcgagctggacctggacagcatggccccccccgcctacagcctgtacacccccgagcccccccccagctacgacgaggccgtgaagatggccaagcccagagaggagggccccgccctgagccagaagcccagccccctgctgggcgccagcggcctggagaccacccccgtgccccaggagagcggccccaacacccagctgcccccctgcagccccggcgccccctag

SEQ ID NO: 23534 - DNA, 312 bp, Artificial Sequence
  Description of Artificial Sequence: Synthetic coding sequence
atggccagaggccccctggccgccagaggcctgagactgctgctgcccctgctgcccctgctgcccctgctgcccctgccccaggtgggcagagccgccttcagcctgggcagcgccaccgccggcagagtgcccgccagaaccacccccctgcccggcagccccctgagcccccaggtggccctgggcttcgccgacggcagctgcgaccccagcgaccagtgccccccccaggccagatggagcagcctgtggcacgtgggcctgatcctgctggccgtgctgctgctgctgctgtgcggcgtgacctag

SEQ ID NO: 23535 - DNA, 744 bp, Artificial Sequence
  Description of Artificial Sequence: Synthetic coding sequence
atggccagcgccgagctggactacaccatcgagatccccgaccagccctgctggagccagaagaacagccccagccccggcggcaaggaggccgagaccagacagcccgtggtgatcctgctgggctggggcggctgcaaggacaagaacctggccaagtacagcgccatctaccacaagagaaagctgctggagctgctgttcgactacgagatcgagaaggagcccctgctgttccacgtgttcagcaacggcggcgtgatgctgtacagatacgtgctggagctgctgcagaccagaagattctgcagactgagagtggtgggcaccatcttcgacagcgcccccggcgacagcaacctggtgggcgccctgagagccctggccgccatcctggagagaagagccgccatgctgagactgctgctgctggtggccttcgccctggtggtggtgctgttccacgtgctgctggcccccatcaccgccctgttccacacccacttctacgacagactgcaggacgccggcagcagatggcccgagctgtacctgtacagcagagccgacgaggtggtgctggccagagacatcgagagaatggtggaggccagactggccagaagagtgctggccagaagcgtggacttcgtgagcagcgcccacgtgagccacctgagagactaccccacctactacaccagcctgtgcgtggacttcatgagaaactgcgtgagatgctag

SEQ ID NO: 23536 - DNA, 834 bp, Artificial Sequence
  Description of Artificial Sequence: Synthetic coding sequence
atggccagcgccgagctggactacaccatcgagatccccgaccagccctgctggagccagaagaacagccccagccccggcggcaaggaggccgagaccagacagcccgtggtgatcctgctgggctggggcggctgcaaggacaagaacctggccaagtacagcgccatctaccacaagagaggctgcatcgtgatcagatacaccgccccctggcacatggtgttcttcagcgagagcctgggcatccccagcctgagagtgctggcccagaagctgctggagctgctgttcgactacgagatcgagaaggagcccctgctgttccacgtgttcagcaacggcggcgtgatgctgtacagatacgtgctggagctgctgcagaccagaagattctgcagactgagagtggtgggcaccatcttcgacagcgcccccggcgacagcaacctggtgggcgccctgagagccctggccgccatcctggagagaagagccgccatgctgagactgctgctgctggtggccttcgccctggtggtggtgctgttccacgtgctgctggcccccatcaccgccctgttccacacccacttctacgacagactgcaggacgccggcagcagatggcccgagctgtacctgtacagcagagccgacgaggtggtgctggccagagacatcgagagaatggtggaggccagactggccagaagagtgctggccagaagcgtggacttcgtgagcagcgcccacgtgagccacctgagagactaccccacctactacaccagcctgtgcgtggacttcatgagaaactgcgtgagatgctag

SEQ ID NO: 23537 - DNA, 606 bp, Artificial Sequence
  Description of Artificial Sequence: Synthetic coding sequence
atggccagcgccgagctggactacaccatcgagatccccgaccagccctgctggagccagaagaacagccccagccccggcggcaaggaggccgagaccagacagcccgtggtgatcctgctgggctggggcggctgcaaggacaagaacctggccaagtacagcgccatctaccacaagagaggctgcatcgtgatcagatacaccgccccctggcacatggtgttcttcagcgagagcctgggcatccccagcctgagagtgctggcccagaagctgctggagctgctgttcgactacgagatcgagaaggagcccctgctgttccacgtgttcagcaacggcggcgtgatgctgtacagatacgtgctggagctgctgcagaccagaagattctgcagactgagagtggtgggcaccatcttcgacagcgcccccggcgacagcaacctggtgttctgcatggccagctgcctgctgctgagccccctgctggtggacggcatcagcgccggcaccgagggccagctgaccctgagacccgactgggccgcccaggtgctgaccagactgggctgccacctgcagtgcatcaccagaagctag

SEQ ID NO: 23538 - DNA, 336 bp, Artificial Sequence
  Description of Artificial Sequence: Synthetic coding sequence
atggccagcgccgagctggactacaccatcgagatccccgaccagccctgctggagccagaagaacagccccagccccggcggcaaggaggccgagaccagacagcccgtggtgatcctgctgggctggggcggctgcaaggacaagaacctggccaagtacagcgccatctaccacaagagagtgttctgcatggccagctgcctgctgctgagccccctgctggtggacggcatcagcgccggcaccgagggccagctgaccctgagacccgactgggccgcccaggtgctgaccagactgggctgccacctgcagtgcatcaccagaagctag

SEQ ID NO: 23539 - DNA, 237 bp, Artificial Sequence
  Description of Artificial Sequence: Synthetic coding sequence
atggccagcgccgagctggactacaccatcgagatccccgaccagccctgctggagccagagcctgctgcacggcctgctgctggccgccttcaccatcgccggcggctggcacctgtgctgggacagaggcgccacccacacccccgccagactgggcagcaccggcgccaacgccgcctggctgagccccagcatgcaccaccccaagctgagagcccccctgagacacagctag

SEQ ID NO: 23540 - DNA, 408 bp, Artificial Sequence
  Description of Artificial Sequence: Synthetic coding sequence
atggccagcgccgagctggactacaccatcgagatccccgaccagccctgctggagccagaagaacagccccagccccggcggcaaggaggccgagaccagacagcccgtggtgatcctgctgggctggggcggctgcaaggacaagaacctggccaagtacagcgccatctaccacaagagactgctggagctgctgttcgactacgagatcgagaaggagcccctgctgttccacgtgttcagcaacggcggcgtgatgctgtacagatacgtgctggagctgctgcagaccagaagattctgcagactgagagtggtgggcaccatcttcgacagcgcccccggcgacagcaacctggtgggcgccctgagagccctggccgccatcctggagagaagagcctag

SEQ ID NO: 23541 - DNA, 510 bp, Artificial Sequence
  Description of Artificial Sequence: Synthetic coding sequence
atgtgcctgagactgggcggcctgagcgtgggcgacttcagaaaggtgctgatgaagaccggcctggtgctggtggtgctgggccacgtgagcttcatcaccgccgccctgttccacggcaccgtgctgagatacgtgggcaccccccaggacgccgtggccctgcagtactgcgtggtgaacatcctgagcgtgaccagcgccatcgtgggcaaggccctgctggccgcctgcaccttcggcagcagcgagctgctggccctggcccccgactgccccttcgaccccaccagaatctacagcagcagcctgtgcctgtggggcatcgccctggtgctgtgcgtggccgagaacgtgttcgccgtgagatgcgcccagctgacccaccagctgctggagctgagaccctggtggggcaagagcagccaccacatgatgagagagaaccccgagctggtggagggcagagacctgctgagctgcaccagcagcgagcccctgaccctgtag

SEQ ID NO: 23542 - DNA, 669 bp, Artificial Sequence
  Description of Artificial Sequence: Synthetic coding sequence
atgtgcctgagactgggcggcctgagcgtgggcgacttcagaaaggtgctgatgaagaccggcctggtgctggtggtgctgggccacgtgagcttcatcaccgccgccctgttccacggcaccgtgctgagatacgtgggcaccccccaggacgccgtggccctgcagtactgcgtggtgaacatcctgagcgtgaccagcgccatcgtggtgatcaccagcggcatcgccgccatcgtgctgagcagatacctgcccagcacccccctgagatggaccgtgttcagcagcagcgtggcctgcgccctgctgagcctgacctgcgccctgggcctgctggccagcatcgccatgaccttcgccacccagggcaaggccctgctggccgcctgcaccttcggcagcagcgagctgctggccctggcccccgactgccccttcgaccccaccagaatctacagcagcagcctgtgcctgtggggcatcgccctggtgctgtgcgtggccgagaacgtgttcgccgtgagatgcgcccagctgacccaccagctgctggagctgagaccctggtggggcaagagcagccaccacatgatgagagagaaccccgagctggtggagggcagagacctgctgagctgcaccagcagcgagcccctgaccctgtag

SEQ ID NO: 23543 - DNA, 834 bp, Artificial Sequence
  Description of Artificial Sequence: Synthetic coding sequence
atggccgccgacggcgagagaagccccctgctgagcgagcccatcgacggcggcgccggcggcaacggcctggtgggccccggcggcagcggcgccggccccggcggcggcctgacccccagcgcccccccctacggcgccgccttcccccccttccccgagggccaccccgccgtgctgcccggcgaggacccccccccctacagccccctgaccagccccgacagcggcagcgcccccatgatcacctgcagagtgtgccagagcctgatcaacgtggagggcaagatgcaccagcacgtggtgaagtgcggcgtgtgcaacgaggccacccccatcaagaacgccccccccggcaagaagtacgtgagatgcccctgcaactgcctgctgatctgcaaggtgaccagccagagaatcgcctgccccagaccctactgcaagagaatcatcaacctgggccccgtgcaccccggccccctgagccccgagccccagcccatgggcgtgagagtgatctgcggccactgcaagaacaccttcctgtggaccgagttcaccgacagaaccctggccagatgcccccactgcagaaaggtgagcagcatcggcagaagataccccagaaagagatgcatctgctgcttcctgctgggcctgctgctggccgtgaccgccaccggcctggccttcggcacctggaagcacgccagaagatacggcggcatctacgccgcctgggccttcgtgatcctgctggccgtgctgtgcctgggcagagccctgtactgggcctgcatgaaggtgagccaccccgtgcagaacttcagctag

SEQ ID NO: 23544 - DNA, 855 bp, Artificial Sequence
  Description of Artificial Sequence: Synthetic coding sequence
atggccgccgacggcgagagaagccccctgctgagcgagcccatcgacggcggcgccggcggcaacggcctggtgggccccggcggcagcggcgccggccccggcggcggcctgacccccagcgcccccccctacggcgccggcaagcacgcccccccccaggccttcccccccttccccgagggccaccccgccgtgctgcccggcgaggacccccccccctacagccccctgaccagccccgacagcggcagcgcccccatgatcacctgcagagtgtgccagagcctgatcaacgtggagggcaagatgcaccagcacgtggtgaagtgcggcgtgtgcaacgaggccacccccatcaagaacgccccccccggcaagaagtacgtgagatgcccctgcaactgcctgctgatctgcaaggtgaccagccagagaatcgcctgccccagaccctactgcaagagaatcatcaacctgggccccgtgcaccccggccccctgagccccgagccccagcccatgggcgtgagagtgatctgcggccactgcaagaacaccttcctgtggaccgagttcaccgacagaaccctggccagatgcccccactgcagaaaggtgagcagcatcggcagaagataccccagaaagagatgcatctgctgcttcctgctgggcctgctgctggccgtgaccgccaccggcctggccttcggcacctggaagcacgccagaagatacggcggcatctacgccgcctgggccttcgtgatcctgctggccgtgctgtgcctgggcagagccctgtactgggcctgcatgaaggtgagccaccccgtgcagaacttcagctag

SEQ ID NO: 23545 - DNA, 792 bp, Artificial Sequence
  Description of Artificial Sequence: Synthetic coding sequence
atggagatcaacaccaagctgctgatcagcgtgacctgcatcagcttcttcaccttccagctgctgttctacttcgtgagctactggttcagcgccaaggtgagccccggcttcaacagcctgagcttcaagaagaagatcgagtggaacagcagagtggtgagcacctgccacagcctggtggtgggcatcttcggcctgtacatcttcctgttcgacgaggccaccaaggccgaccccctgtggggcggccccagcctggccaacgtgaacatcgccatcgccagcggctacctgatcagcgacctgagcatcatcatcctgtactggaaggtgatcggcgacaagttcttcatcatgcaccactgcgccagcctgtacgcctactacctggtgctgaagaacggcgtgctggcctacatcggcaacttcagactgctggccgagctgagcagccccttcgtgaaccagagatggttcttcgaggccctgaagtaccccaagttcagcaaggccatcgtgatcaacggcatcctgatgaccgtggtgttcttcatcgtgagaatcgccagcatgctgccccactacggcttcatgtacagcgtgtacggcaccgagccctacatcagactgggcgtgctgatccagctgagctgggtgatcagctgcgtggtgctggacgtgatgaacgtgatgtggatgatcaagatcagcaagggctgcatcaaggtgatcagccacatcagacaggagaaggccaagaacagcctgcagaacggcaagctggactag

SEQ ID NO: 23546 - DNA, 432 bp, Artificial Sequence
  Description of Artificial Sequence: Synthetic coding sequence
atggagatcaacaccaagctgctgatcagcgtgacctgcatcagcttcttcaccttccagctgctgttctacttcgtgagctactggttcagcgccaaggtgagccccggcttcaacagcctgagcttcaagaagaagatcgagtggaacagcagagtggtgagcacctgccacagcctggtggtgggcatcttcggcctgtacatcttcctgttcgacgaggccaccaaggccgaccccctgtggggcggccccagcctggccaacgtgaacatcgccatcgccagcggctacctgatcagcgacctgagcatcatcatcctgtactggaaggtgatcggcgacaagttcttcatcatgcaccactgcgccagcctgtacgcctactacctggtgctgaagaacggcgtgctggcctacatcggcaactag

SEQ ID NO: 23547 - DNA, 465 bp, Artificial Sequence
  Description of Artificial Sequence: Synthetic coding sequence
atggagatcaacaccaagctgctgatcagcgtgacctgcatcagcttcttcaccttccagctgctgttctacttcgtgagctactggttcagcgccaaggtgagccccggcttcaacagcctgagcttcaagaagaagatcgagtggaacagcagagtggtgagcacctgccacagcctggtggtgggcatcttcggcctgtacatcttcctgttcgacgaggccaccaaggccgaccccctgtggggcggccccagcctggccaacgtgaacatcgccatcgccagcggctacctgatcagcgacctgagcatcatcatcctgtactggaaggtgatcggcgacaagttcttcatcatgcaccactgcgccagcctgtacgcctactacctggtgctgaagaacggcgtgctggcctacatcggcaacttcagactgctggccgagctgagcagccccttctag

SEQ ID NO: 23548 - DNA, 1995 bp, Artificial Sequence
  Description of Artificial Sequence: Synthetic coding sequence
atgaagagaagaaacgccgactgcagcaagctgagaagacccctgaagagaaacagaatcaccgagggcatctacggcagcaccttcctgtacctgaagttcctggtggtgtgggccctggtgctgctggccgacttcgtgctggagttcagattcgagtacctgtggcccttctggctgttcatcagaagcgtgtacgacagcttcagataccagggcctggccttcagcgtgttcttcgtgtgcgtggccttcaccagcaacatcatctgcctgctgttcatccccatccagtggctgttcttcgccgccagcacctacgtgtgggtgcagtacgtgtggcacaccgagagaggcgtgtgcctgcccaccgtgagcctgtggatcctgttcgtgtacatcgaggccgccatcagattcaaggacctgaagaacttccacgtggacctgtgcagacccttcgccgcccactgcatcggctaccccgtggtgaccctgggcttcggcttcaagagctacgtgagctacaagatgagactgagaaagcagaaggaggtgcagaaggagaacgagttctacatgcagctgctgcagcaggccctgccccccgagcagcagatgctgcagaagcaggagaaggaggccgaggaggccgccaagggcctgcccgacatggacagcagcatcctgatccaccacaacggcggcatccccgccaacaagaagctgagcaccaccctgcccgagatcgagtacagagagaagggcaaggagaaggacaaggacgccaagaagcacaacctgggcatcaacaacaacaacatcctgcagcccgtggacagcaagatccaggagatcgagtacatggagaaccacatcaacagcaagagactgaacaacgacctggtgggcagcaccgagaacctgctgaaggaggacagctgcaccgccagcagcaagaactacaagaacgccagcggcgtggtgaacagcagccccagaagccacagcgccaccaacggcagcatccccagcagcagcagcaagaacgagaagaagcagaagtgcaccagcaagagccccagcacccacaaggacctgatggagaactgcatccccaacaaccagctgagcaagcccgacgccctggtgagactggagcaggacatcaagaagctgaaggccgacctgcaggccagcagacaggtggagcaggagctgagaagccagatcagcagcctgagcagcaccgagagaggcatcagaagcgagatgggccagctgagacaggagaacgagctgctgcagaacaagctgcacaacgccgtgcagatgaagcagaaggacaagcagaacatcagccagctggagaagaagctgaaggccgagcaggaggccagaagcttcgtggagaagcagctgatggaggagaagaagagaaagaagctggaggaggccaccgccgccagagccgtggccttcgccgccgccagcagaggcgagtgcaccgagaccctgagaaacagaatcagagagctggaggccgagggcaagaagctgaccatggacatgaaggtgaaggaggaccagatcagagagctggagctgaaggtgcaggagctgagaaagtacaaggagaacgagaaggacaccgaggtgctgatgagcgccctgagcgccatgcaggacaagacccagcacctggagaacagcctgagcgccgagaccagaatcaagctggacctgttcagcgccctgggcgacgccaagagacagctggagatcgcccagggccagatcctgcagaaggaccaggagatcaaggacctgaagcagaagatcgccgaggtgatggccgtgatgcccagcatcacctacagcgccgccaccagccccctgagccccgtgagcccccactacagcagcaagttcgtggagaccagccccagcggcctggaccccaacgccagcgtgtaccagcccctgaagaagtag

SEQ ID NO: 23549 - DNA, 921 bp, Artificial Sequence
  Description of Artificial Sequence: Synthetic coding sequence
atgaagagaagaaacgccgactgcagcaagctgagaagacccctgaagagaaacagaatcaccgagggcatctacggcagactggagcaggacatcaagaagctgaaggccgacctgcaggccagcagacaggtggagcaggagctgagaagccagatcagcagcctgagcagcaccgagagaggcatcagaagcgagatgggccagctgagacaggagaacgagctgctgcagaacaagctgcacaacgccgtgcagatgaagcagaaggacaagcagaacatcagccagctggagaagaagctgaaggccgagcaggaggccagaagcttcgtggagaagcagctgatggaggagaagaagagaaagaagctggaggaggccaccgccgccagagccgtggccttcgccgccgccagcagaggcgagtgcaccgagaccctgagaaacagaatcagagagctggaggccgagggcaagaagctgaccatggacatgaaggtgaaggaggaccagatcagagagctggagctgaaggtgcaggagctgagaaagtacaaggagaacgagaaggacaccgaggtgctgatgagcgccctgagcgccatgcaggacaagacccagcacctggagaacagcctgagcgccgagaccagaatcaagctggacctgttcagcgccctgggcgacgccaagagacagctggagatcgcccagggccagatcctgcagaaggaccaggagatcaaggacctgaagcagaagatcgccgaggtgatggccgtgatgcccagcatcacctacagcgccgccaccagccccctgagccccgtgagcccccactacagcagcaagttcgtggagaccagccccagcggcctggaccccaacgccagcgtgtaccagcccctgaagaagtag

SEQ ID NO: 23550 - DNA, 1314 bp, Artificial Sequence
  Description of Artificial Sequence: Synthetic coding sequence
atgaagagaagaaacgccgactgcagcaagctgagaagacccctgaagagaaacagaatcaccgagggcatctacggcagcaccttcctgtacctgaagttcctggtggtgtgggccctggtgctgctggccgacttcgtgctggagttcagattcgagtacctgtggcccttctggctgttcatcagaagcgtgtacgacagcttcagataccagggcctggccttcagcgtgttcttcgtgtgcgtggccttcaccagcaacatcatctgcctgctgttcatccccatccagtggctgttcttcgccgccagcacctacgtgtgggtgcagtacgtgtggcacaccgagagaggcgtgtgcctgcccaccgtgagcctgtggatcctgttcgtgtacatcgaggccgccatcagattcaaggacctgaagaacttccacgtggacctgtgcagacccttcgccgcccactggctggagcaggacatcaagaagctgaaggccgacctgcaggccagcagacaggtggagcaggagctgagaagccagatcagcagcctgagcagcaccgagagaggcatcagaagcgagatgggccagctgagacaggagaacgagctgctgcagaacaagctgcacaacgccgtgcagatgaagcagaaggacaagcagaacatcagccagctggagaagaagctgaaggccgagcaggaggccagaagcttcgtggagaagcagctgatggaggagaagaagagaaagaagctggaggaggccaccgccgccagagccgtggccttcgccgccgccagcagaggcgagtgcaccgagaccctgagaaacagaatcagagagctggaggccgagggcaagaagctgaccatggacatgaaggtgaaggaggaccagatcagagagctggagctgaaggtgcaggagctgagaaagtacaaggagaacgagaaggacaccgaggtgctgatgagcgccctgagcgccatgcaggacaagacccagcacctggagaacagcctgagcgccgagaccagaatcaagctggacctgttcagcgccctgggcgacgccaagagacagctggagatcgcccagggccagatcctgcagaaggaccaggagatcaaggacctgaagcagaagatcgccgaggtgatggccgtgatgcccagcatcacctacagcgccgccaccagccccctgagccccgtgagcccccactacagcagcaagttcgtggagaccagccccagcggcctggaccccaacgccagcgtgtaccagcccctgaagaagtag

SEQ ID NO: 23551 - DNA, 627 bp, Artificial Sequence
  Description of Artificial Sequence: Synthetic coding sequence
atggacaagttcgtgatcagaacccccagaatccagaacagcccccagaagaaggacagcggcggcaaggtgtacaagcaggccaccatcgagagcctgaagagagtggtggtggtggaggacatcaagagatggaagaccatgctggagctgcccgaccagaccaaggagaacctggtggaggccctgcaggagctgaagaagaagatccccagcagagaggtgctgaagagcaccagaatcggccacaccgtgaacaagatgagaaagcacagcgacagcgaggtggccagcctggccagagaggtgtacaccgagtggaagaccttcaccgagaagcacagcaacagacccagcatcgaggtgagaagcgaccccaagaccgagagcctgagaaagaacgcccagaagctgctgagcgaggccctggagctgaagatggaccacctgctggtggagaacatcgagagagagaccttccacctgtgcagcagactgatcaacggcccctacagaagaaccgtgagagccctggtgttcaccctgaagcacagagccgagatcagagcccaggtgaagagcggcagcctgcccgtgggcaccttcgtgcagacccacaagaagtag

SEQ ID NO: 23552 - DNA, 438 bp, Artificial Sequence
  Description of Artificial Sequence: Synthetic coding sequence
atggccgcccccaagggcagcctgtgggtgagaacccagctgggcctgccccccctgctgctgctgaccatggccctggccggcggcagcggcaccgccagcgccgaggccttcgacagcgtgctgggcgacaccgccagctgccacagagcctgccagctgacctaccccctgcacacctaccccaaggaggaggagctgtacgcctgccagagaggctgcagactgttcagcatctgccagttcgtggacgacggcatcgacctgaacagaaccaagctggagtgcgagagcgcctgcaccgaggcctacagccagagcgacgagcagtacgcctgccacctgggctgccagaaccagctgcccttcgccgagctgagacaggagcaggtgagaaacaacaccgccttccagaccagcctgctgagatggcactag

SEQ ID NO: 23553 - DNA, 852 bp, Artificial Sequence
  Description of Artificial Sequence: Synthetic coding sequence
atggccgcccccaagggcagcctgtgggtgagaacccagctgggcctgccccccctgctgctgctgaccatggccctggccggcggcagcggcaccgccagcgccgaggccttcgacagcgtgctgggcgacaccgccagctgccacagagcctgccagctgacctaccccctgcacacctaccccaaggtgagcgccagcctgtacaccgtggaccacatcgaggaggagctgtacgcctgccagagaggctgcagactgttcagcatctgccagttcgtggacgacggcatcgacctgaacagaaccaagctggagtgcgagagcgcctgcaccgaggcctacagccagagcgacgagcagtacgcctgccacctgggctgccagaaccagctgcccttcgccgagctgagacaggagcagctgatgagcctgatgcccaagatgcacctgctgttccccctgaccctggtgagaagcttctggagcgacatgatggacagcgcccagagcttcatcaccagcagctggaccttctacctgcaggccgacgacggcaagatcgtgatcttccagagcaagcccgagatccagtacgccccccacctggagcaggagcccaccaacctgagagagagcagcctgagcaagatgagctacctgcagatgagaaacagccaggcccacagaaacttcctggaggacggcgagagcgacggcttcctgagatgcctgagcctgaacagcggctggatcctgaccaccaccctggtgctgagcgtgatggtgctgctgtggatctgctgcgccaccgtggccaccgccgtggagcagtacgtgcccagcgagtag

SEQ ID NO: 23554 - DNA, 579 bp, Artificial Sequence
  Description of Artificial Sequence: Synthetic coding sequence
atgagcctgatgcccaagatgcacctgctgttccccctgaccctggtgagaagcttctggagcgacatgatggacagcgcccagagcttcatcaccagcagctggaccttctacctgcaggccgacgacggcaagatcgtgatcttccagagcaagcccgagatccagtacgccccccacctggagcaggagcccaccaacctgagagagagcagcctgagcaagatgagctacctgcagatgagaaacagccaggcccacagaaacttcctggaggacggcgagagcgacggcttcctgagatgcctgagcctgaacagcggctggatcctgaccaccaccctggtgctgagcgtgatggtgctgctgtggatctgctgcgccaccgtggccaccgccgtggagcagtacgtgcccagcgagaagctgagcatctacggcgacctggagttcatgaacgagcagaagctgaacagataccccgccagcagcctggtggtggtgagaagcaagaccgaggaccacgaggaggccggccccctgcccaccaaggtgaacctggcccacagcgagatctag

SEQ ID NO: 23555 - DNA, 579 bp, Artificial Sequence; identical to SEQ ID NO: 23554
  Description of Artificial Sequence: Synthetic coding sequence

SEQ ID NO: 23556 - DNA, 579 bp, Artificial Sequence; identical to SEQ ID NO: 23554
  Description of Artificial Sequence: Synthetic coding sequence

SEQ ID NO: 23557 - DNA, 435 bp, Artificial Sequence
  Description of Artificial Sequence: Synthetic coding sequence
atgagcctgatgcccaagatgcacctgctgttccccctgaccctggtgagaagcttctggagcgacatgatggacagcgcccagagcttcatcaccagcagctggaccttctacctgcaggccgacgacggcaagatcgtgatcttccagagcaagcccgagatccagtacgccccccacctggagcaggagcccaccaacctgagagagagcagcctgagcaagatgagctacctgcagatgagaaacagccaggcccacagaaacttcctggaggacggcgagagcgacggcttcctgagatgcctgagcctgaacagcggctggatcctgaccaccaccctggtgctgagcgtgatggtgctgctgtggatctgctgcgccaccgtggccaccgccgtggagcagtacgtgcccagcgaggtgaacctgtag

SEQ ID NO: 23558 - DNA, 435 bp, Artificial Sequence; identical to SEQ ID NO: 23557
  Description of Artificial Sequence: Synthetic coding sequence

SEQ ID NO: 23559 - DNA, 858 bp, Artificial Sequence
  Description of Artificial Sequence: Synthetic coding sequence
atggccgcccccaagggcagcctgtgggtgagaacccagctgggcctgccccccctgctgctgctgaccatggccctggccggcggcagcggcaccgccagcgccgaggccttcgacagcgtgctgggcgacaccgccagctgccacagagcctgccagctgacctaccccctgcacacctaccccaaggtgagcgccagcctgtacaccgtggaccacatcgaggaggagctgtacgcctgccagagaggctgcagactgttcagcatctgccagttcgtggacgacggcatcgacctgaacagaaccaagctggagtgcgagagcgcctgcaccgaggcctacagccagagcgacgagcagtacgcctgccacctgggctgccagaaccagctgcccttcgccgagctgagacaggagcagctgatgagcctgatgcccaagatgcacctgctgttccccctgaccctggtgagaagcttctggagcgacatgatggacagcgcccagagcttcatcaccagcagctggaccttctacctgcaggccgacgacggcaagatcgtgatcttccagagcaagcccgagatccagtacgccccccacctggagcaggagcccaccaacctgagagagagcagcctgagcaagatgagctacctgcagatgagaaacagccaggcccacagaaacttcctggaggacggcgagagcgacggcttcctgagatgcctgagcctgaacagcggctggatcctgaccaccaccctggtgctgagcgtgatggtgctgctgtggatctgctgcgccaccgtggccaccgccgtggagcagtacgtgcccagcgaggtgaactag

SEQ ID NO: 23560 - DNA, 1029 bp, Artificial Sequence
  Description of Artificial Sequence: Synthetic coding sequence
atggccgccgtggccctgatgcccccccccctgctgctgctgctgctgctggccagcccccccgccgccagcgcccccagcgccagagaccccttcgccccccagctgggcgacacccagaactgccagctgagatgcagagacagagacctgggcccccagcccagccaggccggcctggagggcgccagcgagagcccctacgacagagccgtgctgatcagcgcctgcgagagaggctgcagactgttcagcatctgcagattcgtggccagaagcagcaagcccaacgccacccagaccgagtgcgaggccgcctgcgtggaggcctacgtgaaggaggccgagcagcaggcctgcagccacggctgctggagccagcccgccgagcccgagcccgagcagaagagaaaggtgctggaggcccccagcggcgccctgagcctgctggacctgttcagcaccctgtgcaacgacctggtgaacagcgcccagggcttcgtgagcagcacctggacctactacctgcagaccgacaacggcaaggtggtggtgttccagacccagcccatcgtggagagcctgggcttccagggcggcagactgcagagagtggaggtgacctggagaggcagccaccccgaggccctggaggtgcacgtggaccccgtgggccccctggacaaggtgagaaaggccaagatcagagtgaagaccagcagcaaggccaaggtggagagcgaggagccccaggacaacgacttcctgagctgcatgagcagaagaagcggcctgcccagatggatcctggcctgctgcctgttcctgagcgtgctggtgatgctgtggctgagctgcagcaccctggtgaccgcccccggccagcacctgaagttccagcccctgaccctggagcagcacaagggcttcatgatggagcccgactggcccctgtaccccccccccagccacgcctgcgaggacagcctgcccccctacaagctgaagctggacctgaccaagctgtag

SEQ ID NO: 23561 - DNA, 1029 bp, Artificial Sequence; identical to SEQ ID NO: 23560
  Description of Artificial Sequence: Synthetic coding sequence

SEQ ID NO: 23562 - DNA, 402 bp, Artificial Sequence
  Description of Artificial Sequence: Synthetic coding sequence
atgagaatgagcctggcccagagagtgctgctgacctggctgttcaccctgctgttcctgatcatgctggtgctgaagctggacgagaaggccccctggaactggttcctgatcttcatccccgtgtggatcttcgacaccatcctgctggtgctgctgatcgtgaagatggccggcagatgcaagagcggcttcgaccccagacacggcagccacaacatcaagaagaaggcctggtacctgatcgccatgctgctgaagctggccttctgcctggccctgtgcgccaagctggagcagttcaccaccatgaacctgagctacgtgttcatccccctgtgggccctgctggccggcgccctgaccgagctgggctacaacgtgttcttcgtgagagactag

SEQ ID NO: 23563 - DNA, 633 bp, Artificial Sequence
  Description of Artificial Sequence: Synthetic coding sequence
atggccctgccccagatgtgcgacggcagccacctggccagcaccctgagatactgcatgaccgtgagcggcaccgtggtgctggtggccggcaccctgtgcttcgcctggtggagcgagggcgacgccaccgcccagcccggccagctggccccccccaccgagtaccccgtgcccgagggccccagccccctgctgagaagcgtgagcttcgtgtgctgcggcgccggcggcctgctgctgctgatcggcctgctgtggagcgtgaaggccagcatccccggcccccccagatgggacccctaccacctgagcagagacctgtactacctgaccgtggagagcagcgagaaggagagctgcagaacccccaaggtggtggacatccccacctacgaggaggccgtgagcttccccgtggccgagggcccccccaccccccccgcctaccccaccgaggaggccctggagcccagcggcagcagagacgccctgctgagcacccagcccgcctggcccccccccagctacgagagcatcagcctggccctggacgccgtgagcgccgagaccacccccagcgccaccagaagctgcagcggcctggtgcagaccgccagaggcggcagctag

SEQ ID NO: 23564 - DNA, 1932 bp, Artificial Sequence
  Description of Artificial Sequence: Synthetic coding sequence
atggccgccgtgctggccctgagagtggtggccggcctggccgccgccgccctggtggccatgctgctggagcactacggcctggccggccagcccagccccctgcccagacccgccccccccagaagaccccaccccgcccccggccccggcgacagcaacatcttctggggcctgcagatcagcgacatccacctgagcagattcagagaccccggcagagccgtggacctggagaagttctgcagcgagaccatcgacatcatccagcccgccctggtgctggccaccggcgacctgaccgacgccaagaccaaggagcagctgggcagcagacagcacgaggtggagtggcagacctaccagggcatcctgaagaagaccagagtgatggagaagaccaagtggctggacatcaagggcaaccacgacgccttcaacatccccagcctggacagcatcaagaactactacagaaagtacagcgccgtgagaagagacggcagcttccactacgtgcacagcacccccttcggcaactacagcttcatctgcgtggacgccaccgtgaaccccggccccaagagaccctacaacttcttcggcatcctggacaagaagaagatggaggagctgctgctgctggccaaggagagcagcagaagcaaccacaccatctggttcggccacttcaccaccagcaccatcctgagccccagccccggcatcagaagcatcatgagcagcgccatcgcctacctgtgcggccacctgcacaccctgggcggcctgatgcccgtgctgcacaccagacacttccagggcaccctggagctggaggtgggcgactggaaggacaacagaagatacagaatcttcgccttcgaccacgacctgttcagcttcgccgacctgatcttcggcaagtggcccgtggtgctgatcaccaaccccaagagcctgctgtacagctgcggcgagcacgagcccctggagagactgctgcacagcacccacatcagagtgctggccttcagcctgagcagcatcaccagcgtgaccgtgaagatcgacggcgtgcacctgggccaggccgtgcacgtgagcggccccatcttcgtgctgaagtggaaccccagaaactacagcagcggcacccacaacatcgaggtgatcgtgcaggacagcgccggcagaagcaagagcgtgcaccacatcttcagcgtgcaggagaacaaccacctgagcttcgaccccctggccagcttcatcctgagaaccgaccactacatcatggccagagtgctgttcgtgctgatcgtgctgagccagctgaccatcctgatcatcttcagatacagaggctaccccgagctgaaggagcccagcggcttcatcaacctgaccagcttcagcctgcacgtgctgagcaagatcaacatcttctactacagcgtgctgctgctgaccctgtacaccgtgctgggcccctggttcttcggcgagatcatcgacggcaagttcggctgctgcttcagcttcggcatcttcgtgaacggccacttcctgcagggcagcatcaccttcatcatcggcatcctgcagctggccttcttcaacatccccctgatggcctacatgtgctggagcctgctgcagagatgcttcggccacaacttcagaagccacctgcaccagagaaagtacctgaagatcatgcccgtgcacctgctgatgctgctgctgtacatctggcaggtgtacagctgctacttcctgtacgccacctacggcaccctggccttcctgttcagccccctgagaacctggctgaccctgctgacccccgtgctgatcagatacgtgtggaccctgaacagcaccaagttcggcatcttcatggtgcagctgaagagccacctgagcagctag

SEQ ID NO: 23565 - DNA, 2424 bp, Artificial Sequence
  Description of Artificial Sequence: Synthetic coding sequence
atgatggacagccccttcctggagctgtggcagagcaaggccgtgagcatcagagagcagctgggcctgggcgacagacccaacgacagctactgctacaacagcgccaagaacagcaccgtgctgcagggcgtgaccttcggcggcatccccaccgtgctgctgatcgacgtgagctgcttcctgttcctgatcctggtgttcagcatcatcagaagaagattctgggactacggcagaatcgccctggtgagcgaggccgacagcgagagcagattccagagactgagcagcaccagcagcagcggccagcaggacttcgagaacgagctgggctgctgcccctggctgaccgccatcttcagactgcacgacgaccagatcctggagtggtgcggcgaggacgccatccactacctgagcttccagagacacatcatcttcctgctggtggtggtgagcttcctgagcctgtgcgtgatcctgcccgtgaacctgagcggcgacctgctggacaaggacccctacagcttcggcagaaccaccatcgccaacctgcagaccgacaacgacctgctgtggctgcacaccatcttcgccgtgatctacctgttcctgaccgtgggcttcatgagacaccacacccagagcatcaagtacaaggaggagaacctggtgagaagaaccctgttcatcaccggcctgcccagagacgccagaaaggagaccgtggagagccacttcagagacgcctaccccacctgcgaggtggtggacgtgcagctgtgctacaacgtggccaagctgatctacctgtgcaaggagaagaagaagaccgagaagagcctgacctactacaccaacctgcaggtgaagaccggccagagaaccctgatcaaccccaagccctgcggccagttctgctgctgcgaggtgctgggctgcgagtgggaggacgccatcagctactacaccagaatgaaggacagactgctggagagaatcaccgaggaggagagacacgtgcaggaccagcccctgggcatggccttcgtgaccttccaggagaagagcatggccacctacatcctgaaggacttcaacgcctgcaagtgccagagcctgcagtgcaagggcgagccccagcccagcagccacagcagagagctgtacaccagcaagtggaccgtgaccttcgccgccgaccccgaggacatctgctggaagaacctgagcatccagggcctgagatggtggctgcagtggctgggcatcaacttcaccctgttcctgggcctgttcttcctgaccacccccagcatcatcctgagcaccatggacaagttcaacgtgaccaagcccatccacgccctgaacaaccccatcatcagccagttcttccccaccctgctgctgtggagcttcagcgccctgctgcccagcatcgtgtactacagcaccctgctggagagccactggaccaagagcggcgagaaccagatcatgatgaccaaggtgtacatcttcctgatcttcatggtgctgatcctgcccagcctgggcctgaccagcctggacttcttcttcagatggctgttcgacaagaccagcagcgaggccagcatcagactggagtgcgtgttcctgcccgaccagggcgccttcttcgtgaactacgtgatcgccagcgccttcatcggcaacggcatggagctgctgagactgcccggcctgatcctgtacaccttcagaatgatcatggccaagaccgccgccgacagaagaaacgtgaagcagaaccaggccttccagtacgagttcggcgccatgtacgcctggatgctgtgcgtgttcaccgtgatcgtggcctacagcatcacctgccccatcatcgcccccttcggcctgatctacatcctgctgaagcacatggtggacagacacaacctgtacttcgtgtacctgcccgccaagctggagaagggcatccacttcgccgccgtgaaccaggccctggccgcccccatcctgtgcctgttctggctgtacttcttcagcttcctgagactgggcatgaaggcccccgccaccctgttcaccttcctggtgctgctgctgaccatcctggtgtgcctggcccacacctgcttcggctgcttcaagcacctgagccccctgaactacaagaccgaggagcccgccagcgacaagggcagcgaggccgaggcccacatgcccccccccttcaccccctacgtgcccagaatcctgaacggcctggccagcgagagaaccgccctgagcccccagcagcagcagcagcagacctacggcgccatccacaacatcagcggcaccatccccggccagtgcctggcccagagcgccaccggcagcgtggccgccgccccccaggaggcctag

SEQ ID NO: 23566 - DNA, 357 bp, Artificial Sequence
  Description of Artificial Sequence: Synthetic coding sequence
atgatggacagccccttcctggagctgtggcagagcaaggccgtgagcatcagagagcagctgggcctgggcgacagacccaacgacagctactgctacaacagcgccaagaacagcaccgtgctgcagggcgtgaccttcggcggcatccccaccgtgctgctgatcgacgtgagctgcttcctgttcctgatcctggtgttcagcatcatcagaagaagattctgggactacggcagaatcgccctggtgagcgaggccgacagcgagagcagattccagagactgagcagcaccagcagcagcggccagcaggacttcgagaacgagctgggctgctgcccctggctgacctag

SEQ ID NO: 23567 - DNA, 249 bp, Artificial Sequence
  Description of Artificial Sequence: Synthetic coding sequence
atgaaggacagactgctggagagaatcaccgaggaggagagacacgtgcaggaccagcccctgggcatggccttcgtgaccttccaggagaagagcatggccacctacatcctgaaggacttcaacgcctgcaagtgccagagcctgcagtgcaagggcgagccccagcccagcagccacagcagagagctgtacaccagcaagtggaccgtgaccttcgccgccgaccccgaggacatctgctggtag

SEQ ID NO: 23568 - DNA, 2499 bp, Artificial Sequence
  Description of Artificial Sequence: Synthetic coding sequence
atgctgcccttcctgctggccaccctgggcaccaccgccctgaacaacagcaaccccaaggactactgctacagcgccagaatcagaagcaccgtgctgcagggcctgcccttcggcggcgtgcccaccgtgctggccctggacttcatgtgcttcctggccctgctgttcctgttcagcatcctgagaaaggtggcctgggactacggcagactggccctggtgaccgacgccgacagactgagaagacaggagagagacagagtggagcaggagtacgtggccagcgccatgcacggcgacagccacgacagatacgagagactgaccagcgtgagcagcagcgtggacttcgaccagagagacaacggcttctgcagctggctgaccgccatcttcagaatcaaggacgacgagatcagagacaagtgcggcggcgacgccgtgcactacctgagcttccagagacacatcatcggcctgctggtggtggtgggcgtgctgagcgtgggcatcgtgctgcccgtgaacttcagcggcgacctgctggagaacaacgcctacagcttcggcagaaccaccatcgccaacctgaagagcggcaacaacctgctgtggctgcacaccagcttcgccttcctgtacctgctgctgaccgtgtacagcatgagaagacacaccagcaagatgagatacaaggaggacgacctggtgaagagaaccctgttcatcaacggcatcagcaagtacgccgagagcgagaagatcaagaagcacttcgaggaggcctaccccaactgcaccgtgctggaggccagaccctgctacaacgtggccagactgatgttcctggacgccgagagaaagaaggccgagagaggcaagctgtacttcaccaacctgcagagcaaggagaacgtgcccaccatgatcaaccccaagccctgcggccacctgtgctgctgcgtggtgagaggctgcgagcaggtggaggccatcgagtactacaccaagctggagcagaagctgaaggaggactacaagagagagaaggagaaggtgaacgagaagcccctgggcatggccttcgtgaccttccacaacgagaccatcaccgccatcatcctgaaggacttcaacgtgtgcaagtgccagggctgcacctgcagaggcgagcccagacccagcagctgcagcgagagcctgcacatcagcaactggaccgtgagctacgcccccgacccccagaacatctactgggagcacctgagcatcagaggcttcatctggtggctgagatgcctggtgatcaacgtggtgctgttcatcctgctgttcttcctgaccacccccgccatcatcatcaccaccatggacaagttcaacgtgaccaagcccgtggagtacctgaacaaccccatcatcacccagttcttccccaccctgctgctgtggtgcttcagcgccctgctgcccaccatcgtgtactacagcgccttcttcgaggcccactggaccagaagcggcgagaacagaaccaccatgcacaagtgctacaccttcctgatcttcatggtgctgctgctgcccagcctgggcctgagcagcctggacctgttcttcagatggctgttcgacaagaagttcctggccgaggccgccatcagattcgagtgcgtgttcctgcccgacaacggcgccttcttcgtgaactacgtgatcgccagcgccttcatcggcaacgccatggacctgctgagaatccccggcctgctgatgtacatgatcagactgtgcctggccagaagcgccgccgagagaagaaacgtgaagagacaccaggcctacgagttccagttcggcgccgcctacgcctggatgatgtgcgtgttcaccgtggtgatgacctacagcatcacctgccccatcatcgtgcccttcggcctgatgtacatgctgctgaagcacctggtggacagatacaacctgtactacgcctacctgcccgccaagctggacaagaagatccacagcggcgccgtgaaccaggtggtggccgcccccatcctgtgcctgttctggctgctgttcttcagcaccatgagaaccggcttcctggcccccaccagcatgttcaccttcgtggtgctggtgatcaccatcgtgatctgcctgtgccacgtgtgcttcggccacttcaagtacctgagcgcccacaactacaagatcgagcacaccgagaccgacaccgtggaccccagaagcaacggcagaccccccaccgccgccgccgtgcccaagagcgccaagtacatcgcccaggtgctgcaggacagcgaggtggacggcgacggcgacggcgcccccggcagcagcggcgacgagccccccagcagcagcagccaggacgaggagctgctgatgccccccgacgccctgaccgacaccgacttccagagctgcgaggacagcctgatcgagaacgagatccaccagtag

SEQ ID NO: 23569 - DNA, 2499 bp, Artificial Sequence; identical to SEQ ID NO: 23568
  Description of Artificial Sequence: Synthetic coding sequence

SEQ ID NO: 23570 - DNA, 681 bp, Artificial Sequence
  Description of Artificial Sequence: Synthetic coding sequence
atgctgcccttcctgctggccaccctgggcaccaccgccctgaacaacagcaaccccaaggactactgctacagcgccagaatcagaagcaccgtgctgcagggcctgcccttcggcggcgtgcccaccgtgctggccctggacttcatgtgcttcctggccctgctgttcctgttcagcatcctgagaaaggtggcctgggactacggcagactggccctggtgaccgacgccgacagactgagaagacaggagagagacagagtggagcaggagtacgtggccagcgccatgcacggcgacagccacgacagatacgagagactgaccagcgtgagcagcagcgtggacttcgaccagagagacaacggcttctgcagctggctgaccgccatcttcagaatcaaggacgacgagatcagagacaagtgcggcggcgacgccgtgcactacctgagcttccagagacacatcatcggcctgctggtggtggtgggcgtgctgagcgtgggcatcgtgctgcccgtgaacttcagcggcgacctgctggagaacaacgcctacagcttcggcagaaccaccatcgccaacctgaagagcggcaacaacctgctgtggctgcacaccagcttcgccttcctgtacctgctgctgaccgtgtacagcatgagaagacactag

SEQ ID NO: 23571 - DNA, 2421 bp, Artificial Sequence
  Description of Artificial Sequence: Synthetic coding sequence
atgagcgccagccccgacgacctgagcaccggcggcagactgcagaacatgaccgtggacgagtgcttccagagcagaaacaccgtgctgcagggccagcccttcggcggcgtgcccaccgtgctgtgcctgaacatcgccctgtgggtgctggtgctggtggtgtacagcttcctgagaaaggccgcctgggactacggcagactggccctgctgatccacaacgacagcctgaccagcctgatctacggcgagcagagcgagaagaccagccccagcgagaccagcctggagatggagagaagagacaagggcttctgcagctggttcttcaacagcatcaccatgaaggacgaggacctgatcaacaagtgcggcgacgacgccagaatctacatcgtgttccagtaccacctgatcatcttcgtgctgatcatctgcatccccagcctgggcatcatcctgcccatcaactacaccggcagcgtgctggactggagcagccacttcgccagaaccaccatcgtgaacgtgagcaccgagagcaagctgctgtggctgcacagcctgctgagcttcttctacttcatcaccaacttcatgttcatggcccaccactgcctgggcttcgcccccagaaacagccagaaggtgaccagaaccctgatgatcacctacgtgcccaaggacatcgaggaccccgagctgatcatcaagcacttccacgaggcctaccccggcagcgtggtgaccagagtgcacttctgctacgacgtgagaaacctgatcgacctggacgaccagagaagacacgccatgagaggcagactgttctacaccgccaaggccaagaagaccggcaaggtgatgatcagaatccacccctgcgccagactgtgcttctgcaagtgctggacctgcttcaaggaggtggacgccgagcagtactacagcgagctggaggagcagctgaccgacgagttcaacgccgagctgaacagagtgcccctgaagagactggacctgatcttcgtgaccttccaggacagcagaatggccaagagagtgagaaaggactacaagtacgtgcagtgcggcgtgcagccccagcagagcagcgtgaccaccatcgtgaagagctactactggagagtgaccatggccccccaccccaaggacatcatctggaagcacctgagcgtgagaagattcttctggtgggccagattcatcgccatcaacaccttcctgttcttcctgttcttcttcctgaccacccccgccatcatcatgaacaccatcgacatgtacaacgtgaccagacccatcgagaagctgcagaaccccatcgtgacccagttcttccccagcgtgatgctgtggggcttcaccgtgatcctgcccctgatcgtgtacttcagcgccttcctggaggcccactggaccagaagcagccagaacctggtgatggtgcacaagtgctacatcttcctggtgttcatggtggtgatcctgcccagcatgggcctgaccagcctggacgtgttcctgagatggctgttcgacatctactacctggagcaggccagcatcagattccagtgcgtgttcctgcccgacaacggcgccttcttcgtgaactacgtgatcaccgccgccctgctgggcaccggcatggagctgctgagactgggcagcctgttctgctacagcaccagactgttcttcagcagaagcgagcccgagagagtgaacatcagaaagaaccaggccatcgacttccagttcggcagagagtacgcctggatgatgaacgtgttcagcgtggtgatggcctacagcatcacctgccccatcatcgtgcccttcggcctgctgtacctgtgcatgaagcacctgaccgacagatacaacatgtactacagcttcgcccccaccaagctgaacgagcagatccacatggccgccgtgagccaggccatcttcgcccccctgctgggcctgttctggatgctgttcttcagcatcctgagactgggcagcctgcacgccatcaccatcttcagcctgagcaccctgctgatcgccatggtgatcgccttcgtgggcatcttcctgggcaagctgagaatggtggccgactacgagcccgaggaggaggagatccagaccgtgttcgacatggagcccagcagcaccagcagcacccccaccagcctgctgtacgtggccaccgtgctgcaggagcccgagctgaacctgacccccgccagcagccccgccagacacacctacggcaccatgaacaaccagcccgaggagggcgaggaggagagcggcctgagaggcttcgccagagagctggacagcgcccagttccaggagggcctggagctggagggccagaaccagtaccactag

SEQ ID NO: 23572 - DNA, 1131 bp, Artificial Sequence
  Description of Artificial Sequence: Synthetic coding sequence
atgaacaccatcgacatgtacaacgtgaccagacccatcgagaagctgcagaaccccatcgtgacccagttcttccccagcgtgatgctgtggggcttcaccgtgatcctgcccctgatcgtgtacttcagcgccttcctggaggcccactggaccagaagcagccagaacctggtgatggtgcacaagtgctacatcttcctggtgttcatggtggtgatcctgcccagcatgggcctgaccagcctggacgtgttcctgagatggctgttcgacatctactacctggagcaggccagcatcagattccagtgcgtgttcctgcccgacaacggcgccttcttcgtgaactacgtgatcaccgccgccctgctgggcaccggcatggagctgctgagactgggcagcctgttctgctacagcaccagactgttcttcagcagaagcgagcccgagagagtgaacatcagaaagaaccaggccatcgacttccagttcggcagagagtacgcctggatgatgaacgtgttcagcgtggtgatggcctacagcatcacctgccccatcatcgtgcccttcggcctgctgtacctgtgcatgaagcacctgaccgacagatacaacatgtactacagcttcgcccccaccaagctgaacgagcagatccacatggccgccgtgagccaggccatcttcgcccccctgctgggcctgttctggatgctgttcttcagcatcctgagactgggcagcctgcacgccatcaccatcttcagcctgagcaccctgctgatcgccatggtgatcgccttcgtgggcatcttcctgggcaagctgagaatggtggccgactacgagcccgaggaggaggagatccagaccgtgttcgacatggagcccagcagcaccagcagcacccccaccagcctgctgtacgtggccaccgtgctgcaggagcccgagctgaacctgacccccgccagcagccccgccagacacacctacggcaccatgaacaaccagcccgaggagggcgaggaggagagcggcctgagaggcttcgccagagagctggacagcgcccagttccaggagggcctggagctggagggccagaaccagtaccactag

SEQ ID NO: 23573 - DNA, 153 bp, Artificial Sequence
  Description of Artificial Sequence: Synthetic coding sequence
atgagcgccagccccgacgacctgagcaccggcggcagactgcagaacatgaccgtggacgagtgcttccagagcagaaacaccgtgctgcagggccagcccttcggcggcgtgcccaccgtgctgtgcctgaacatcgccctgtgggtgtag

SEQ ID NO: 23574 - DNA, 495 bp, Artificial Sequence
  Description of Artificial Sequence: Synthetic coding sequence
atgagcgccagccccgacgacctgagcaccggcggcagactgcagaacatgaccgtggacgagtgcttccagagcagaaacaccgtgctgcagggccagcccttcggcggcgtgcccaccgtgctgtgcctgaacatcgccctgtgggtgctggtgctggtggtgtacagcttcctgagaaaggccgcctgggactacggcagactggccctgctgatccacaacgacagcctgaccagcctgatctacggcgagcagagcgagaagaccagccccagcgagaccagcctggagatggagagaagagacaagggcttctgcagctggttcttcaacagcatcaccatgaaggacgaggacctgatcaacaagtgcggcgacgacgccagaatctacatcgtgttccagtaccacctgatcatcttcgtgctgatcatctgcatccccagcctgggcatcatcctgcccatcaactacaccggcagcgtgctgtag

SEQ ID NO: 23575 - DNA, 156 bp, Artificial Sequence
  Description of Artificial Sequence: Synthetic coding sequence
atgagcgccagccccgacgacctgagcaccggcggcagactgcagaacatgaccgtggacgagtgcttccagagcagaaacaccgtgctgcagggccagcccttcggcggcgtgcccaccgtgctgtgcctgaacatcgccctgtgggtgctgtag

SEQ ID NO: 23576 - DNA, 111 bp, Artificial Sequence
  Description of Artificial Sequence: Synthetic coding sequence
atgagcgccagccccgacgacctgagcaccggcggcagactgcagaacatgaccgtggacgagtgcttccagagcagaaacaccgtgctgcagggccagcccttcggctag

SEQ ID NO: 23577 - DNA, 72 bp, Artificial Sequence
  Description of Artificial Sequence: Synthetic coding sequence
atgagcgccagccccgacgacctgagcaccggcggcagactgcagaacatgaccgtggacgagtgcttctag

SEQ ID NO: 23578 - DNA, 987 bp, Artificial Sequence
  Description of Artificial Sequence: Synthetic coding sequence
atgagaagccccggcggcatcctgctgcaggccctgcccagactgctgcagcacgccgccctgcccggcctggccgagctgcccgccagatgggccctgcccagaggcgccggcggcgacggccccgccgacagactgcccagaggcggcggcgccagcgccgccgccgccgccgccgccgccagcggcgccctgctgggcgcctacctggagagacacggcccccccgaggccagcgagctgcccgagcccggcggcgccctggccggcggccccggcagcggcggcggcggcgtggtggtgggcgtggccgaggtgagaaactggagatgctgctgcctgggcagcacctgctggtgcagaagcctggtgctggtgtgcgtgctggccgccctgtgcttcgccagcctggccctggtgagaagatacctgcaccacctgctgctgtgggtggagagcctggacagcctgctgggcgtgctgctgttcgtggtgggcttcatcgtggtgagcttcccctgcggctggggctacatcgtgctgaacgtggccgccggctacctgtacggcttcgtgctgggcatgggcctgatgatggtgggcgtgctgatcggcaccttcatcgcccacgtggtgtgcaagagactgctgaccgcctgggtggccgccagaatccagagcagcgagaagctgagcgccgtgatcagagtggtggagggcggcagcggcctgaaggtggtggccctggccagactgacccccatccccttcggcctgcagaacgccgtgttcagcatcatcatcagcatcggcctgatgttctacgtggtgcacagagcccaggtggagctgaacgccgccatcgtggcctgcgagatggagctgaagagcagcctggtgaagggcaaccagcccaacaccagcggcagcagcttctacaacaagagaaccctgaccttcagcggcggcggcatcaacgtggtgtag

SEQ ID NO: 23579 - DNA, 1143 bp, Artificial Sequence
  Description of Artificial Sequence: Synthetic coding sequence
atgagaagccccggcggcatcctgctgcaggccctgcccagactgctgcagcacgccgccctgcccggcctggccgagctgcccgccagatgggccctgcccagaggcgccggcggcgacggccccgccgacagactgcccagaggcggcggcgccagcgccgccgccgccgccgccgccgccagcggcgccctgctgggcgcctacctggagagacacggcccccccgaggccagcgagctgcccgagcccggcggcgccctggccggcggccccggcagcggcggcggcggcgtggtggtgggcgtggccgaggtgagaaactggagatgctgctgcctgggcagcacctgctggtgcagaagcctggtgctggtgtgcgtgctggccgccctgtgcttcgccagcctggccctggtgagaagatacctgcaccacctgctgctgtgggtggagagcctggacagcctgctgggcgtgctgctgttcgtggtgggcttcatcgtggtgagcttcccctgcggctggggctacatcgtgctgaacgtggccgccggctacctgtacggcttcgtgctgggcatgggcctgatgatggtgggcgtgctgatcggcaccttcatcgcccacgtggtgtgcaagagactgctgaccgcctgggtggccgccagaatccagagcagcgagaagctgagcgccgtgatcagagtggtggagggcggcagcggcctgaaggtggtggccctggccagactgacccccatccccttcggcctgcagaacgccgtgttcagcatcaccgacctgagcctgcccaactacctgatggccagcagcgtgggcctgctgcccacccagctgctgaacagctacctgggcaccaccctgagaaccatggaggacgtgatcgccgagcagagcgtgagcggctacttcgtgttctgcctgcagatcatcatcagcatcggcctgatgttctacgtggtgcacagagcccaggtggagctgaacgccgccatcgtggcctgcgagatggagctgaagagcagcctggtgaagggcaaccagcccaacaccagcggcagcagcttctacaacaagagaaccctgaccttcagcggcggcggcatcaacgtggtgtag

SEQ ID NO: 23580 - DNA, 360 bp, Artificial Sequence
  Description of Artificial Sequence: Synthetic coding sequence
atgccccccagaatcaccgacctgagcctgcccaactacctgatggccagcagcgtgggcctgctgcccacccagctgctgaacagctacctgggcaccaccctgagaaccatggaggacgtgatcgccgagcagagcgtgagcggctacttcgtgttctgcctgcagatcatcatcagcatcggcctgatgttctacgtggtgcacagagcccaggtggagctgaacgccgccatcgtggcctgcgagatggagctgaagagcagcctggtgaagggcaaccagcccaacaccagcggcagcagcttctacaacaagagaaccctgaccttcagcggcggcggcatcaacgtggtgtag

SEQ ID NO: 23581 - DNA, 156 bp, Artificial Sequence
  Description of Artificial Sequence: Synthetic coding sequence
atgccccccagaatcaccgacctgagcctgcccaactacctgatggccagcagcgtgggcctgctgcccacccagctgctgaacagctacctgggcaccaccctgagaaccatggaggacgtgatcgccgagcagagcgtgagcggctacttctag

SEQ ID NO: 23582 - DNA, 723 bp, Artificial Sequence
  Description of Artificial Sequence: Synthetic coding sequence
atgagcagactgctgcccctgctgagaagcagaaccgccagaagcctgagacccggccccgccgccgccgccgcccccagaccccccagctggtgctgctgcggcagaggcctgctggccctggccccccccggcggcctgcccggcggccccagaagactgggcacccaccccaagaaggagcccatggaggccctgaacaccgcccagggcgccagagacttcatctacagcctgcacagcaccgagagaagctgcctgctgaaggagctgcacagattcgagagcatcgccatcgcccaggagaagctggaggcccccccccccacccccggccagctgagatacgtgttcatccacaacgccatccccttcatcggcttcggcttcctggacaacgccatcatgatcgtggccggcacccacatcgagatgagcatcggcatcatcctgggcatcagcaccatggccgccgccgccctgggcaacctggtgagcgacctggccggcctgggcctggccggctacgtggaggccctggccagcagactgggcctgagcatccccgacctgacccccaagcaggtggacatgtggcagaccagactgagcacccacctgggcaaggccgtgggcgtgaccatcggctgcatcctgggcatgttccccctgatcttcttcggcggcggcgaggaggacgagaagctggagaccaagagctag

SEQ ID NO: 23583 - DNA, 1020 bp, Artificial Sequence
  Description of Artificial Sequence: Synthetic coding sequence
atggccgccgcctgcggccccggcgccgccggctactgcctgctgctgggcctgcacctgttcctgctgaccgccggccccgccctgggctggaacgaccccgacagaatgctgctgagagacgtgaaggccctgaccctgcactacgacagatacaccaccagcagaagactggaccccatcccccagctgaagtgcgtgggcggcaccgccggctgcgacagctacacccccaaggtgatccagtgccagaacaagggctgggacggctacgacgtgcagtgggagtgcaagaccgacctggacatcgcctacaagttcggcaagaccgtggtgagctgcgagggctacgagagcagcgaggaccagtacgtgctgagaggcagctgcggcctggagtacaacctggactacaccgagctgggcctgcagaagctgaaggagagcggcaagcagcacggcttcgccagcttcagcgactactactacaagtggagcagcgccgacagctgcaacatgagcggcctgatcaccatcgtggtgctgctgggcatcgccttcgtggtgtacaagctgttcctgagcgacggccagtacagcccccccccctacagcgagtacccccccttcagccacagataccagagattcaccaacagcgccggcccccccccccccggcttcaagagcgagttcaccggcccccagaacaccggccacggcgccaccagcggcttcggcagcgccttcaccggccagcagggctacgagaacagcggccccggcttctggaccggcctgggcaccggcggcatcctgggctacctgttcggcagcaacagagccgccacccccttcagcgacagctggtactaccccagctacccccccagctaccccggcacctggaacagagcctacagccccctgcacggcggcagcggcagctacagcgtgtgcagcaacagcgacaccaagaccagaaccgccagcggctacggcggcaccagaagaagatag

SEQ ID NO: 23584 - DNA, 504 bp, Artificial Sequence
  Description of Artificial Sequence: Synthetic coding sequence
atgagcggcctgatcaccatcgtggtgctgctgggcatcgccttcgtggtgtacaagctgttcctgagcgacggccagtacagcccccccccctacagcgagtacccccccttcagccacagataccagagattcaccaacagcgccggcccccccccccccggcttcaagagcgagttcaccggcccccagaacaccggccacggcgccaccagcggcttcggcagcgccttcaccggccagcagggctacgagaacagcggccccggcttctggaccggcctgggcaccggcggcatcctgggctacctgttcggcagcaacagagccgccacccccttcagcgacagctggtactaccccagctacccccccagctaccccggcacctggaacagagcctacagccccctgcacggcggcagcggcagctacagcgtgtgcagcaacagcgacaccaagaccagaaccgccagcggctacggcggcaccagaagaagatag

SEQ ID NO: 23585 - DNA, 912 bp, Artificial Sequence
  Description of Artificial Sequence: Synthetic coding sequence
atgctgctgagagacgtgaaggccctgaccctgcactacgacagatacaccaccagcagaagactggaccccatcccccagctgaagtgcgtgggcggcaccgccggctgcgacagctacacccccaaggtgatccagtgccagaacaagggctgggacggctacgacgtgcagtgggagtgcaagaccgacctggacatcgcctacaagttcggcaagaccgtggtgagctgcgagggctacgagagcagcgaggaccagtacgtgctgagaggcagctgcggcctggagtacaacctggactacaccgagctgggcctgcagaagctgaaggagagcggcaagcagcacggcttcgccagcttcagcgactactactacaagtggagcagcgccgacagctgcaacatgagcggcctgatcaccatcgtggtgctgctgggcatcgccttcgtggtgtacaagctgttcctgagcgacggccagtacagcccccccccctacagcgagtacccccccttcagccacagataccagagattcaccaacagcgccggcccccccccccccggcttcaagagcgagttcaccggcccccagaacaccggccacggcgccaccagcggcttcggcagcgccttcaccggccagcagggctacgagaacagcggccccggcttctggaccggcctgggcaccggcggcatcctgggctacctgttcggcagcaacagagccgccacccccttcagcgacagctggtactaccccagctacccccccagctaccccggcacctggaacagagcctacagccccctgcacggcggcagcggcagctacagcgtgtgcagcaacagcgacaccaagaccagaaccgccagcggctacggcggcaccagaagaagatag

SEQ ID NO: 23586 - DNA, 504 bp, Artificial Sequence; identical to SEQ ID NO: 23584
  Description of Artificial Sequence: Synthetic coding sequence

SEQ ID NO: 23587 - DNA, 774 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggctacgaggtgcacggcatggagaagatccccgaggacggccccgccctgatcatcttctaccacggcgccatccccatcgacttctactacttcatggccaagatcttcatccacaagggcagaacctgcagagtggtggccgaccacttcgtgttcaagatccccggcttcagcctgctgctggacgtgttctgcgccctgcacggccccagagagaagtgcgtggagatcctgagaagcggccacctgctggccatcagccccggcggcgtgagagaggccctgatcagcgacgagacctacaacatcgtgtggggccacagaagaggcttcgcccaggtggccatcgacgccaaggtgaccaagaacgccgtgcaggccctgatcgacaagcaccagagaatccccggcaacatcatgagcgccctgctggagagattccactag

SEQ ID NO: 23588 - DNA, 975 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggctacgaggtgcacggcatggagaagatccccgaggacggccccgccctgatcatcttctaccacggcgccatccccatcgacttctactacttcatggccaagatcttcatccacaagggcagaacctgcagagtggtggccgaccacttcgtgttcaagatccccggcttcagcctgctgctggacgtgttctgcgccctgcacggccccagagagaagtgcgtggagatcctgagaagcggccacctgctggccatcagccccggcggcgtgagagaggccctgatcagcgacgagacctacaacatcgtgtggggccacagaagaggcttcgcccaggtggccatcgacgccaaggtgcccatcatccccatgttcacccagaacatcagagagggcttcagaagcctgggcggcaccagactgttcagatggctgtacgagaagttcagataccccttcgcccccatgtacggcggcttccccgtgaagctgagaacctacctgggcgaccccatcccctacgacccccagatcaccgccgaggagctggccgagaagaccaagaacgccgtgcaggccctgatcgacaagcaccagagaatccccggcaacatcatgagcgccctgctggagagattccactag

SEQ ID NO: 23589 - DNA, 381 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggctacgaggtgcacggcatggagaagatccccgaggacggccccgccctgatctag

SEQ ID NO: 23590 - DNA, 408 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggcaagcagggctacttccacctgtgcgtggccatccacgtgtgctgcatcggcaccgtgctgcccttccacttcatcgactag

SEQ ID NO: 23591 - DNA, 732 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggctacgaggtgcacggcatggagaagatccccgaggacggccccgccctgatcatcttctaccacggcgccatccccatcgacttctactacttcatggccaagatcttcatccacaagggcagaacctgcagagtggtggccgaccacttcgtgttcaagatccccggcttcagcctgctgctggacgtgttctgcgccctgcacggccccagagagaagtgcgtggagatcctgagaagcggccacctgctggccatcagccccggcggcgtgagagaggccctgatcagcgacgagacctacaacatcgtgtggggccacagaagaggcttcgcccaggtggccatcgacgccaaggtgcccatcatccccatgttcacccagaacatcagagagggcttctag

SEQ ID NO: 23592 - DNA, 408 bp, Artificial Sequence; identical to SEQ ID NO: 23590
  Description of Artificial Sequence: Synthetic coding sequence

SEQ ID NO: 23593 - DNA, 9 bp, Artificial Sequence
  Description of Artificial Sequence: Synthetic coding sequence
atgatctag

SEQ ID NO: 23594 - DNA, 495 bp, Artificial Sequence
  Description of Artificial Sequence: Synthetic coding sequence
atgatcgacaagaaccagacctgcggcgtgggccaggacagcgtgccctacatgatctgcctgatccacatcctggaggagtggttcggcgtggagcagctggaggactacctgaacttcgccaactacctgctgtgggtgttcacccccctgatcctgctgatcctgccctacttcaccatcttcctgctgtacctgaccatcatcttcctgcacatctacaagagaaagaacgtgctgaaggaggcctacagccacaacctgtgggacggcgccagaaagaccgtggccaccctgtgggacggccacgccgccgtgtggcacggctacgaggtgcacggcatggagaagatccccgaggacggccccgccctgatcatcttctaccacggcgccatccccatcgacttctactacttcatggccaagatcttcatccacaagggcagaacctgcagagtggtggccgaccacttcgtgttcaagatcccctag

SEQ ID NO: 23595 - DNA, 276 bp, Artificial Sequence
  Description of Artificial Sequence: Synthetic coding sequence
atgttcacccagaacatcagagagggcttcagaagcctgggcggcaccagactgttcagatggctgtacgagaagttcagataccccttcgcccccatgtacggcggcttccccgtgaagctgagaacctacctgggcgaccccatcccctacgacccccagatcaccgccgaggagctggccgagaagaccaagaacgccgtgcaggccctgatcgacaagcaccagagaatccccggcaacatcatgagcgccctgctggagagattccactag

SEQ ID NO: 23596 - DNA, 744 bp, Artificial Sequence
  Description of Artificial Sequence: Synthetic coding sequence
atgctgagattcatccagaagttcagccaggccagcagcaagatcctgaagtacagcttccccgtgggcctgagaaccagcagaaccgacatcctgagcctgaagatgagcctgcagcagaacttcagcccctgccccagaccctggctgagcagcagcttccccgcctacatgagcaagacccagtgctaccacaccagcccctgcagcttcaagaagcagcagaagcaggccctgctggccagacccagcagcaccatcacctacctgaccgacagccccaagcccgccctgtgcgtgaccctggccggcctgatccccttcgtggccccccccctggtgatgctgatgaccaagacctacatccccatcctggccttcacccagatggcctacggcgccagcttcctgagcttcctgggcggcatcagatggggcttcgccctgcccgagggcagccccgccaagcccgactacctgaacctggccagcagcgccgcccccctgttcttcagctggttcgccttcctgatcagcgagagactgagcgaggccatcgtgaccgtgatcatgggcatgggcgtggccttccacctggagctgttcctgctgccccactaccccaactggttcaaggccctgagaatcgtggtgaccctgctggccaccttcagcttcatcatcaccctggtggtgaagagcagcttccccgagaagggccacaagagacccggccaggtgtag

SEQ ID NO: 23597 - DNA, 828 bp, Artificial Sequence
  Description of Artificial Sequence: Synthetic coding sequence
atgcagctgcaggtgttctggaccggcctggagtacacctgcagactgctgggcatcaccaccgccgccgtgctgatcggcgtgggcaccgagaccttcctgcagggccagttcaagagcctggccttctacctgctgttcaccggcgccgccgtgagcatctgcgagggcgcctacttcgtggcccagctgctggccatctgcttccagtgccagcccggcagcctggccgacagagtgagagagaaggcccactggctgggctgcttccagaagttcctggcctacctgctgctgagcgtggcctgcttcctgcaccccgtgctggtgtggcacgtgaccatccccggcagcatgctgatcatcaccggcctggcctacttcctgctgagcaagagaaagaagagaaaggccgcccccgaggtgctggccagccccgagcagtacaccgaccccagcagcagcgccgtgagcaccaccggcagcggcgacaccgagcagacctacaccttccacggcgccctgaaggagggccccagcagcctgttcatccacatgaagagcatcctgaagggcaccaagaagcccagcgccctgcagccccccaacaccctgatggagctgagcctggagcccgccgacagcctggccaagaagaagcaggtgcacttcgaggacaacctggtgagaatcgtgcccagcctggccgagggcctggacgacggcgacagcgagcccgaggagaccaccagcgacaccacccccatcatcccccccccccaggcccccctgttcctgagcagcctgaccgccaccggcctgttctag

SEQ ID NO: 23598 - DNA, 474 bp, Artificial Sequence
  Description of Artificial Sequence: Synthetic coding sequence
atgctgatcatcaccggcctggcctacttcctgctgagcaagagaaagaagagaaaggccgcccccgaggtgctggccagccccgagcagtacaccgaccccagcagcagcgccgtgagcaccaccggcagcggcgacaccgagcagacctacaccttccacggcgccctgaaggagggccccagcagcctgttcatccacatgaagagcatcctgaagggcaccaagaagcccagcgccctgcagccccccaacaccctgatggagctgagcctggagcccgccgacagcctggccaagaagaagcaggtgcacttcgaggacaacctggtgagaatcgtgcccagcctggccgagggcctggacgacggcgacagcgagcccgaggagaccaccagcgacaccacccccatcatcccccccccccaggcccccctgttcctgagcagcctgaccgccaccggcctgttctag

SEQ ID NO: 23599 - DNA, 771 bp, Artificial Sequence
  Description of Artificial Sequence: Synthetic coding sequence
atgccccccgcccagggctacgagttcgccgccgccaagggccccagagacgagctgggccccagcttccccatggccagcccccccggcctggagctgaagaccctgagcaacggcccccaggcccccagaagaagcgcccccctgggccccgtggcccccaccagagagggcgtggagaacgcctgcttcagcagcgaggagcacgagacccacttccagaaccccggcaacaccagactgggcagcagccccagcccccccggcggcgtgagcagcctgcccagaagccagagagacgacctgagcctgcacagcgaggagggccccgccctggagcccgtgagcagacccgtggactacggcttcgtgagcgccctggtgttcctggtgagcggcatcctgctggtggtgaccgcctacgccatccccagagaggccagagtgaaccccgacaccgtgaccgccagagagatggagagactggagatgtactacgccagactgggcagccacctggacagatgcatcatcgccggcctgggcctgctgaccgtgggcggcatgctgctgagcgtgctgctgatggtgagcctgtgcaagggcgagctgtacagaagaagaaccttcgtgcccggcaagggcagcagaaagacctacggcagcatcaacctgagaatgagacagctgaacggcgacggcggccaggccctggtggagaacgaggtggtgcaggtgagcgagaccagccacaccctgcagagaagctag

SEQ ID NO: 23600 - DNA, 465 bp, Artificial Sequence
  Description of Artificial Sequence: Synthetic coding sequence
atgccccccgcccagggctacgagttcgccgccgccaagggccccagagacgagctgggccccagcttccccatggccagcccccccggcctggagctgaagaccctgagcaacggcccccaggcccccagaagaagcgcccccctgggccccgtggcccccaccagagagggcgtggagaacgcctgcttcagcagcgaggagcacgagacccacttccagaaccccggcaacaccagactgggcagcagccccagcccccccggcggcgtgagcagcctgcccagaagccagagagacgacctgagcctgcacagcgaggagggccccgccctggagcccgtgagcagacccgtggactacggcttcgtgagcgccctggtgttcctggtgagcggcatcctgctggtggtgaccgcctacgccatccccagagaggccagagtgaaccccgacaccgtgtag

SEQ ID NO: 23601 - DNA, 417 bp, Artificial Sequence
  Description of Artificial Sequence: Synthetic coding sequence
atgagacccaccgccgacagcttcagactgaagaagggcaacgtgttccccaacttcgacccctgcgcccaggccctgcagaagagctgccacttcgccctgagcttcctgatcggcaagatgggcatcatcatcctgagcgtgtgcctgatctgcaccagactgctgcaggagggcatcgcccagagcaagtgcctgatcaacgtgagcttcagcctgtacagctgcttcatcgtgttcgtgaccatcagccaggacagcgagaccctgagcctggactgcgaccacagactgttcttcagcctgcccttcaccgaccccgccagcggcggccagagccagcacagctggccctgccccgagagaagcaagaacctgccccaggtgagcaagcagctgagaaacagagccggctag

SEQ ID NO: 23602 - DNA, 411 bp, Artificial Sequence
  Description of Artificial Sequence: Synthetic coding sequence
atgtggctggacaccagaaacctgggcatcgtgatcagctgctggaagggcgtgtgcgtgccccagaccaccaccctggagatgttctacaacgacaacgacagagtggaggagagcagcaacagctaccagatcagaagagagttcctgctgcccgcctgcctgcccgccttcctgagcttcagcaccagcttcagcttcttcctgagcttcctgcccctgagcctgagcctgttcctgcccttcttccccagcttcttcctgagcctgagcctgagccccagcttcctgcccagcttcctgagacagggcctggccctgagccccagactggagtgcgacggcgccatcatgatccactgcagcctgaacatccccggcagcagcgacccccccaccagcgccagctag

SEQ ID NO: 23603 - DNA, 1185 bp, Artificial Sequence
  Description of Artificial Sequence: Synthetic coding sequence
atgaccgagcaggagaccctggccctgctggaggtgaagagaagcgacagccccgagaagagcagcccccaggccctggtgcccaacggcagacagcccgagggcgagggcggcgccgagagccccggcgccgagagcctgagagtgggcagcagcgccggcagccccaccgccatcgagggcgccgaggacggcctggacagcaccgtgagcgaggccgccaccctgccctggggcaccggcccccagcccagcgcccccttccccgacccccccggctggagagacatcgagcccgagccccccgagagcgagcccctgaccaagctggaggagctgcccgaggacgacgccaacctgctgcccgagaaggccgccagagccttcgtgcccatcgacctgcagtgcatcgagagacagccccaggaggacctgatcgtgagatgcgaggccggcgagggcgagtgcagaaccttcatgccccccagagtgacccaccccgaccccaccgagagaaagtgggccgaggccgtggtgagaccccccggctgcagctgcggcggctgcggcagctgcggcgacagagagtggctgagagccgtggccagcgtgggcgccgccctgatcctgttcccctgcctgctgtacggcgcctacgccttcctgcccttcgacgtgcccagactgcccaccatgagcagcagactgatctacaccctgagatgcggcgtgttcgccaccttccccatcgtgctgggcatcctggtgtacggcctgagcctgctgtgcttcagcgccctgagacccttcggcgagcccagaagagaggtggagatccacagaagatacgtggcccagagcgtgcagctgttcatcctgtacttcttcaacctggccgtgctgagcacctacctgccccaggacaccctgaagctgctgcccctgctgaccggcctgttcgccgtgagcagactgatctactggctgaccttcgccgtgggcagaagcttcagaggcttcggctacggcctgaccttcctgcccctgctgagcatgctgatgtggaacctgtactacatgttcgtggtggagcccgagagaatgctgaccgccaccgagagcagactggactaccccgaccacgccagaagcgccagcgactacagacccagaccctggggctag

SEQ ID NO: 23604 - DNA, 528 bp, Artificial Sequence
  Description of Artificial Sequence: Synthetic coding sequence
atgaccgagcaggagaccctggccctgctggaggtgaagagagaccccggcgtgagagccgagcccgtgatgctgttctgccccagcgccctgtggggcgccaccgccggcggcggcgacccccccgccatctgcggccccgtgggccccgccctgtacagcctgctgctgcagcccggcagagccttccacctgcccgcccccggctacccccagaccgcccccagcgcccactggagcctgtgcagactgcccgccgacctgctggccgacctgtgcagaggccccctgctgcccagactgagactgagacccgacgtgagcgccaccgccgtggacgccgacgtggagcccctgctgcacgtgagaggcggcgccggcgcccacgcccactgccacagagagccccccggcctgcccggccccagacccctgggcctgagactgcaggccccccccctgggcctgagcctgagcgccctggccctgggcgtgggcggcagcggcctgggcctgacccacctgtag

SEQ ID NO: 23605 - DNA, 1185 bp, Artificial Sequence; identical to SEQ ID NO: 23603
  Description of Artificial Sequence: Synthetic coding sequence

SEQ ID NO: 23606 - DNA, 399 bp, Artificial Sequence
  Description of Artificial Sequence: Synthetic coding sequence
atgaccgagcaggagaccctggccctgctggaggtgaagagagaccccggcgtgagagccgagcccgtgatgctgttctgccccagcgccctgtggggcgccaccgccggcggcggcgacccccccgccatctgcggccccgtgggccccgccctgtacagcctgctgctgcagcccggcagagccttccacctgcccgcccccggctacccccagaccgcccccagcgcccactggagcctgtgcagactgcccgccgacctgctggccgacctgtgcagaggccccctgctgcccagactgagactgagacccgacgtgagcgccaccgccgtggacgccgacgtggagcccctgctgcacgtgagaggcggcgccggcgcccacgcccactgctag

SEQ ID NO: 23607 - DNA, 507 bp, Artificial Sequence
  Description of Artificial Sequence: Synthetic coding sequence
atggccgagggcgccagagccagaggccccagaggctgcagagacagagacggccccgccggcggcgccggcaagatggccgcccccagaagaggcagaggcagcagcaccgtgctgagcagcgtgcccctgcagatgctgttctacctgagcggcacctactacgccctgtacttcctggccaccctgctgatgatcacctacaagagccaggtgttcagctacccccacagatacctggtgctggacctggccctgctgttcctgatgggcatcctggaggccgtgagactgtacctgggcaccagaggcaacctgaccgaggccgagagacccctggccgccagcctggccctgaccgccggcaccgccctgctgagcgcccacttcctgctgtggcaggccctggtgctgtgggccgactgggccctgagcgccaccctgctggccctgcacggcctggaggccgtgctgcaggtggtggccatcgccgccttcaccagatag

SEQ ID NO: 23608 - DNA, 483 bp, Artificial Sequence
  Description of Artificial Sequence: Synthetic coding sequence
atggccgagggcgccagagccagaggccccagaggctgcagagacagagacggccccgccggcggcgccggcagaggcagcagcaccgtgctgagcagcgtgcccctgcagatgctgttctacctgagcggcacctactacgccctgtacttcctggccaccctgctgatgatcacctacaagagccaggtgttcagctacccccacagatacctggtgctggacctggccctgctgttcctgatgggcatcctggaggccgtgagactgtacctgggcaccagaggcaacctgaccgaggccgagagacccctggccgccagcctggccctgaccgccggcaccgccctgctgagcgcccacttcctgctgtggcaggccctggtgctgtgggccgactgggccctgagcgccaccctgctggccctgcacggcctggaggccgtgctgcaggtggtggccatcgccgccttcaccagatag

SEQ ID NO: 23609 - DNA, 768 bp, Artificial Sequence
  Description of Artificial Sequence: Synthetic coding sequence
atgaaggtgctggccaccagcttcgtgctgggcagcctgggcctggccttctacctgcccctggtggtgaccacccccaagaccctggccatccccgagaagctgcaggaggccgtgggcaaggtgatcatcaacgccaccacctgcaccgtgacctgcggcctgggctacaaggaggagaccgtgtgcgaggtgggccccgacggcgtgagaagaaagtgccagaccagaagactggagtgcctgaccaactggatctgcggcatgctgcacttcaccatcctgatcggcaaggagttcgagctgagctgcctgagcagcgacatcctggagttcggccaggaggccttcagattcacctggagactggccagaggcgtgatcagcaccgacgacgaggtgttcaagcccttccaggccaacagccacttcgtgaagttcaagtacgcccaggagtacgacagcggcacctacagatgcgacgtgcagctggtgaagaacctgagactggtgaagagactgtacttcggcctgagagtgctgccccccaacctggtgaacctgaacttccaccagagcctgaccgaggaccagaagctgatcgacgagggcctggaggtgaacctggacagctacagcaagccccaccaccccaagtggaagaagaaggtggccagcgccctgggcatcggcatcgccatcggcgtggtgggcggcgtgctggtgagaatcgtgctgtgcgccctgagaggcggcctgcagcagtag

SEQ ID NO: 23610 - DNA, 1032 bp, Artificial Sequence
  Description of Artificial Sequence: Synthetic coding sequence
atgttcagcctgcccagcctgcccagctggctgcccggcctgcccagcctggagtggggcagcagcctgctggacagcctgctgcagggcctgatcggcgccctgggcgtgctggtgctgaacagcctgctgaaggtgtacttcttcgtgggctgcgccaacgacccccagagaagacccgagaaggagagactgagagcccagtgggccagcctggagaccgtgcacctggccggcctggccctgttcctgaccgtggtgggcagcagagtggccgccctggtggtgctggagttcagcctgagagccgtgagcaccctgctgagcctgggcaagggcagccagggcgccgccgagagactgcagctgtacctgctgtgccagtacagcctgggctgcggcctgacctgcggcctgagcttcctgcaggagggcgccccccacagaaccctgaacctgctgctgagcctgggcctggccaccctgctgggcctgggcgccagaagactgcacagacacgtgtgcagactgtacgagctgcacagcagccagagatactgcggcgtgtgcctgggcctgctggcccacgcccacggcctgccccagctgctgggcagagccctggccatcgccttcgccgtgggcgacctggccgccgtggccctgatcaaccaggacttcctgaccaccagcgaggccatgagattctggacccccctgaccatctgctacaccctgctggtgatctacatgcaggaggagcagagacagcaccccggcctgcagagccaggtgcagaccgtgctggtgagaatgggcggcctgttcgtgctgctgctgaccgtgggcagatggctggacctgctgggcatcctggtgagcctgctgggcgagctgtggtgcctggtgggcgtgagaaccctgctggacctgtgccagatccaggacttccccagccagagaccccccgtgagcacccccagccagcccctgcccagcgccccccagagccagagcagcgcccccagctag

SEQ ID NO: 23611 - DNA, 450 bp, Artificial Sequence
  Description of Artificial Sequence: Synthetic coding sequence
atgaccgcccagggcggcctggtggccaacagaggcagaagattcaagtgggccatcgagctgagcggccccggcggcggcagcagaggcagaagcgacagaggcagcggccagggcgacagcctgtaccccgtgggctacctggacaagcaggtgcccgacaccagcgtgcaggagaccgacagaatcctggtggagaagagatgctgggacatcgccctgggccccctgaagcagatccccatgaacctgttcatcatgtacatggccggcaacaccatcagcatcttccccaccatgatggtgtgcatgatggcctggagacccatccaggccctgatggccatcagcgccaagaacggcgtgcagtggtggagaaccgccttcgtgaacatgagaaagcagagactggtgcccatgtacctgggcctgatctacatcctgctgtag

SEQ ID NO: 23612 - DNA, 552 bp, Artificial Sequence
  Description of Artificial Sequence: Synthetic coding sequence
atgaccgcccagggcggcctggtggccaacagaggcagaagattcaagtgggccatcgagctgagcggccccggcggcggcagcagaggcagaagcgacagaggcagcggccagggcgacagcctgtaccccgtgggctacctggacaagcaggtgcccgacaccagcgtgcaggagaccgacagaatcctggtggagaagagatgctgggacatcgccctgggccccctgaagcagatccccatgaacctgttcatcatgtacatggccggcaacaccatcagcatcttccccaccatgatggtgtgcatgatggcctggagacccatccaggccctgatggccatcagcgccaccttcaagatgctggagagcagcagccagaagttcctgcagggcctggtgtacctgatcggcaacctgatgggcctggccctggccgtgtacaagtgccagagcatgggcctgctgcccacccacgccagcgactggctggccttcatcgagccccccgagagaatggagttcagcggcggcggcctgctgctgtag

SEQ ID NO: 23613 - DNA, 723 bp, Artificial Sequence
  Description of Artificial Sequence: Synthetic coding sequence
atggtgagccccgtgaccgtggtgaagagcgagggccccaagctggtgcccttcttcaaggccacctgcgtgtacttcgtgctgtggctgcccagcagcagccccagctgggtgagcaccctgatcaagtgcctgcccatcttctgcctgtggctgttcctgctggcccacggcctgggcttcctgctggcccaccccagcgccaccagaatcttcgtgggcctggtgttcagcgccgtgggcgacgccttcctgatctggcaggaccagggctacttcgtgcacggcctgctgatgttcgccgtgacccacatgttctacgccagcgccttcggcatgcagcccctggccctgagaaccggcctggtgatggccgccctgagcggcctgtgctacgccctgctgtacccctgcctgagcggcgccttcacctacctggtgggcgtgtacgtggccctgatcggcttcatgggctggagagccatggccggcctgagactggccggcgccgactggagatggaccgagctggccgccggcagcggcgccctgttcttcatcatcagcgacctgaccatcgccctgaacaagttctgcttccccgtgccctacagcagagccctgatcatgagcacctactacgtggcccagatgctggtggccctgagcgccgtggagagcagagagcccgtggagcactacagactgaccaaggccaactag

SEQ ID NO: 23614 - DNA, 723 bp, Artificial Sequence; identical to SEQ ID NO: 23613
  Description of Artificial Sequence: Synthetic coding sequence

SEQ ID NO: 23615 - DNA, 681 bp, Artificial Sequence
  Description of Artificial Sequence: Synthetic coding sequence
atggacgccggcaaggccggccagaccctgaagacccactgcagcgcccagagacccgacgtgtgcagatggctgagccccttcatcctgagctgctgcgtgtacttctgcctgtggatccccgaggaccagctgagctggttcgccgccctggtgaagtgcctgcccgtgctgtgcctggccggcttcctgtgggtgatgagccccagcggcggctacacccagctgctgcagggcgccctggtgtgcagcgccgtgggcgacgcctgcctgatctggcccgccgccttcgtgcccggcatggccgccttcgccaccgcccacctgctgtacgtgtgggccttcggcttcagccccctgcagcccggcctgctgctgctgatcatcctggcccccggcccctacctgagcctggtgctgcagcacctggagcccgacatggtgctgcccgtggccgcctacggcctgatcctgatggccatgctgtggagaggcctggcccagggcggcagcgccggctggggcgccctgctgttcaccctgagcgacggcgtgctggcctgggacaccttcgcccagcccctgccccacgcccacctggtgatcatgaccacctactacgccgcccagctgctgatcaccctgagcgccctgagaagccccgtgcccaagaccgactag

SEQ ID NO: 23616 - DNA, 546 bp, Artificial Sequence
  Description of Artificial Sequence: Synthetic coding sequence
atggccgccgccgcctggctgcaggtgctgcccgtgatcctgctgctgctgggcgcccaccccagccccctgagcttcttcagcgccggccccgccaccgtggccgccgccgacagaagcaagtggcacatccccatccccagcggcaagaactacttcagcttcggcaagatcctgttcagaaacaccaccatcttcctgaagttcgacggcgagccctgcgacctgagcctgaacatcacctggtacctgaagagcgccgactgctacaacgagatctacaacttcaaggccgaggaggtggagctgtacctggagaagctgaaggagaagagaggcctgagcggcaagtaccagaccagcagcaagctgttccagaactgcagcgagctgttcaagacccagaccttcagcggcgacttcatgcacagactgcccctgctgggcgagaagcaggaggccaaggagaacggcaccaacctgaccttcatcggcgacaagaccatccagatgcccttcctgaagaagcacttcctggactgctag

SEQ ID NO: 23617 - DNA, 1668 bp, Artificial Sequence
  Description of Artificial Sequence: Synthetic coding sequence
atggccgccgccgcctggctgcaggtgctgcccgtgatcctgctgctgctgggcgcccaccccagccccctgagcttcttcagcgccggccccgccaccgtggccgccgccgacagaagcaagtggcacatccccatccccagcggcaagaactacttcagcttcggcaagatcctgttcagaaacaccaccatcttcctgaagttcgacggcgagccctgcgacctgagcctgaacatcacctggtacctgaagagcgccgactgctacaacgagatctacaacttcaaggccgaggaggtggagctgtacctggagaagctgaaggagaagagaggcctgagcggcaagtaccagaccagcagcaagctgttccagaactgcagcgagctgttcaagacccagaccttcagcggcgacttcatgcacagactgcccctgctgggcgagaagcaggaggccaaggagaacggcaccaacctgaccttcatcggcgacaagaccgccatgcacgagcccctgcagacctggcaggacgccccctacatcttcatcgtgcacatcggcatcagcagcagcaaggagagcagcaaggagaacagcctgagcaacctgttcaccatgaccgtggaggtgaagggcccctacgagtacctgaccctggaggactaccccctgatgatcttcttcatggtgatgtgcatcgtgtacgtgctgttcggcgtgctgtggctggcctggagcgcctgctactggagagacctgctgagaatccagttctggatcggcgccgtgatcttcctgggcatgctggagaaggccgtgttctacgccgagttccagaacatcagatacaagggcgagagcgtgcagggcgccctgatcctggccgagctgctgagcgccgtgaagagaagcctggccagaaccctggtgatcatcgtgagcctgggctacggcatcgtgaagcccagactgggcgtgaccctgcacaaggtggtggtggccggcgccctgtacctgctgttcagcggcatggagggcgtgctgagagtgaccggcgcccagaccgacctggccagcctggccttcatccccctggccttcctggacaccgccctgtgctggtggatcttcatcagcctgacccagaccatgaagctgctgaagctgagaagaaacatcgtgaagctgagcctgtacagacacttcaccaacaccctgatcctggccgtggccgccagcatcgtgttcatcatctggaccaccatgaagttcagaatcgtgacctgccagagcgactggagagagctgtgggtggacgacgccatctggagactgctgttcagcatgatcctgttcgtgatcatggtgctgtggagacccagcgccaacaaccagagattcgccttcagccccctgagcgaggaggaggaggaggacgagcagaaggagcccatgctgaaggagagcttcgagggcatgaagatgagaagcaccaagcaggagcccaacggcaacagcaaggtgaacaaggcccaggaggacgacctgaagtgggtggaggagaacgtgcccagcagcgtgaccgacgtggccctgcccgccctgctggacagcgacgaggagagaatgatcacccacttcgagagaagcaagatggagtag

SEQ ID NO: 23618 - DNA, 1485 bp, Artificial Sequence
  Description of Artificial Sequence: Synthetic coding sequence
atggcccacagcgacaccgtggtggacggcgagccctgcgacctgagcctgaacatcacctggtacctgaagagcgccgactgctacaacgagatctacaacttcaaggccgaggaggtggagctgtacctggagaagctgaaggagaagagaggcctgagcggcaagtaccagaccagcagcaagctgttccagaactgcagcgagctgttcaagacccagaccttcagcggcgacttcatgcacagactgcccctgctgggcgagaagcaggaggccaaggagaacggcaccaacctgaccttcatcggcgacaagaccgccatgcacgagcccctgcagacctggcaggacgccccctacatcttcatcgtgcacatcggcatcagcagcagcaaggagagcagcaaggagaacagcctgagcaacctgttcaccatgaccgtggaggtgaagggcccctacgagtacctgaccctggaggactaccccctgatgatcttcttcatggtgatgtgcatcgtgtacgtgctgttcggcgtgctgtggctggcctggagcgcctgctactggagagacctgctgagaatccagttctggatcggcgccgtgatcttcctgggcatgctggagaaggccgtgttctacgccgagttccagaacatcagatacaagggcgagagcgtgcagggcgccctgatcctggccgagctgctgagcgccgtgaagagaagcctggccagaaccctggtgatcatcgtgagcctgggctacggcatcgtgaagcccagactgggcgtgaccctgcacaaggtggtggtggccggcgccctgtacctgctgttcagcggcatggagggcgtgctgagagtgaccggcgcccagaccgacctggccagcctggccttcatccccctggccttcctggacaccgccctgtgctggtggatcttcatcagcctgacccagaccatgaagctgctgaagctgagaagaaacatcgtgaagctgagcctgtacagacacttcaccaacaccctgatcctggccgtggccgccagcatcgtgttcatcatctggaccaccatgaagttcagaatcgtgacctgccagagcgactggagagagctgtgggtggacgacgccatctggagactgctgttcagcatgatcctgttcgtgatcatggtgctgtggagacccagcgccaacaaccagagattcgccttcagccccctgagcgaggaggaggaggaggacgagcagaaggagcccatgctgaaggagagcttcgagggcatgaagatgagaagcaccaagcaggagcccaacggcaacagcaaggtgaacaaggcccaggaggacgacctgaagtgggtggaggagaacgtgcccagcagcgtgaccgacgtggccctgcccgccctgctggacagcgacgaggagagaatgatcacccacttcgagagaagcaagatggagtag

SEQ ID NO: 23619 - DNA, 1596 bp, Artificial Sequence
  Description of Artificial Sequence: Synthetic coding sequence
atgtacaagagaagagtggtgtacctgagcgacgtgagccagaaccccgtgagccccggctggatcagaaagggcaagaactacttcagcttcggcaagatcctgttcagaaacaccaccatcttcctgaagttcgacggcgagccctgcgacctgagcctgaacatcacctggtacctgaagagcgccgactgctacaacgagatctacaacttcaaggccgaggaggtggagctgtacctggagaagctgaaggagaagagaggcctgagcggcaagtaccagaccagcagcaagctgttccagaactgcagcgagctgttcaagacccagaccttcagcggcgacttcatgcacagactgcccctgctgggcgagaagcaggaggccaaggagaacggcaccaacctgaccttcatcggcgacaagaccgccatgcacgagcccctgcagacctggcaggacgccccctacatcttcatcgtgcacatcggcatcagcagcagcaaggagagcagcaaggagaacagcctgagcaacctgttcaccatgaccgtggaggtgaagggcccctacgagtacctgaccctggaggactaccccctgatgatcttcttcatggtgatgtgcatcgtgtacgtgctgttcggcgtgctgtggctggcctggagcgcctgctactggagagacctgctgagaatccagttctggatcggcgccgtgatcttcctgggcatgctggagaaggccgtgttctacgccgagttccagaacatcagatacaagggcgagagcgtgcagggcgccctgatcctggccgagctgctgagcgccgtgaagagaagcctggccagaaccctggtgatcatcgtgagcctgggctacggcatcgtgaagcccagactgggcgtgaccctgcacaaggtggtggtggccggcgccctgtacctgctgttcagcggcatggagggcgtgctgagagtgaccggcgcccagaccgacctggccagcctggccttcatccccctggccttcctggacaccgccctgtgctggtggatcttcatcagcctgacccagaccatgaagctgctgaagctgagaagaaacatcgtgaagctgagcctgtacagacacttcaccaacaccctgatcctggccgtggccgccagcatcgtgttcatcatctggaccaccatgaagttcagaatcgtgacctgccagagcgactggagagagctgtgggtggacgacgccatctggagactgctgttcagcatgatcctgttcgtgatcatggtgctgtggagacccagcgccaacaaccagagattcgccttcagccccctgagcgaggaggaggaggaggacgagcagaaggagcccatgctgaaggagagcttcgagggcatgaagatgagaagcaccaagcaggagcccaacggcaacagcaaggtgaacaaggcccaggaggacgacctgaagtgggtggaggagaacgtgcccagcagcgtgaccgacgtggccctgcccgccctgctggacagcgacgaggagagaatgatcacccacttcgagagaagcaagatggagtag

SEQ ID NO: 23620 - DNA, 1668 bp, Artificial Sequence
  Description of Artificial Sequence: Synthetic coding sequence
atggtggccgcctgcagaagcgtggccggcctgctgcccagaagaagaagatgcttccccgccagagcccccctgctgagagtggccctgtgcctgctgtgctggacccccgccgccgtgagagccgtgcccgagctgggcctgtggctggagaccgtgaacgacaagagcggccccctgatcttcagaaagaccatgttcaacagcaccgacatcaagctgagcgtgaagagcttccactgcagcggccccgtgaagttcaccatcgtgtggcacctgaagtaccacacctgccacaacgagcacagcaacctggaggagctgttccagaagcacaagctgagcgtggacgaggacttctgccactacctgaagaacgacaactgctggaccaccaagaacgagaacctggactgcaacagcgacagccaggtgttccccagcctgaacaacaaggagctgatcaacatcagaaacgtgagcaaccaggagagaagcatggacgtggtggccagaacccagaaggacggcttccacatcttcatcgtgagcatcaagaccgagaacaccgacgccagctggaacctgaacgtgagcctgagcatgatcggcccccacggctacatcagcgccagcgactggcccctgatgatcttctacatggtgatgtgcatcgtgtacatcctgtacggcatcctgtggctgacctggagcgcctgctactggaaggacatcctgagaatccagttctggatcgccgccgtgatcttcctgggcatgctggagaaggccgtgttctacagcgagtaccagaacatcagcaacaccggcctgagcacccagggcctgctgatcttcgccgagctgatcagcgccatcaagagaaccctggccagactgctggtgatcatcgtgagcctgggctacggcatcgtgaagcccagactgggcaccgtgatgcacagagtgatcggcctgggcctgctgtacctgatcttcgccgccgtggagggcgtgatgagagtgatcggcggcagcaaccacctggccgtggtgctggacgacatcatcctggccgtgatcgacagcatcttcgtgtggttcatcttcatcagcctggcccagaccatgaagaccctgagactgagaaagaacaccgtgaagttcagcctgtacagacacttcaagaacaccctgatcttcgccgtgctggccagcatcgtgttcatgggctggaccaccaagaccttcagaatcgccaagtgccagagcgactggatggagagatgggtggacgacgccttctggagcttcctgttcagcctgatcctgatcgtgatcatgttcctgtggagacccagcgccaacaaccagagatacgccttcatgcccctgatcgacgacagcgacgacgagatcgaggagttcatggtgaccagcgagaacctgaccgagggcatcaagctgagagccagcaagagcgtgagcaacggcaccgccaagcccgccaccagcgagaacttcgacgaggacctgaagtgggtggaggagaacatccccagcagcttcaccgacgtggccctgcccgtgctggtggacagcgacgaggagatcatgaccagaagcgagatggccgagaagatgttcagcagcgagaagatcatgtag

SEQ ID NO: 23621 - DNA, 480 bp, Artificial Sequence
  Description of Artificial Sequence: Synthetic coding sequence
atggccgacgtgcccggcgcccagagagccgtgcccggcgacggccccgagcccagagaccccctggactgctgggcctgcgccgtgctggtgaccgcccagaacctgctggtggccgccttcaacctgctgctgctggtgctggtgctgggcaccatcctgctgcccgccgtgaccatgctgggcttcggcttcctgtgccacagccagttcctgagaagccaggcccccccctgcaccgcccacctgagagaccccggcttcaccgccctgctggtgaccggcttcctgctgctggtgcccctgctggtgctggccctggccagctacagaagactgtgcctgagactgagactggccgactgcctggtgccctacagcagagccctgtacagaagaagaagagccccccagcccagacagatcagagccagccccggcagccaggccgtgcccaccagcggcaaggtgtgggtgtag

SEQ ID NO: 23622 - DNA, 480 bp, Artificial Sequence
  Description of Artificial Sequence: Synthetic coding sequence
atgctgcacgtgctggccagcctgcccctgctgctgctgctggtgaccagcgccagcacccacgcctggagcagacccctgtggtaccaggtgggcctggacctgcagccctggggctgccagcccaagagcgtggagggctgcagaggcggcctgagctgccccggctactggctgggccccggcgccagcagaatctaccccgtggccgccgtgatgatcaccaccaccatgctgatgatctgcagaaagatcctgcagggcagaagaagaagccaggccaccaagggcgagcacccccaggtgaccaccgagccctgcggcccctggaagagaagagcccccatcagcgaccacaccctgctgagaggcgtgctgcacatgctggacgccctgctggtgcacatcgagggccacctgagacacctggccacccagagacagatccagatcaagggcaccagcacccagagcggctag

SEQ ID NO: 23623 - DNA, 780 bp, Artificial Sequence
  Description of Artificial Sequence: Synthetic coding sequence
atgtgccccgagaacgccgaggactgcgagcaggccgtggtgcacgtggagaccaccctgtacctggtgccctgcctgaacgactgcggcccctacggccagtgcctgctgctgagaagacacagctacctgtacgccagctgcagctgcaaggccggctggagaggctggagctgcaccgacaacagcaccgcccagaccgtggcccagcagagagccgccaccctgctgctgaccctgagcaacctgatgttcctggcccccatcgccgtgagcgtgagaagattcttcctggtggaggccagcgtgtacgcctacaccatgttcttcagcaccttctaccacgcctgcgaccagcccggcgaggccgtgctgtgcatcctgagctacgacaccctgcagtactgcgacttcctgggcagcggcgccgccatctgggtgaccatcctgtgcatggccagactgaagaccgtgctgaagtacgcctacagatgcggccacagaagacagtgctaccccaccagctggcagagatgggccttctacctgctgcccggcgtgagcatggccagcgtgggcatcgccatctacaccagcatgatgaccagcgacaactactactacacccacagcatctggcacatcctgctggccggcagcgccgccctgctgctgcccccccccgaccagcccgccgagccctgggcctgcagccagaagttcccctgccactaccagatctgcaagaacgacagagaggagctgtacgccgtgacctag

SEQ ID NO: 23624 - DNA, 2316 bp, Artificial Sequence
  Description of Artificial Sequence: Synthetic coding sequence
atgggcagagccggcaccggcaccggcggcgaggccgtggccgccgtggtggccggccccctgctgctgctgctgctggccagacccccccccgccagcgccggctacagcggcaagagcgaggtgggcctggtgagcgagcacttcagccaggccccccagagactgagcttctacagctggtacggcagcgccagactgttcagattcagagtgccccccgacgccgtgctgctgagatggctgctgcaggtgagcagagagagcggcgccgcctgcaccgacgccgagatcaccgtgcacttcagaagcggcgccccccccgtgatcaaccccctgggcaccagcttccccgacgacaccgccgtgcagcccagcttccaggtgggcgtgcccctgagcaccacccccagaagcaacgccagcgtgaacgtgagccaccccgcccccggcgactggttcgtggccgcccacctgccccccagcagccagaagatcgagctgaagggcctggcccccacctgcgcctacgtgttccagcccgagctgctggtgaccagagtggtggagatcagcatcatggagcccgacgtgcccctgccccagaccctgctgagccaccccagctacctgaaggtgttcgtgcccgactacaccagagagctgctgctggagctgagagactgcgtgagcaacggcagcctgggctgccccgtgagactgaccgtgggccccgtgaccctgcccagcaacttccagaaggtgctgacctgcaccggcgccccctggccctgcagactgctgctgcccagccccccctgggacagatggctgcaggtgaccgccgagagcctggtgggccccctgggcaccgtggccttcagcgccgtggccgccctgaccgcctgcagacccagaagcgtgaccatccagcccctgctgcagagcagccagaaccagagcttcaacgccagcagcggcctgctgagccccagccccgaccaccaggacctgggcagaagcggcagagtggacagaagccccttctgcctgaccaactaccccgtgaccagagaggacatggacgtggtgagcgtgcacttccagcccctggacagagtgagcgtgagagtgtgcagcgacacccccagcgtgatgagactgagactgaacaccggcatggacagcggcggcagcctgaccatcagcctgagagccaacaagaccgagatgagaaacgagaccgtggtggtggcctgcgtgaacgccgccagccccttcctgggcttcaacaccagcctgaactgcaccaccgccttcttccagggctaccccctgagcctgagcgcctggagcagaagagccaacctgatcatcccctaccccgagaccgacaactggtacctgagcctgcagctgatgtgccccgagaacgccgaggactgcgagcaggccgtggtgcacgtggagaccaccctgtacctggtgccctgcctgaacgactgcggcccctacggccagtgcctgctgctgagaagacacagctacctgtacgccagctgcagctgcaaggccggctggagaggctggagctgcaccgacaacagcaccgcccagaccgtggcccagcagagagccgccaccctgctgctgaccctgagcaacctgatgttcctggcccccatcgccgtgagcgtgagaagattcttcctggtggaggccagcgtgtacgcctacaccatgttcttcagcaccttctaccacgcctgcgaccagcccggcgaggccgtgctgtgcatcctgagctacgacaccctgcagtactgcgacttcctgggcagcggcgccgccatctgggtgaccatcctgtgcatggccagactgaagaccgtgctgaagtacgtgctgttcctgctgggcaccctggtgatcgccatgagcctgcagctggacagaagaggcatgtggaacatgctgggcccctgcctgttcgccttcgtgatcatggccagcatgtgggcctacagatgcggccacagaagacagtgctaccccaccagctggcagagatgggccttctacctgctgcccggcgtgagcatggccagcgtgggcatcgccatctacaccagcatgatgaccagcgacaactactactacacccacagcatctggcacatcctgctggccggcagcgccgccctgctgctgcccccccccgaccagcccgccgagccctgggcctgcagccagaagttcccctgccactaccagatctgcaagaacgacagagaggagctgtacgccgtgacctag

SEQ ID NO: 23625 - DNA, 1419 bp, Artificial Sequence
  Description of Artificial Sequence: Synthetic coding sequence
atgaacatgccccagagcctgggcaaccagcccctgccccccgagccccccagcctgggcacccccgccgagggccccggcaccaccagcccccccgagcactgctggcccgtgagacccaccctgagaaacgagctggacaccttcagcgtgcacttctacatcttcttcggccccagcgtggccctgccccccgagagacccgccgtgttcgccatgagactgctgcccgtgctggacagcggcggcgtgctgagcctggagctgcagctgaacgccagcagcgtgagacaggagaacgtgaccgtgttcggctgcctgacccacgaggtgcccctgagcctgggcgacgccgccgtgacctgcagcaaggagagcctggccggcttcctgctgagcgtgagcgccaccaccagagtggccagactgagaatccccttcccccagaccggcacctggttcctggccctgagaagcctgtgcggcgtgggccccagattcgtgagatgcagaaacgccaccgccgaggtgagaatgagaaccttcctgagcccctgcgtggacgactgcggcccctacggccagtgcaagctgctgagaacccacaactacctgtacgccgcctgcgagtgcaaggccggctggagaggctggggctgcaccgacagcgccgacgccctgacctacggcttccagctgctgagcaccctgctgctgtgcctgagcaacctgatgttcctgccccccgtggtgctggccatcagaagcagatacgtgctggaggccgccgtgtacaccttcaccatgttcttcagcaccttctaccacgcctgcgaccagcccggcatcgtggtgttctgcatcatggactacgacgtgctgcagttctgcgacttcctgggcagcctgatgagcgtgtgggtgaccgtgatcgccatggccagactgcagcccgtggtgaagcaggtgctgtacctgctgggcgccatgctgctgagcatggccctgcagctggacagacacggcctgtggaacctgctgggccccagcctgttcgccctgggcatcctggccaccgcctggaccgtgagaagcgtgagaagaagacactgctacccccccacctggagaagatggctgttctacctgtgccccggcagcctgatcgccggcagcgccgtgctgctgtacgccttcgtggagaccagagacaactacttctacatccacagcatctggcacatgctgatcgccggcagcgtgggcttcctgctgccccccagagccaagaccgaccacggcgtgcccagcggcgccagagccagaggctgcggctaccagctgtgcatcaacgagcaggaggagctgggcctggtgggccccggcggcgccaccgtgagcagcatctgcgccagctag

SEQ ID NO: 23626 - DNA, 1419 bp, Artificial Sequence; identical to SEQ ID NO: 23625
  Description of Artificial Sequence: Synthetic coding sequence

SEQ ID NO: 23627 - DNA, 1017 bp, Artificial Sequence
  Description of Artificial Sequence: Synthetic coding sequence
atgaacatgccccagagcctgggcaaccagcccctgccccccgagccccccagcctgggcacccccgccgagggccccggcaccaccagcccccccgagcactgctggcccgtgagacccaccctgagaaacgagctggacaccttcagcgtgcacttctacatcttcttcggccccagcgtggccctgccccccgagagacccgccgtgttcgccatgagactgctgcccgtgctggacagcggcggcgtgctgagcctggagctgcagctgaacgccagcagcgtgagacaggagaacgtgaccgtgttcggctgcctgacccacgaggtgcccctgagcctgggcgacgccgccgtgacctgcagcaaggagagcctggccggcttcctgctgagcgtgagcgccaccaccagagtggccagactgagaatccccttcccccagaccggcacctggttcctggccctgagaagcctgtgcggcgtgggccccagattcgtgagatgcagaaacgccaccgccgaggtgagaatgagaaccttcctgagcccctgcgtggacgactgcggcccctacggccagtgcaagctgctgagaacccacaactacctgtacgccgcctgcgagtgcaaggccggctggagaggctggggctgcaccgacagcgccgacgccctgacctacggcttccagctgctgagcaccctgctgctgtgcctgagcaacctgatgttcctgccccccgtggtgctggccatcagaagcagatacgtgctggaggccgccgtgtacaccttcaccatgttcttcagcaccgtgtgcggcggcgtgtgcatcctgagcctgggcgcctgcgcctggtggtgggtgaccgtgtgcatcagcaccaccttcagcgagggcctgggcatgagcgtgcccagcctgtgcctgctgcagaccgagaccgccgtgctgcccaagctgagctgcatcgacaacggccacttctgcaagacccactggagcaagtag

SEQ ID NO: 23628 - DNA, 1017 bp, Artificial Sequence; identical to SEQ ID NO: 23627
  Description of Artificial Sequence: Synthetic coding sequence

SEQ ID NO: 23629 - DNA, 552 bp, Artificial Sequence
  Description of Artificial Sequence: Synthetic coding sequence
atgaagctgctgagcctggtggccgtggtgggctgcctgctggtgccccccgccgaggccaacaagagcagcgaggacatcagatgcaagtgcatctgccccccctacagaaacatcagcggccacatctacaaccagaacgtgagccagaaggactgcaactgcctgcacgtggtggagcccatgcccgtgcccggccacgacgtggaggcctactgcctgctgtgcgagtgcagatacgaggagagaagcaccaccaccatcaaggtgatcatcgtgatctacctgagcgtggtgggcgccctgctgctgtacatggccttcctgatgctggtggaccccctgatcagaaagcccgacgcctacaccgagcagctgcacaacgaggaggagaacgaggacgccagaagcatggccgccgccgccgccagcctgggcggccccagagccaacaccgtgctggagagagtggagggcgcccagcagagatggaagctgcaggtgcaggagcagagaaagaccgtgttcgacagacacaagatgctgagctag

SEQ ID NO: 23630 - DNA, 552 bp, Artificial Sequence; identical to SEQ ID NO: 23629
  Description of Artificial Sequence: Synthetic coding sequence

SEQ ID NO: 23631 - DNA, 561 bp, Artificial Sequence
  Description of Artificial Sequence: Synthetic coding sequence
atgaagctgctgagcctggtggccgtggtgggctgcctgctggtgccccccgccgaggccaacaaggtgagagagagcagcgaggacatcagatgcaagtgcatctgccccccctacagaaacatcagcggccacatctacaaccagaacgtgagccagaaggactgcaactgcctgcacgtggtggagcccatgcccgtgcccggccacgacgtggaggcctactgcctgctgtgcgagtgcagatacgaggagagaagcaccaccaccatcaaggtgatcatcgtgatctacctgagcgtggtgggcgccctgctgctgtacatggccttcctgatgctggtggaccccctgatcagaaagcccgacgcctacaccgagcagctgcacaacgaggaggagaacgaggacgccagaagcatggccgccgccgccgccagcctgggcggccccagagccaacaccgtgctggagagagtggagggcgcccagcagagatggaagctgcaggtgcaggagcagagaaagaccgtgttcgacagacacaagatgctgagctag

SEQ ID NO: 23632 - DNA, 561 bp, Artificial Sequence; identical to SEQ ID NO: 23631
  Description of Artificial Sequence: Synthetic coding sequence

SEQ ID NO: 23633 - DNA, 552 bp, Artificial Sequence; identical to SEQ ID NO: 23629
  Description of Artificial Sequence: Synthetic coding sequence

SEQ ID NO: 23634 - DNA, 345 bp, Artificial Sequence
  Description of Artificial Sequence: Synthetic coding sequence
atgaagctgctgagcctggtggccgtggtgggctgcctgctggtgccccccgccgaggccaacaaggtgagagaggtgagcctgcagcacctggtgaccaccaccgtgcacggccaccccgtgtacagagccgacagcgagagcagcgaggacatcagatgcaagtgcatctgccccccctacagaaacatcagcggccacatctacaaccagaacgtgagccagaaggactgcaactgcctgcacgtggtggagcccatgcccgtgcccggccacgacgtggaggcctactgcctgctgtgcgagtgcagatacgaggagagaagcaccaccaccatcaagtag

SEQ ID NO: 23635 - DNA, 417 bp, Artificial Sequence
  Description of Artificial Sequence: Synthetic coding sequence
atgaagctgctgagcctggtggccgtggtgggctgcctgctggtgccccccgccgaggccaacaagagcagcgaggacatcagatgcaagtgcatctgccccccctacagaaacatcagcggccacatctacaaccagaacgtgagccagaaggactgcaactgcctgcacgtggtggagcccatgcccgtgcccggccacgacgtggaggcctactgcctgctgtgcgagtgcagatacgaggagagaagcaccaccaccatcaaggtgatcatcgtgatctacctgagcgtggtgggcgccctgctgctgtacatggccttcctgatgctggtggaccccctgatcagaaagcccgacgcctacaccgagcagctgcacaacgaggaggagaacgaggacgccagaagcatgtag

SEQ ID NO: 23636 - DNA, 456 bp, Artificial Sequence
  Description of Artificial Sequence: Synthetic coding sequence
atgaagctgctgagcctggtggccgtggtgggctgcctgctggtgccccccgccgaggccaacaagagcagcgaggacatcagatgcaagtgcatctgccccccctacagaaacatcagcggccacatctacaaccagaacgtgagccagaaggactgccccgtgagcctgtgctgcagcaactgcctgcacgtggtggagcccatgcccgtgcccggccacgacgtggaggcctactgcctgctgtgcgagtgcagatacgaggagagaagcaccaccaccatcaaggtgatcatcgtgatctacctgagcgtggtgggcgccctgctgctgtacatggccttcctgatgctggtggaccccctgatcagaaagcccgacgcctacaccgagcagctgcacaacgaggaggagaacgaggacgccagaagcatggccgccgccgccgccagctag

SEQ ID NO: 23637 - DNA, 369 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagaccaactag

SEQ ID NO: 23638 - DNA, 420 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagcacccccagtgcctgacctacagcagatgctacgtgagcgccttcggcatccacgcctag

SEQ ID NO: 23639 - DNA, 519 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagaccaacaaggcctgggccaagggcgacatccagggcgccggcgccgccagcagaagagccttcctgctgggcgtgctggccgtgggcctgggcgtgtgcacctacgccgccgccctggtgaccctggccgcctacctggccagcagagaccccccctag

SEQ ID NO: 23640 - DNA, 402 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagaccagacccagctgcccctacagcccccactgcgagccctag

SEQ ID NO: 23641 - DNA, 372 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagcccagcctgtag

SEQ ID NO: 23642 - DNA, 384 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagctgcccctgcagcccagcctgtag

SEQ ID NO: 23643 - DNA, 183 bp, Artificial Sequence
  Description of Artificial Sequence: Synthetic coding sequence
tgatgggacggcggcagcagactgagccccttcctgccccacgaccacctgggcctggccgtgttcagcatgctgtgctgcttctggcccgtgggcatcgccgccttctgcctggcccagaagcacccccagtgcctgacctacagcagatgctacgtgagcgccttcggcatccacgcctag

SEQ ID NO: 23644 - DNA, 345 bp, Artificial Sequence
  Description of Artificial Sequence: Synthetic coding sequence
atggacagccccagcctgagagagctgcagcagcccctgctggagggcaccgagtgcgagacccccgcccagaagcccggcagacacgagctgggcagccccctgagagagatcgccttcgccgagagcctgagaggcctgcagttcctgagcccccccctgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgcctag

SEQ ID NO: 23645 - DNA, 402 bp, Artificial Sequence; identical to SEQ ID NO: 23640
  Description of Artificial Sequence: Synthetic coding sequence

SEQ ID NO: 23646 - DNA, 264 bp, Artificial Sequence
  Description of Artificial Sequence: Synthetic coding sequence
tgactgcccagcgtgagcgccggcctgggcgagcccagaccccccgacgtggaggacatgagcagcagcgacagcgacagcgactgggacggcggcagcagactgagccccttcctgccccacgaccacctgggcctggccgtgttcagcatgctgtgctgcttctggcccgtgggcatcgccgccttctgcctggcccagaagcacccccagtgcctgacctacagcagatgctacgtgagcgccttcggcatccacgcctag

SEQ ID NO: 23647 - DNA, 480 bp, Artificial Sequence
  Description of Artificial Sequence: Synthetic coding sequence
atgagccaggcctgggtgcccggcctggcccccaccctgctgttcagcctgctggccggcccccagaagatcgccgccaagtgcggcctgatcctggcctgccccaagggcttcaagtgctgcggcgacagctgctgccaggagaacgagctgttccccggccccgtgagaatcttcgtgatcatcttcctggtgatcctgagcgtgttctgcatctgcggcctggccaagtgcttctgcagaaactgcagagagcccgagcccgacagccccgtggactgcagaggccccctggagctgcccagcatcatcccccccgagagagtgagagtgagcctgagcgcccccccccccccctacagcgaggtgatcctgaagcccagcctgggccccacccccaccgagcccccccccccctacagcttcagacccgaggagtacaccggcgaccagagaggcatcgacaaccccgccttctag

SEQ ID NO: 23648 - DNA, 480 bp, Artificial Sequence; identical to SEQ ID NO: 23647
  Description of Artificial Sequence: Synthetic coding sequence

SEQ ID NO: 23649 - DNA, 333 bp, Artificial Sequence
  Description of Artificial Sequence: Synthetic coding sequence
atggccgccgtggtggccaagagagagggcccccccttcatcagcgaggccgccgtgagaggcaacgccgccgtgctggactactgcagaaccagcgtgagcgccctgagcggcgccaccgccggcatcctgggcctgaccggcctgtacggcttcatcttctacctgctggccagcgtgctgctgagcctgctgctgatcctgaaggccggcagaagatggaacaagtacttcaagagcagaagacccctgttcaccggcggcctgatcggcggcctgttcacctacgtgctgttctggaccttcctgtacggcatggtgcacgtgtactag

SEQ ID NO: 23650 - DNA, 333 bp, Artificial Sequence; identical to SEQ ID NO: 23649
  Description of Artificial Sequence: Synthetic coding sequence

SEQ ID NO: 23651 - DNA, 681 bp, Artificial Sequence
  Description of Artificial Sequence: Synthetic coding sequence
atggagaccgtggtgatcgtggccatcggcgtgctggccaccatcttcctggccagcttcgccgccctggtgctggtgtgcagacagagatactgcagacccagagacctgctgcagagatacgacagcaagcccatcgtggacctgatcggcgccatggagacccagagcgagcccagcgagctggagctggacgacgtggtgatcaccaacccccacatcgaggccatcctggagaacgaggactggatcgaggacgccagcggcctgatgagccactgcatcgccatcctgaagatctgccacaccctgaccgagaagctggtggccatgaccatgggcagcggcgccaagatgaagaccagcgccagcgtgagcgacatcatcgtggtggccaagagaatcagccccagagtggacgacgtggtgaagagcatgtacccccccctggaccccaagctgctggacgccagaaccaccgccctgctgctgagcgtgagccacctggtgctggtgaccagaaacgcctgccacctgaccggcggcctggactggatcgaccagagcctgagcgccgccgaggagcacctggaggtgctgagagaggccgccctggccagcgagcccgacaagggcctgcccggccccgagggcttcctgcaggagcagagcgccatctag

SEQ ID NO: 23652 - DNA, 681 bp, Artificial Sequence; identical to SEQ ID NO: 23651
  Description of Artificial Sequence: Synthetic coding sequence

SEQ ID NO: 23653 - DNA, 414 bp, Artificial Sequence
  Description of Artificial Sequence: Synthetic coding sequence
atggagaccgtggtgatcgtggccatcggcgtgctggccaccatcttcctggccagcttcgccgccctggtgctggtgtgcagacagagatactgcagacccagagacctgctgcagagatacgacagcaagcccatcgtggacctgatcggcgccatggagacccagagcgagcccagcgagctggagctggacgacgtggtgatcaccaacccccacatcgaggccatcctggagaacgaggactggatcgaggacgccagcggcctgatgagccactgcatcgccatcctgaagatctgccacaccctgaccgagaagctggtggccatgaccatgggcagcggcgccaagatgaagaccagcgccagcgtgagcgacatcatcgtggtggccaagagaatcagcccctag

SEQ ID NO: 23654 - DNA, 669 bp, Artificial Sequence
  Description of Artificial Sequence: Synthetic coding sequence
atggagaccgtggtgatcgtggccatcggcgtgctggccaccatcttcctggccagcttcgccgccctggtgctggtgtgcagacagagatactgcagacccagagacctgctgcagagatacgacagcaagcccatcgtggacctgatcggcgccatggagacccagagcgagcccagcgagctggagctggacgacgtggtgatcaccaacccccacatcgaggccatcctggagaacgaggactggatcgaggacgccagcggcctgatgagccactgcatcgccatcctgaagatctgccacaccctgaccgagaagctggtggccatgaccatgggcagcggcgccaagatgaagaccagcgccagcgtgagcgacatcatcgtggtggccaagagaatcagccccagagtggacgacgtggtgaagagcatgtacccccccctggaccccaagctgctggacgccagaaccaccgccctgctgctgagcgtgagccacctggtgctggtgaccagaaacgcctgccacctgaccggcggcctggactggatcgaccagagcctgagcgccgccgaggagcacctggaggtgctgagagaggccgccctggccagcgagcccgacaagggcctgcccggccccgagggcttcctgcaggagtag

SEQ ID NO: 23655 - DNA, 681 bp, Artificial Sequence; identical to SEQ ID NO: 23651
  Description of Artificial Sequence: Synthetic coding sequence

SEQ ID NO: 23656 - DNA, 777 bp, Artificial Sequence
  Description of Artificial Sequence: Synthetic coding sequence
atggtgggcatcctgcccctgtgctgcagcggctgcgtgcccagcctgtgctgcagcagctacgtgcccagcgtggcccccaccgccgcccacagcgtgagagtgccccacagcgccggccactgcggccagagagtgctggcctgcagcctgccccaggtgttcctgaagccctggatcttcgtggagcacttcagcagctggctgagcctggagctgttcagcttcctgagatacctgggcaccctgctgtgcgcctgcggccacagactgagagagggcctgctgctgccctgcctgctgggcgtgggcagctggctgctgttcaacaactggaccggcggcagctggttcagcctgcacctgcagcaggtgagcctgagccagggcagccacgtggccgccttcctgcccgaggccatcggccccggcgtgcccgtgcccgtgagcggcgagagcaccagcgcccagcagagccacgccggctggcagctgagcgccgaggccgacgcctgccccagcgtgctgtacagcgaggtgctggagtggaacaagaacatcaacacctacaccagcttccacgacttctgcctgatcctgggcatcttcctgttctgcttcgtgctggccgtgatcggcctgccctacatcaagcccggcctgagcctgagcgtggccctgctgtggcagagcctgatcctgctgagcagcctggtgcagcaggacagccaggtgcacacctggggctgcctgttcagcaccttcaccagcacctag

SEQ ID NO: 23657 - DNA, 570 bp, Artificial Sequence
  Description of Artificial Sequence: Synthetic coding sequence
atggtgggcatcctgcccctgtgctgcagcggctgcgtgcccagcctgtgctgcagcagctacgtgcccagcgtggcccccaccgccgcccacagcgtgagagtgccccacagcgccggccactgcggccagagagtgctggcctgcagcctgccccaggtgttcctgaagccctggatcttcgtggagcacttcagcagctggctgagcctggagctgttcagcttcctgagatacctgggcaccctgctgtgcgcctgcggccacagactgagagagggcctgctgctgccctgcctgctgggcgtgggcagctggctgctgttcaacaactggaccggcggcagctggttcagcctgcacctgcagcaggtgagcctgagccagggcagccacgtggccgccttcctgcccgaggccatcggccccggcgtgcccgtgcccgtgagcggcgagagcaccagcgcccagcagagccacgccggctggcagctgagcgccgaggccgacgcctgccccagcgtgctgtacagcgaggtgctggagtggaacaagaacatcaacacctag

SEQ ID NO: 23658 - DNA, 507 bp, Artificial Sequence
  Description of Artificial Sequence: Synthetic coding sequence
atgcccaagggctggggcgtgagaagcagcaccttcctgcccctgtggctgcccgtgaagatcgagctgcaccaggtgcagttccacagcagcagccagatgatcttcagcaccctgagaagcgagctgtacaagctgctggccctgtgccagcacgccgtggtgcccatgggcaagttcctgggcaagaccaagacccagagccagggccaggtggtgatcttcagcgagaagggcaaggccatcatctacctgagcctgcccagaaccgtgcccatctacacctgcatcttcagccagagcgtgggctgcctgttcatcctgctgatcatcagcctgaacttcctgctgttcatctacttcatcgagaccgacctgatcatgctgcccagagtgatcctggacctgctggccagcagcgacccccccaccctggtgagccagagcgccggcatcaccgacgtgaactaccacacccagagcacctgcagaagattcagcgtgtag

SEQ ID NO: 23659 - DNA, 1362 bp, Artificial Sequence
  Description of Artificial Sequence: Synthetic coding sequence
atggccatcttcagacagctgagcctgggcgccaaggccaccctggccgccgtgaccgtgttcgtgagcatgatcgccagcagaagctacctggccgagagcctggagctgagagcctggagatggctgctgagactgcagctggccctgttcgtgaacagcctgctgctgatcggcagcctgtacatctggagaagcaccgtgagcaacctgtgccacagccccgccgccgagagcacctgcttccagctgtggaaggtggtggtgctggccttcctggccctggcccacagcagcttcttcaccatgttcttcctggtggccgaggagccctacctgttcagcctggccgcctacagctgcctgggcgcctacatcatcatgctgttcttcctgttcatcctgagcggcatggagcaggcctaccagctgctggcctggagaagcggcagagtggtgggcagcctggagaagaccagaaagctggtgctgagacccgccctggccgtgggcgtgaccgccgtgctgagcgtggccggcatcctgaacgccgcccagccccccgccgtgaagaccgtggaggtgcccatccaccagctgcccgccagcatgaacaacctgaagatcgtgctgctgagcgacatccacctgggccccaccgtgggcagaaccaagatggagatgttcgtgagaatggtgaacgtgctggagcccgacatcaccgtgatcgtgggcgacctgagcgacagcgaggccagcgtgctgagaaccgccgtggcccccctgggccagctgcacagccacctgggcgcctacttcgtgaccggcaaccacgagtactacaccagcgacgtgagcaactggttcgccctgctggagagcctgcacgtgcagcccctgcacaacgagaacgtgaagatcagcgccaccagagcccagagaggcggcggcggcagcggcagcggcagcgaggacgaggactggatctgcctggccggcgtggacgacatcgaggccgacatcctgcactacagcggccacggcatggacctggacaaggccctggagggctgcagccccgaccacaccatcatcctgctggcccaccagcccctggccgccaagagagccctgcaggccagacccgacatcaacctgatcctgagcggccacacccacgccggccagatcttccccctgaacgtggccgcctacctgctgaaccccttcttcgccggcctgtaccaggtggcccaggccaccttcgtgtacgtgagccccggcaccgcctactacggcatccccatgagactgggcagcagagccgagatcaccgagctgatcctgcagagaagcccctag

SEQ ID NO: 23660 - DNA, 951 bp, Artificial Sequence
  Description of Artificial Sequence: Synthetic coding sequence
atggagcaggcctaccagctgctggcctggagaagcggcagagtggtgggcagcctggagaagaccagaaagctggtgctgagacccgccctggccgtgggcgtgaccgccgtgctgagcgtggccggcatcctgaacgccgcccagccccccgccgtgaagaccgtggaggtgcccatccaccagctgcccgccagcatgaacaacctgaagatcgtgctgctgagcgacatccacctgggccccaccgtgggcagaaccaagatggagatgttcgtgagaatggtgaacgtgctggagcccgacatcaccgtgatcgtgggcgacctgagcgacagcgaggccagcgtgctgagaaccgccgtggcccccctgggccagctgcacagccacctgggcgcctacttcgtgaccggcaaccacgagtactacaccagcgacgtgagcaactggttcgccctgctggagagcctgcacgtgcagcccctgcacaacgagaacgtgaagatcagcgccaccagagcccagagaggcggcggcggcagcggcagcggcagcgaggacgaggactggatctgcctggccggcgtggacgacatcgaggccgacatcctgcactacagcggccacggcatggacctggacaaggccctggagggctgcagccccgaccacaccatcatcctgctggcccaccagcccctggccgccaagagagccctgcaggccagacccgacatcaacctgatcctgagcggccacacccacgccggccagatcttccccctgaacgtggccgcctacctgctgaaccccttcttcgccggcctgtaccaggtggcccaggccaccttcgtgtacgtgagccccggcaccgcctactacggcatccccatgagactgggcagcagagccgagatcaccgagctgatcctgcagagaagcccctag

SEQ ID NO: 23661 - DNA, 882 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagcagagtgagatactgggacctgctgctgctgatccccaacgtgctgttcctgatcttcctgctgtggaagctgcccagcgccagagccaagatcagaatcaccagcagccccatcttcatcaccttctacatcctggtgttcgtggtggccctggtgggcatcgccagagccgtggtgagcatgaccgtgagcaccagcaacgccgccaccgtggccgacaagatcctgtgggagatcaccagattcttcctgctggccatcgagctgagcgtgatcatcctgggcctggccttcggccacctggagagcaagagcagcatcaagagagtgctggccatcaccaccgtgctgagcctggcctacagcgtgacccagggcaccctggagatcctgtaccccgacgcccacctgagcgccgaggacttcaacatctacggccacggcggcagacagttctggctggtgagcagctgcttcttcttcctgctgtgcagatgccacaacctgcccgtgctgcagctgctgagaagcgcccacctgagaggcttcccccccggcctgctgagactgggcgcccaggaccccctgctgctgcagatgcccagcggcagagacagaggcgccagatgcacccccacccccgccctgagatgcggccccgccggcggccccggcggctgcagaggctgctggggcctgagctgccagctgctggagcacgccgtgagactgtgcagaagaggcggcctgcccggctag

SEQ ID NO: 23662 - DNA, 1122 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagcagagtgagatactgggacctgctgctgctgatccccaacgtgctgttcctgatcttcctgctgtggaagctgcccagcgccagagccaagatcagaatcaccagcagccccatcttcatcaccttctacatcctggtgttcgtggtggccctggtgggcatcgccagagccgtggtgagcatgaccgtgagcaccagcaacgccgccaccgtggccgacaagatcctgtgggagatcaccagattcttcctgctggccatcgagctgagcgtgatcatcctgggcctggccttcggccacctggagagcaagagcagcatcaagagagtgctggccatcaccaccgtgctgagcctggcctacagcgtgacccagggcaccctggagatcctgtaccccgacgcccacctgagcgccgaggacttcaacatctacggccacggcggcagacagttctggctggtgagcagctgcttcttcttcctggtgtacagcctggtggtgatcctgcccaagacccccctgaaggagagaatcagcctgcccagcagaagaagcttctacgtgtacgccggcatcctggccctgctgaacctgctgcagggcctgggcagcgtgctgctgtgcttcgacatcatcgagggcctgtgctgcgtggacgccaccaccttcctgtacttcagcttcttcgcccccctgatctacgtggccttcctgagaggcttcttcggcagcgagcccaagatcctgttcagctacaagtgccaggtggacgagaccgaggagcccgacgtgcacctgccccagccctacgccgtggccagaagagagggcctggaggccgccggcgccgccggcgccagcgccgccagctacagcagcacccagttcgacagcgccggcggcgtggcctacctggacgacatcgccagcatgccctgccacaccggcagcatcaacagcaccgacagcgagagatggaaggccatcaacgcctag

SEQ ID NO: 23663 - DNA, 1122 bp, Artificial Sequence; identical to SEQ ID NO: 23662
  Description of Artificial Sequence: Synthetic coding sequence

SEQ ID NO: 23664 - DNA, 126 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagctag

SEQ ID NO: 23665 - DNA, 612 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagcagagtgagatactgggacctgctgctgctgatccccaacgtgctgttcctgatcttcctgctgtggaagctgcccagcgccagagccaagatcagaatcaccagcagccccatcttcatcaccttctacatcctggtgttcgtggtggccctggtgggcatcgccagagccgtggtgagcatgaccgtgagcaccagcaacgccgccaccgtggccgacaagatcctgtgggagatcaccagattcttcctgctggccatcgagctgagcgtgatcatcctgggcctggccttcggccacctggagagcaagagcagcatcaagagagtgctggccatcaccaccgtgctgagcctggcctacagcgtgacccagggcaccctggagatcctgtaccccgacgcccacctgagcgccgaggacttcaacatctacggccacggcggcagacagttctggctggtgagcagctgcttcttcttcctgtag

SEQ ID NO: 23666 - DNA, 1122 bp, Artificial Sequence; identical to SEQ ID NO: 23662
  Description of Artificial Sequence: Synthetic coding sequence

SEQ ID NO: 23667 - DNA, 615 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagcagagtgagatactgggacctgctgctgctgatccccaacgtgctgttcctgatcttcctgctgtggaagctgcccagcgccagagccaagatcagaatcaccagcagccccatcttcatcaccttctacatcctggtgttcgtggtggccctggtgggcatcgccagagccgtggtgagcatgaccgtgagcaccagcaacgccgccaccgtggccgacaagatcctgtgggagatcaccagattcttcctgctggccatcgagctgagcgtgatcatcctgggcctggccttcggccacctggagagcaagagcagcatcaagagagtgctggccatcaccaccgtgctgagcctggcctacagcgtgacccagggcaccctggagatcctgtaccccgacgcccacctgagcgccgaggacttcaacatctacggccacggcggcagacagttctggctggtgagcagctgcttcttcttcctggtgtag

SEQ ID NO: 23668 - DNA, 501 bp, Artificial Sequence
  Description of Artificial Sequence: Synthetic coding sequence
atggacaccctggaggaggtgacctgggccaacggcagcaccgccctgcccccccccctggcccccaacatcagcgtgccccacagatgcctgctgctgctgtacgaggacatcggcaccagcagagtgagatactgggacctgctgctgctgatccccaacgtgctgttcctgatcttcctgctgtggaagctgcccagcgccagagccaagatcagaatcaccagcagccccatcttcatcaccttctacatcctggtgttcgtggtggccctggtgggcatcgccagagccgtggtgagcatgaccgtgagcaccagcaacgccgccaccgtggccgacaagatcctgtgggagatcaccagattcttcctgctggccatcgagctgagcgtgatcatcctgggcctggccttcggccacctggagagcaagagcagcatcaagagagtgctggccatcaccaccgtgctgagcctggcctacagcgtgacccagtag

SEQ ID NO: 23669 - DNA, 390 bp, Artificial Sequence
  Description of Artificial Sequence: Synthetic coding sequence
tgaagcgaggtgcccctgccccccggcgccctggccaccctgagcagcagctgcagcctgggcgtggccctgcacagaagcagccccgccagcagaggccccggcgagagcagcctgcccgccttcagcggcgtggccctgctgccccccgcctgcaaggccggcctgccctacaacctgagcagacaggagggccacctgacctgcctgagcatccccgacatcaagaccgccttcagcgactgcaccagcaagatcggcagaagagactgcctgacccaggcctgcagcgccctgaccggcaagggcgtgagagagggcatcgagtggatggtgaagtgcgtggtgagaaacgtgcacagaccccccagacagagagacatcacctag

SEQ ID NO: 23670 - DNA, 1158 bp, Artificial Sequence
  Description of Artificial Sequence: Synthetic coding sequence
atggtgctgatgcacctggccgtgaagaacaacagaatgagcgccaacaacgaccacttcctgacccccacctggcagcagatgagagccacccccctggccgcccccgccggcagcctgagcagaaagaagagactggagctggacgacaacctggacaccgagagacccgtgcagaagagagccagaagcggcccccagcccagactgcccccctgcctgctgcccctgagcccccccaccgcccccgacagagccaccgccgtggccaccgccagcagactgggcccctacgtgctgctggagcccgaggagggcggcagagcctaccaggccctgcactgccccaccggcaccgagtacacctgcaaggtgtaccccgtgcaggaggccctggccgtgctggagccctacgccagactgcccccccacaagcacgtggccagacccaccgaggtgctggccggcacccagctgctgtacgccttcttcaccagaacccacggcgacatgcacagcctggtgagaagcagacacagaatccccgagcccgaggccgccgtgctgttcagacagatggccaccgccctggcccactgccaccagcacggcctggtgctgagagacctgaagctgtgcagattcgtgttcgccgacagagagagaaagaagctggtgctggagaacctggaggacagctgcgtgctgaccggccccgacgacagcctgtgggacaagcacgcctgccccgcctacgtgggccccgagatcctgagcagcagagccagctacagcggcaaggccgccgacgtgtggagcctgggcgtggccctgttcaccatgctggccggccactaccccttccaggacagcgagcccgtgctgctgttcggcaagatcagaagaggcgcctacgccctgcccgccggcctgagcgcccccgccagatgcctggtgagatgcctgctgagaagagagcccgccgagagactgaccgccaccggcatcctgctgcacccctggctgagacaggaccccatgcccctggcccccaccagaagccacctgtgggaggccgcccaggtggtgcccgacggcctgggcctggacgaggccagagaggaggagggcgacagagaggtggtgctgtacggctag

SEQ ID NO: 23671 - DNA, 816 bp, Artificial Sequence
  Description of Artificial Sequence: Synthetic coding sequence
atgagagccacccccctggccgcccccgccggcagcctgagcagaaagaagagactggagctggacgacaacctggacaccgagagacccgtgcagaagagagccagaagcggcccccagcccagactgcccccctgcctgctgcccctgagcccccccaccgcccccgacagagccaccgccgtggccaccgccagcagactgggcccctacgtgctgctggagcccgaggagggcggcagagcctaccaggccctgcactgccccaccggcaccgagtacacctgcaaggtgtaccccgtgcaggaggccctggccgtgctggagccctacgccagactgcccccccacaagcacgtggccagacccaccgaggtgctggccggcacccagctgctgtacgccttcttcaccagaacccacggcgacatgcacagcctggtgagaagcagacacagaatccccgagcccgaggccgccgtgctgttcagacagatggccaccgccctggcccactgccaccagcacggcctggtgctgagagacctgaagctgtgcagattcgtgttcgccgacagagagagaaagaagctggtgctggagaacctggaggacagctgcgtgctgaccggccccgacgacagcctgtgggacaagcacgcctgccccgcctacgtgggccccgagatcctgagcagcagagccagctacagcggcaaggccgccgacgtgtggagcctgggcgtggccctgttcaccatgctggccggccactaccccttccaggacagcgagcccgtgctgctgttcggctag

SEQ ID NO: 23672 - DNA, 1188 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaagctgtgcttcgagctggactacgagcccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtgtggatggccagagtgcccggcgacagcggctgctgccagttctgcagcccccccagcgtgctgggcaccgaggtggccgcctag

SEQ ID NO: 23673 - DNA, 1446 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaagctgtgcttcgagctggactacgagcccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtggtgagcatcgacctggcccacggcggcagctgcaccgtgggcgtggtgagcgaggacgtgcagagaaagggcgagctgagactgagacccgaggagggcgtgtgggccgtgagactggcctggggcttcgtgagcgccctgggcagcttccccaccagactgaccctgaaggagcagcccagacaggtgagagtgagcctggactacgaggtgggctgggtgaccttcaccaacgccgtgaccagagagcccatctacaccttcaccgccagcttcaccagaaaggtgatccccttcttcggcctgtggggcagaggcagcagcttcagcctgagcagctag

SEQ ID NO: 23674 - DNA, 1446 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaacctgcccaaccacctggtgatccccaccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtggtgagcatcgacctggcccacggcggcagctgcaccgtgggcgtggtgagcgaggacgtgcagagaaagggcgagctgagactgagacccgaggagggcgtgtgggccgtgagactggcctggggcttcgtgagcgccctgggcagcttccccaccagactgaccctgaaggagcagcccagacaggtgagagtgagcctggactacgaggtgggctgggtgaccttcaccaacgccgtgaccagagagcccatctacaccttcaccgccagcttcaccagaaaggtgatccccttcttcggcctgtggggcagaggcagcagcttcagcctgagcagctag

SEQ ID NO: 23675 - DNA, 1695 bp, Artificial Sequence
  Description of Artificial Sequence: Synthetic coding sequence
atggccgagctggacctgatggcccccggccccctgcccagagccaccgcccagccccccgcccccctgagccccgacagcggcagccccagccccgacagcggcagcgccagccccgtggaggaggaggacgtgggcagcagcgagaagctgggcagagagaccgaggagcaggacagcgacagcgccgagcagggcgaccccgccggcgagggcaaggaggtgctgtgcgacttctgcctggacgacaccagaagagtgaaggccgtgaagagctgcctgacctgcatggtgaactactgcgaggagcacctgcagccccaccaggtgaacatcaagctgcagagccacctgctgaccgagcccgtgaaggaccacaactggagatactgccccgcccaccacagccccctgagcgccttctgctgccccgaccagcagtgcatctgccaggactgctgccaggagcacagcggccacaccatcgtgagcctggacgccgccagaagagacaaggaggccgagctgcagtgcacccagctggacctggagagaaagctgaagctgaacgagaacgccatcagcagactgcaggccaaccagaagagcgtgctggtgagcgtgagcgaggtgaaggccgtggccgagatgcagttcggcgagctgctggccgccgtgagaaaggcccaggccaacgtgatgctgttcctggaggagaaggagcaggccgccctgagccaggccaacggcatcaaggcccacctggagtacagaagcgccgagatggagaagagcaagcaggagctggagagaatggccgccatcagcaacaccgtgcagttcctggaggagtactgcaagttcaagaacaccgaggacatcaccttccccagcgtgtacgtgggcctgaaggacaagctgagcggcatcagaaaggtgatcaccgagagcaccgtgcacctgatccagctgctggagaactacaagaagaagctgcaggagttcagcaaggaggaggagtacgacatcagaacccaggtgagcgccgtggtgcagagaaagtactggaccagcaagcccgagcccagcaccagagagcagttcctgcagtacgcctacgacatcaccttcgaccccgacaccgcccacaagtacctgagactgcaggaggagaacagaaaggtgaccaacaccaccccctgggagcacccctaccccgacctgcccagcagattcctgcactggagacaggtgctgagccagcagagcctgtacctgcacagatactacttcgaggtggagatcttcggcgccggcacctacgtgggcctgacctgcaagggcatcgacagaaagggcgaggagagaaacagctgcatcagcggcaacaacttcagctggagcctgcagtggaacggcaaggagttcaccgcctggtacagcgacatggagacccccctgaaggccggccccttcagaagactgggcgtgtacatcgacttccccggcggcatcctgagcttctacggcgtggagtacgacaccatgaccctggtgcacaagttcgcctgcaagttcagcgagcccgtgtacgccgccttctggctgagcaagaaggagaacgccatcagaatcgtggacctgggcgaggagcccgagaagcccgcccccagcctggtgggcaccgccccctag

SEQ ID NO: 23676 - DNA, 1695 bp, Artificial Sequence; identical to SEQ ID NO: 23675
  Description of Artificial Sequence: Synthetic coding sequence

SEQ ID NO: 23677 - DNA, 1425 bp, Artificial Sequence
  Description of Artificial Sequence: Synthetic coding sequence
atggaggccgaggacatccaggaggagctgacctgccccatctgcctggactacttccaggaccccgtgagcatcgagtgcggccacaacttctgcagaggctgcctgcacagaaactgggcccccggcggcggccccttcccctgccccgagtgcagacaccccagcgcccccgccgccctgagacccaactgggccctggccagactgaccgagaagacccagagaagaagactgggccccgtgccccccggcctgtgcggcagacactgggagcccctgagactgttctgcgaggacgaccagagacccgtgtgcctggtgtgcagagagagccaggagcaccagacccacgccatggcccccatcgacgaggccttcgagagctacagagagaagctgctgaagagccagagaaacctggtggccaagatgaagaaggtgatgcacctgcaggacgtggaggtgaagaacgccacccagtggaaggacaagatcaagagccagagaatgagaatcagcaccgagttcagcaagctgcacaacttcctggtggaggaggaggacctgttcctgcagagactgaacaaggaggaggaggagaccaagaagaagctgaacgagaacaccctgaagctgaaccagaccatcgccagcctgaagaagctgatcctggaggtgggcgagaagagccaggcccccaccctggagctgctgcagaaccccaaggaggtgctgaccagaagcgagatccaggacgtgaactacagcctggaggccgtgaaggtgaagaccgtgtgccagatccccctgatgaaggagatgctgaagagattccaggtggccgtgaacctggccgaggacaccgcccaccccaagctggtgttcagccaggagggcagatacgtgaagaacaccgccagcgccagcagctggcccgtgttcagcagcgcctggaactacttcgccggctggagaaacccccagaagaccgccttcgtggagagattccagcacctgccctgcgtgctgggcaagaacgtgttcaccagcggcaagcactactgggaggtggagagcagagacagcctggaggtggccgtgggcgtgtgcagagaggacgtgatgggcatcaccgacagaagcaagatgagccccgacgtgggcatctgggccatctactggagcgccgccggctactggcccctgatcggcttccccggcacccccacccagcaggagcccgccctgcacagagtgggcgtgtacctggacagaggcaccggcaacgtgagcttctacagcgccgtggacggcgtgcacctgcacaccttcagctgcagcagcgtgagcagactgagacccttcttctggctgagccccctggccagcctggtgatcccccccgtgaccgacagaaagtag

SEQ ID NO: 23678 - DNA, 885 bp, Artificial Sequence
  Description of Artificial Sequence: Synthetic coding sequence
atggaggccgaggacatccaggaggagctgacctgccccatctgcctggactacttccaggaccccgtgagcatcgagtgcggccacaacttctgcagaggctgcctgcacagaaactgggcccccggcggcggccccttcccctgccccgagtgcagacaccccagcgcccccgccgccctgagacccaactgggccctggccagactgaccgagaagacccagagaagaagactgggccccgtgccccccggcctgtgcggcagacactgggagcccctgagactgttctgcgaggacgaccagagacccgtgtgcctggtgtgcagagagagccaggagcaccagacccacgccatggcccccatcgacgaggccttcgagagctacagagagaagctgctgaagagccagagaaacctggtggccaagatgaagaaggtgatgcacctgcaggacgtggaggtgaagaacgccacccagtggaaggacaagatcaagagccagagaatgagaatcagcaccgagttcagcaagctgcacaacttcctggtggaggaggaggacctgttcctgcagagactgaacaaggaggaggaggagaccaagaagaagctgaacgagaacaccctgaagctgaaccagaccatcgccagcctgaagaagctgatcctggaggtgggcgagaagagccaggcccccaccctggagctgctgcagaaccccaaggaggtgctgaccagaagcgagatccaggacgtgaactacagcctggaggccgtgaaggtgaagaccgtgtgccagatccccctgatgaaggagatgctgaagagattccaggccaccaagatcaagacccagaagcagaacagacacaacatgtag

SEQ ID NO: 23679 - DNA, 1503 bp, Artificial Sequence
  Description of Artificial Sequence: Synthetic coding sequence
atggaggccgaggacatccaggaggagctgacctgccccatctgcctggactacttccaggaccccgtgagcatcgagtgcggccacaacttctgcagaggctgcctgcacagaaactgggcccccggcggcggccccttcccctgccccgagtgcagacaccccagcgcccccgccgccctgagacccaactgggccctggccagactgaccgagaagacccagagaagaagactgggccccgtgccccccggcctgtgcggcagacactgggagcccctgagactgttctgcgaggacgaccagagacccgtgtgcctggtgtgcagagagagccaggagcaccagacccacgccatggcccccatcgacgaggccttcgagagctacagaaccggcaacttcgacatccacgtggacgagtggaagagaagactgatcagactgctgctgtaccacttcaagcaggaggagaagctgctgaagagccagagaaacctggtggccaagatgaagaaggtgatgcacctgcaggacgtggaggtgaagaacgccacccagtggaaggacaagatcaagagccagagaatgagaatcagcaccgagttcagcaagctgcacaacttcctggtggaggaggaggacctgttcctgcagagactgaacaaggaggaggaggagaccaagaagaagctgaacgagaacaccctgaagctgaaccagaccatcgccagcctgaagaagctgatcctggaggtgggcgagaagagccaggcccccaccctggagctgctgcagaaccccaaggaggtgctgaccagaagcgagatccaggacgtgaactacagcctggaggccgtgaaggtgaagaccgtgtgccagatccccctgatgaaggagatgctgaagagattccaggtggccgtgaacctggccgaggacaccgcccaccccaagctggtgttcagccaggagggcagatacgtgaagaacaccgccagcgccagcagctggcccgtgttcagcagcgcctggaactacttcgccggctggagaaacccccagaagaccgccttcgtggagagattccagcacctgccctgcgtgctgggcaagaacgtgttcaccagcggcaagcactactgggaggtggagagcagagacagcctggaggtggccgtgggcgtgtgcagagaggacgtgatgggcatcaccgacagaagcaagatgagccccgacgtgggcatctgggccatctactggagcgccgccggctactggcccctgatcggcttccccggcacccccacccagcaggagcccgccctgcacagagtgggcgtgtacctggacagaggcaccggcaacgtgagcttctacagcgccgtggacggcgtgcacctgcacaccttcagctgcagcagcgtgagcagactgagacccttcttctggctgagccccctggccagcctggtgatcccccccgtgaccgacagaaagtag

SEQ ID NO: 23680 - DNA, 993 bp, Artificial Sequence
  Description of Artificial Sequence: Synthetic coding sequence
atgaagaaggtgatgcacctgcaggacgtggaggtgaagaacgccacccagtggaaggacaagatcaagagccagagaatgagaatcagcaccgagttcagcaagctgcacaacttcctggtggaggaggaggacctgttcctgcagagactgaacaaggaggaggaggagaccaagaagaagctgaacgagaacaccctgaagctgaaccagaccatcgccagcctgaagaagctgatcctggaggtgggcgagaagagccaggcccccaccctggagctgctgcagaaccccaaggaggtgctgaccagaagcgagatccaggacgtgaactacagcctggaggccgtgaaggtgaagaccgtgtgccagatccccctgatgaaggagatgctgaagagattccaggtggccgtgaacctggccgaggacaccgcccaccccaagctggtgttcagccaggagggcagatacgtgaagaacaccgccagcgccagcagctggcccgtgttcagcagcgcctggaactacttcgccggctggagaaacccccagaagaccgccttcgtggagagattccagcacctgccctgcgtgctgggcaagaacgtgttcaccagcggcaagcactactgggaggtggagagcagagacagcctggaggtggccgtgggcgtgtgcagagaggacgtgatgggcatcaccgacagaagcaagatgagccccgacgtgggcatctgggccatctactggagcgccgccggctactggcccctgatcggcttccccggcacccccacccagcaggagcccgccctgcacagagtgggcgtgtacctggacagaggcaccggcaacgtgagcttctacagcgccgtggacggcgtgcacctgcacaccttcagctgcagcagcgtgagcagactgagacccttcttctggctgagccccctggccagcctggtgatcccccccgtgaccgacagaaagtag

SEQ ID NO: 23681 - DNA, 1212 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctggacaagaagctggtgtgcggccactgcctgaccatcggccagcaccacggccaccccatcgacgacctgcagagcgcctacctgaaggagaaggacaccccccagaagctgctggagcagctgaccgacacccactggaccgacctgacccacctgatcgagaagctgaaggagcagaagagccacagcgagaagatgatccagggcgacaaggaggccgtgctgcagtacttcaaggagctgaacgacaccctggagcagaagaagaagagcttcctgaccgccctgtgcgacgtgggcaacctgatcaaccaggagtacaccccccagatcgagagaatgaaggagatcagagagcagcagctggagctgatggccctgaccatcagcctgcaggaggagagccccctgaagttcctggagaaggtggacgacgtgagacagcacgtgcagatcctgaagcagagacccctgcccgaggtgcagcccgtggagatctaccccagagtgagcaagatcctgaaggaggagtggagcagaaccgagatcggccagatcaagaacgtgctgatccccaagatgaagatcagccccaagagaatgagctgcagctggcccggcaaggacgagaaggaggtggagttcctgaagatcctgaacatcgtggtggtgaccctgatcagcgtgatcctgatgagcatcctgttcttcaaccagcacatcatcaccttcctgagcgagatcaccctgatctggttcagcgaggccagcctgagcgtgtaccagagcctgagcaacagcctgcacaaggtgaagaacatcctgtgccacatcttctacctgctgaaggagttcgtgtggaagatcgtgagccactag

SEQ ID NO: 23682 - DNA, 345 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctggacaagaagtag

SEQ ID NO: 23683 - DNA, 468 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctggacaagaagctggtgtgcggccactgcctgaccatcggccagcaccacggccaccccatcgacgacctgcagagcgcctacctgaaggagaaggacaccccccagaagctgctggagcagctgaccgacacctag

SEQ ID NO: 23684 - DNA, 534 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctggacaagaagctggtgtgcggccactgcctgaccatcggccagcaccacggccaccccatcgacgacctgcagagcgcctacctgaaggagaaggacaccccccagaagctgctggagcagctgaccgacacccactggaccgacctgacccacctgatcgagaagctgaaggagcagaagagccacagcgagaagatgtag

SEQ ID NO: 23685 - DNA, 336 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctgtag

SEQ ID NO: 23686 - DNA, 972 bp, Artificial Sequence
  Description of Artificial Sequence: Synthetic coding sequence
atgcacaacttcgaggaggagctgacctgccccatctgctacagcatcttcgaggaccccagagtgctgccctgcagccacaccttctgcagaaactgcctggagaacatcctgcaggccagcggcaacttctacatctggagacccctgagaatccccctgaagtgccccaactgcagaagcatcaccgagatcgcccccaccggcatcgagagcctgcccgtgaacttcgccctgagagccatcatcgagaagtaccagcaggaggaccaccccgacatcgtgacctgccccgagcactacagacagcccctgaacgtgtactgcctgctggacaagaagctggtgtgcggccactgcctgaccatcggccagcaccacggccaccccatcgacgacctgcagagcgcctacctgaaggagaaggacaccccccagaagctgctggagcagctgaccgacacccactggaccgacctgacccacctgatcgagaagctgaaggagcagaagagccacagcgagaagatgatccagggcgacaaggaggccgtgctgcagtacttcaaggagctgaacgacaccctggagcagaagaagaagagcttcctgaccgccctgtgcgacgtgggcaacctgatcaaccaggagtacaccccccagatcgagagaatgaaggagatcagagagcagcagctggagctgatggccctgaccatcagcctgcaggaggagagccccctgaagttcctggagaaggtggacgacgtgagacagcacgtgcagatcctgaagcagagacccctgcccgaggtgcagcccgtggagatctaccccagagtgagcaagatcctgaaggaggagtggagcagaaccgagatcggccagatcaagaacgtgctgatccccaagatgaagatcagccccaagagaatgagctgcagctggcccgacgagggcaccgacaagtag

SEQ ID NO: 23687 - DNA, 1380 bp, Artificial Sequence
  Description of Artificial Sequence: Synthetic coding sequence
atggccggcctgaagagaagagtgcccctgcacagcctgagatacttcatcagcatggtgggcctgttcagcaagcccggcctgctgccctggtacgccagaaacccccccggctggagccagctgttcctgggcaccgtgtgcaagggcgacttcaccagagtgatcgccaccaagtgccagaagggccagaagagccagaagaagcccagccacctgggccccctggacggcagctggcaggagagactggccgacgtggtgacccccctgtggagactgagctacgaggagcagctgaagcccgtgatcaacggctacagaaacaagagcaccttcagcgtgaacagaggccccgacggcaaccccaagaccgtgggcttctacctgggcacctggagagacggcaacgtggtgtgcgtgcagagcaaccacctgaagaacatccccgagaagcacagccaggtggcccagtactacgaggtgttcctgagacagagccccctggagccctgcctggtgttccacgagggcggctactggagagagctgaccgtgagaaccaacagccagggccacaccatggccatcatcaccttccacccccagaagctgagccaggaggagctgcacgtgcagaaggagatcgtgaaggagttcttcatcagaggccccggcgccgcctgcggcctgaccagcctgtacttccaggagagcaccatgaccagatgcagccaccagcagagcccctaccagctgctgttcggcgagccctacatcttcgaggagctgctgagcctgaagatcagaatcagccccgacgccttcttccagatcaacaccgccggcgccgagatgctgtacagaaccgtgggcgagctgaccggcgtgaacagcgacaccatcctgctggacatctgctgcggcaccggcgtgatcggcctgagcctggcccagcacaccagcagagtgctgggcatcgagctgctggagcaggccgtggaggacgccagatggaccgccgccttcaacggcatcaccaacagcgagttccacaccggccaggccgagaagatcctgcccggcctgctgaagagcaaggaggacggccagagcatcgtggccgtggtgaaccccgccagagccggcctgcactacaaggtgatccaggccatcagaaacttcagagccatccacaccctggtgttcgtgagctgcaagctgcacggcgagagcaccagaaacgtgatcgagctgtgctgcccccccgaccccgccaagaagctgctgggcgagcccttcgtgctgcagcaggccgtgcccgtggacctgttcccccacaccccccactgcgagctggtgctgctgttcaccagatag

SEQ ID NO: 23688 - DNA, 1485 bp, Artificial Sequence
  Description of Artificial Sequence: Synthetic coding sequence
atggccggcctgaagagaagagtgcccctgcacagcctgagatacttcatcagcatggtgggcctgttcagcaagcccggcctgctgccctggtacgccagaaacccccccggctggagccagctgttcctgggcaccgtgtgcaagggcgacttcaccagagtgatcgccaccaagtgccagaagggccagaagagccagaagaagcccagccacctgggccccctggacggcagctggcaggagagactggccgacgtggtgacccccctgtggagactgagctacgaggagcagctgaaggtgaagttcgccgcccagaagaagatcctgcagagactggagagctacatccagatgctgaacggcgtgagcgtgaccaccgccgtgcccaagagcgagagactgagctgcctgctgcaccccatcatccccagccccgtgatcaacggctacagaaacaagagcaccttcagcgtgaacagaggccccgacggcaaccccaagaccgtgggcttctacctgggcacctggagagacggcaacgtggtgtgcgtgcagagcaaccacctgaagaacatccccgagaagcacagccaggtggcccagtactacgaggtgttcctgagacagagccccctggagccctgcctggtgttccacgagggcggctactggagagagctgaccgtgagaaccaacagccagggccacaccatggccatcatcaccttccacccccagaagctgagccaggaggagctgcacgtgcagaaggagatcgtgaaggagttcttcatcagaggccccggcgccgcctgcggcctgaccagcctgtacttccaggagagcaccatgaccagatgcagccaccagcagagcccctaccagctgctgttcggcgagccctacatcttcgaggagctgctgagcctgaagatcagaatcagccccgacgccttcttccagatcaacaccgccggcgccgagatgctgtacagaaccgtgggcgagctgaccggcgtgaacagcgacaccatcctgctggacatctgctgcggcaccggcgtgatcggcctgagcctggcccagcacaccagcagagtgctgggcatcgagctgctggagcaggccgtggaggacgccagatggaccgccgccttcaacggcatcaccaacagcgagttccacaccggccaggccgagaagatcctgcccggcctgctgaagagcaaggaggacggccagagcatcgtggccgtggtgaaccccgccagagccggcctgcactacaaggtgatccaggccatcagaaacttcagagccatccacaccctggtgttcgtgagctgcaagctgcacggcgagagcaccagaaacgtgatcgagagaagcctgatcctgctggagtgcagcggcatggtgagcgcccactacagcctgcacctgcccggcagcagcgacagccccgccagcgccagctag

SEQ ID NO: 23689 - DNA, 1515 bp, Artificial Sequence
  Description of Artificial Sequence: Synthetic coding sequence
atggccggcctgaagagaagagtgcccctgcacagcctgagatacttcatcagcatggtgggcctgttcagcaagcccggcctgctgccctggtacgccagaaacccccccggctggagccagctgttcctgggcaccgtgtgcaagggcgacttcaccagagtgatcgccaccaagtgccagaagggccagaagagccagaagaagcccagccacctgggccccctggacggcagctggcaggagagactggccgacgtggtgacccccctgtggagactgagctacgaggagcagctgaaggtgaagttcgccgcccagaagaagatcctgcagagactggagagctacatccagatgctgaacggcgtgagcgtgaccaccgccgtgcccaagagcgagagactgagctgcctgctgcaccccatcatccccagccccgtgatcaacggctacagaaacaagagcaccttcagcgtgaacagaggccccgacggcaaccccaagaccgtgggcttctacctgggcacctggagagacggcaacgtggtgtgcgtgcagagcaaccacctgaagaacatccccgagaagcacagccaggtggcccagtactacgaggtgttcctgagacagagccccctggagccctgcctggtgttccacgagggcggctactggagagagctgaccgtgagaaccaacagccagggccacaccatggccatcatcaccttccacccccagaagctgagccaggaggagctgcacgtgcagaaggagatcgtgaaggagttcttcatcagaggccccggcgccgcctgcggcctgaccagcctgtacttccaggagagcaccatgaccagatgcagccaccagcagagcccctaccagctgctgttcggcgagccctacatcttcgaggagctgctgagcctgaagatcagaatcagccccgacgccttcttccagatcaacaccgccggcgccgagatgctgtacagaaccgtgggcgagctgaccggcgtgaacagcgacaccatcctgctggacatctgctgcggcaccggcgtgatcggcctgagcctggcccagcacaccagcagagtgctgggcatcgagctgctggagcaggccgtggaggacgccagatggaccgccgccttcaacggcatcaccaacagcgagttccacaccggccaggccgagaagatcctgcccggcctgctgaagagcaaggaggacggccagagcatcgtggccgtggtgaaccccgccagagccggcctgcactacaaggtgatccaggccatcagaaacttcagagccatccacaccctggtgttcgtgagctgcaagctgcacggcgagagcaccagaaacgtgatcgagctgtgctgcccccccgaccccgccaagaagctgctgggcgagcccttcgtgctgcagcaggccgtgcccgtggacctgttcccccacaccccccactgcgagctggtgctgctgttcaccagatag

SEQ ID NO: 23690 - DNA, 1515 bp, Artificial Sequence; identical to SEQ ID NO: 23689
  Description of Artificial Sequence: Synthetic coding sequence

SEQ ID NO: 23691 - DNA, 1380 bp, Artificial Sequence; identical to SEQ ID NO: 23687
  Description of Artificial Sequence: Synthetic coding sequence

SEQ ID NO: 23692 - DNA, 1515 bp, Artificial Sequence; identical to SEQ ID NO: 23689
  Description of Artificial Sequence: Synthetic coding sequence

SEQ ID NO: 23693 - DNA, 1542 bp, Artificial Sequence
  Description of Artificial Sequence: Synthetic coding sequence
atgagctacggcagcatcgccagaggcggcggcctgggcagcagaggccccttcggcggccccagcagacagggctgccagcccctggagtgcgccagatgctggaccgagtacggcatcagacacttcccctgccccagccccgagagcaagctgcagaacagatgcgtgggcaaggacggcgagggcgacctgggccccgccggcacccccatcgtgcccagagccagaaagagaggccccggcgtggcccccgagggcagcagaatgcccgagcccaccagcagccccaccatcggccccagaaaggacagcgccgccggcccccacggcagaatggccggccccagcaccaccagagccaagaagagaaagcccaacttctgcccccaggagaccgaggtgctggtgagcaaggtgagcaagcaccaccagctgctgttcggcaccggcctgctgaaggccgagcccaccagaagatacagagtgtggagcagaatcctgcaggccgtgaacgccctgggctactgcagaagagacgtggtggacctgaagcacaagtggagagacctgagagccgtggtgagaagaaagctgggcgacctgagaaaggccgcccacggccccagccccggcagcggcaagccccaggccctggccctgacccccgtggagcaggtggtggccaagaccttcagctgccaggccctgcccagcgagggcttcagcctggagccccccagagccacccaggtggacccctgcaacctgcaggagctgttccaggagatgagcgccaacgtgttcagaatcaacagcagcgtgaccagcctggagagaagcctgcagagcctgggcacccccagcgacacccaggagctgagagacagcctgcacaccgcccagcaggagaccaacaagaccatcgccgccagcgccagcagcgtgaagcagatggccgagctgctgagaagcagctgcccccaggagagactgcagcaggagagaccccagctggacagactgaagacccagctgagcgacgccatccagtgctacggcgtggtgcagaagaagatcgccgagaagagcagagccctgctgcccatggcccagagaggcagcaagcagagcccccaggcccccttcgccgagctggccgacgacgagaaggtgttcaacggcagcgacaacatgtggcagggccaggagcaggccctgctgcccgacatcaccgaggaggacctggaggccatcagactgagagaggaggccatcctgcagatggagagcaacctgctggacgtgaaccagatcatcaaggacctggccagcatggtgagcgagcagggcgaggccgtggacagcatcgaggccagcctggaggccgccagcagccacgccgaggccgccagacagctgctggccggcgccagcagacaccagctgcagagacacaagatcaagtgctgcttcctgagcgccggcgtgaccgccctgctggtgatcatcatcatcatcgccaccagcgtgagaaagtag

SEQ ID NO: 23694 - DNA, 834 bp, Artificial Sequence
  Description of Artificial Sequence: Synthetic coding sequence
atgagctacggcagcatcgccagaggcggcggcctgggcagcagaggccccttcggcggccccagcagacagggctgccagcccctggccacccaggtggacccctgcaacctgcaggagctgttccaggagatgagcgccaacgtgttcagaatcaacagcagcgtgaccagcctggagagaagcctgcagagcctgggcacccccagcgacacccaggagctgagagacagcctgcacaccgcccagcaggagaccaacaagaccatcgccgccagcgccagcagcgtgaagcagatggccgagctgctgagaagcagctgccccgagagactgcagcaggagagaccccagctggacagactgaagacccagctgagcgacgccatccagtgctacggcgtggtgcagaagaagatcgccgagaagagcagagccctgctgcccatggcccagagaggcagcaagcagcagagcccccaggcccccttcgccgagctggccgacgacgagaaggtgttcaacggcagcgacaacatgtggcagggccaggagcaggccctgctgcccgacatcaccgaggaggacctggaggccatcagactgagagaggaggccatcctgcagatggagagcaacctgctggacgtgaaccagatcatcaaggacctggccagcatggtgagcgagcagggcgaggccgtggacagcatcgaggccagcctggaggccgccagcagccacgccgaggccgccagacagctgctggccggcgccagcagacaccagctgatgagaagaaccagaccccccgccgcctgcggctgcccctag

SEQ ID NO: 23695 - DNA, 1542 bp, Artificial Sequence
  Description of Artificial Sequence: Synthetic coding sequence
atgagctacggcagcatcgccagaggcggcggcctgggcagcagaggccccttcggcggccccagcagacagggctgccagcccctggagtgcgccagatgctggaccgagtacggcatcagacacttcccctgccccagccccgagagcaagctgcagaacagatgcgtgggcaaggacggcgagggcgacctgggccccgccggcacccccatcgtgcccagagccagaaagagaggccccggcgtggcccccgagggcagcagaatgcccgagcccaccagcagccccaccatcggccccagaaaggacagcgccgccggcccccacggcagaatggccggccccagcaccaccagagccaagaagagaaagcccaacttctgcccccaggagaccgaggtgctggtgagcaaggtgagcaagcaccaccagctgctgttcggcaccggcctgctgaaggccgagcccaccagaagatacagagtgtggagcagaatcctgcaggccgtgaacgccctgggctactgcagaagagacgtggtggacctgaagcacaagtggagagacctgagagccgtggtgagaagaaagctgggcgacctgagaaaggccgcccacggccccagccccggcagcggcaagccccaggccctggccctgacccccgtggagcaggtggtggccaagaccttcagctgccaggccctgcccagcgagggcttcagcctggagccccccagagccacccaggtggacccctgcaacctgcaggagctgttccaggagatgagcgccaacgtgttcagaatcaacagcagcgtgaccagcctggagagaagcctgcagagcctgggcacccccagcgacacccaggagctgagagacagcctgcacaccgcccagcaggagaccaacaagaccatcgccgccagcgccagcagcgtgaagcagatggccgagctgctgagaagcagctgccccgagagactgcagcaggagagaccccagctggacagactgaagacccagctgagcgacgccatccagtgctacggcgtggtgcagaagaagatcgccgagaagagcagagccctgctgcccatggcccagagaggcagcaagcagcagagcccccaggcccccttcgccgagctggccgacgacgagaaggtgttcaacggcagcgacaacatgtggcagggccaggagcaggccctgctgcccgacatcaccgaggaggacctggaggccatcagactgagagaggaggccatcctgcagatggagagcaacctgctggacgtgaaccagatcatcaaggacctggccagcatggtgagcgagcagggcgaggccgtggacagcatcgaggccagcctggaggccgccagcagccacgccgaggccgccagacagctgctggccggcgccagcagacaccagctgcagagacacaagatcaagtgctgcttcctgagcgccggcgtgaccgccctgctggtgatcatcatcatcatcgccaccagcgtgagaaagtag

SEQ ID NO: 23696 - DNA, 453 bp, Artificial Sequence
  Description of Artificial Sequence: Synthetic coding sequence
atgagctacggcagcatcgccagaggcggcggcctgggcagcagaggccccttcggcggccccagcagacagggctgccagcccctggagtgcgccagatgctggaccgagtacggcatcagacacttcccctgccccagccccgagagcaagctgcagaacagatgcgtgggcaaggacggcgagggcgacctgggccccgccggcacccccatcgtgcccagagccagaaagagaggccccggcgtggcccccgagggcagcagaatgcccgagcccaccagcagccccaccatcggccccagaaaggacagcgccgccggcccccacggcagaatggccggccccagcaccaccagagccaagaagagaaagcccaacttctgcccccaggagaccgaggtgctggtgagcaaggtgagcaagcaccaccagctgctgttcggcacctag

SEQ ID NO: 23697 - DNA, 1539 bp, Artificial Sequence
  Description of Artificial Sequence: Synthetic coding sequence
atgagctacggcagcatcgccagaggcggcggcctgggcagcagaggccccttcggcggccccagcagacagggctgccagcccctggagtgcgccagatgctggaccgagtacggcatcagacacttcccctgccccagccccgagagcaagctgcagaacagatgcgtgggcaaggacggcgagggcgacctgggccccgccggcacccccatcgtgcccagagccagaaagagaggccccggcgtggcccccgagggcagcagaatgcccgagcccaccagcagccccaccatcggccccagaaaggacagcgccgccggcccccacggcagaatggccggccccagcaccaccagagccaagaagagaaagcccaacttctgcccccaggagaccgaggtgctggtgagcaaggtgagcaagcaccaccagctgctgttcggcaccggcctgctgaaggccgagcccaccagaagatacagagtgtggagcagaatcctgcaggccgtgaacgccctgggctactgcagaagagacgtggtggacctgaagcacaagtggagagacctgagagccgtggtgagaagaaagctgggcgacctgagaaaggccgcccacggccccagccccggcagcggcaagccccaggccctggccctgacccccgtggagcaggtggtggccaagaccttcagctgccaggccctgcccagcgagggcttcagcctggagccccccagagccacccaggtggacccctgcaacctgcaggagctgttccaggagatgagcgccaacgtgttcagaatcaacagcagcgtgaccagcctggagagaagcctgcagagcctgggcacccccagcgacacccaggagctgagagacagcctgcacaccgcccagcaggagaccaacaagaccatcgccgccagcgccagcagcgtgaagcagatggccgagctgctgagaagcagctgccccgagagactgcagcaggagagaccccagctggacagactgaagacccagctgagcgacgccatccagtgctacggcgtggtgcagaagaagatcgccgagaagagcagagccctgctgcccatggcccagagaggcagcaagcagagcccccaggcccccttcgccgagctggccgacgacgagaaggtgttcaacggcagcgacaacatgtggcagggccaggagcaggccctgctgcccgacatcaccgaggaggacctggaggccatcagactgagagaggaggccatcctgcagatggagagcaacctgctggacgtgaaccagatcatcaaggacctggccagcatggtgagcgagcagggcgaggccgtggacagcatcgaggccagcctggaggccgccagcagccacgccgaggccgccagacagctgctggccggcgccagcagacaccagctgcagagacacaagatcaagtgctgcttcctgagcgccggcgtgaccgccctgctggtgatcatcatcatcatcgccaccagcgtgagaaagtag

SEQ ID NO: 23698 - DNA, 1686 bp, Artificial Sequence
  Description of Artificial Sequence: Synthetic coding sequence
atgagcaccgagagaaccagctggaccagcctgagcaccatccagaagatcgccctgggcctgggcatccccgccagcgccaccgtggcctacatcctgtacagaagatacagagagagcagagaggagagactgaccttcgtgggcgaggacgacatcgagatcgagatgagagtgccccaggaggccgtgaagctgatcatcggcagacagggcgccaacatcaagcagctgagaaagcagaccggcgccagaatcgacgtggacaccgaggacgtgggcgacgagagagtgctgctgatcagcggcttccccgtgcaggtgtgcaaggccaaggccgccatccaccagatcctgaccgagaacacccccgtgagcgagcagctgagcgtgccccagagaagcgtgggcagaatcatcggcagaggcggcgagaccatcagaagcatctgcaaggccagcggcgccaagatcacctgcgacaaggagagcgagggcaccctgctgctgagcagactgatcaagatcagcggcacccagaaggaggtggccgccgccaagcacctgatcctggagaaggtgagcgaggacgaggagctgagaaagagaatcgcccacagcgccgagaccagagtgcccagaaagcagcccatcagcgtgagaagagaggacatgaccgagcccggcggcgccggcgagcccgccctgtggaagaacaccagcagcagcatggagcccaccgcccccctggtgacccccccccccaagggcggcggcgacatggccgtggtggtgagcaaggagggcagctgggagaagcccagcgacgacagcttccagaagagcgaggcccaggccatccccgagatgcccatgttcgagatccccagccccgacttcagcttccacgccgacgagtacctggaggtgtacgtgagcgccagcgagcaccccaaccacttctggatccagatcgtgggcagcagaagcctgcagctggacaagctggtgaacgagatgacccagcactacgagaacagcgtgcccgaggacctgaccgtgcacgtgggcgacatcgtggccgcccccctgcccaccaacggcagctggtacagagccagagtgctgggcaccctggagaacggcaacctggacctgtacttcgtggacttcggcgacaacggcgactgccccctgaaggacctgagagccctgagaagcgacttcctgagcctgcccttccaggccatcgagtgcagcctggccagaatcgcccccagcggcgaccagtgggaggaggaggccctggacgagttcgacagactgacccactgcgccgactggaagcccctggtggccaagatcagcagctacgtgcagaccggcatcagcacctggcccaagatctacctgtacgacaccagcaacggcaagaagctggacatcggcctggagctggtgcacaagggctacgccatcgagctgcccgaggacatcgaggagaacagagccgtgcccgacatgctgaaggacatggccaccgagaccgacgccagcctgagcaccctgctgaccgagaccaagaagagcagcggcgagatcacccacaccctgagctgcctgagcctgagcgaggccgccagcatgagcggcgacgacaacctggaggacgactacctgctgtag

SEQ ID NO: 23699 - DNA, 1674 bp, Artificial Sequence
  Description of Artificial Sequence: Synthetic coding sequence
atgagcaccgagagaaccagctggaccagcctgagcaccatccagaagatcgccctgggcctgggcatccccgccagcgccaccgtggcctacatcctgtacagaagatacagagagagcagagaggagagactgaccttcgtgggcgaggacgacatcgagatcgagatgagagtgccccaggaggccgtgaagctgatcatcggcagacagggcgccaacatcaagcagaccggcgccagaatcgacgtggacaccgaggacgtgggcgacgagagagtgctgctgatcagcggcttccccgtgcaggtgtgcaaggccaaggccgccatccaccagatcctgaccgagaacacccccgtgagcgagcagctgagcgtgccccagagaagcgtgggcagaatcatcggcagaggcggcgagaccatcagaagcatctgcaaggccagcggcgccaagatcacctgcgacaaggagagcgagggcaccctgctgctgagcagactgatcaagatcagcggcacccagaaggaggtggccgccgccaagcacctgatcctggagaaggtgagcgaggacgaggagctgagaaagagaatcgcccacagcgccgagaccagagtgcccagaaagcagcccatcagcgtgagaagagaggacatgaccgagcccggcggcgccggcgagcccgccctgtggaagaacaccagcagcagcatggagcccaccgcccccctggtgacccccccccccaagggcggcggcgacatggccgtggtggtgagcaaggagggcagctgggagaagcccagcgacgacagcttccagaagagcgaggcccaggccatccccgagatgcccatgttcgagatccccagccccgacttcagcttccacgccgacgagtacctggaggtgtacgtgagcgccagcgagcaccccaaccacttctggatccagatcgtgggcagcagaagcctgcagctggacaagctggtgaacgagatgacccagcactacgagaacagcgtgcccgaggacctgaccgtgcacgtgggcgacatcgtggccgcccccctgcccaccaacggcagctggtacagagccagagtgctgggcaccctggagaacggcaacctggacctgtacttcgtggacttcggcgacaacggcgactgccccctgaaggacctgagagccctgagaagcgacttcctgagcctgcccttccaggccatcgagtgcagcctggccagaatcgcccccagcggcgaccagtgggaggaggaggccctggacgagttcgacagactgacccactgcgccgactggaagcccctggtggccaagatcagcagctacgtgcagaccggcatcagcacctggcccaagatctacctgtacgacaccagcaacggcaagaagctggacatcggcctggagctggtgcacaagggctacgccatcgagctgcccgaggacatcgaggagaacagagccgtgcccgacatgctgaaggacatggccaccgagaccgacgccagcctgagcaccctgctgaccgagaccaagaagagcagcggcgagatcacccacaccctgagctgcctgagcctgagcgaggccgccagcatgagcggcgacgacaacctggaggacgactacctgctgtag

SEQ ID NO: 23700 - DNA, 1686 bp, Artificial Sequence; identical to SEQ ID NO: 23698
  Description of Artificial Sequence: Synthetic coding sequence

SEQ ID NO: 23701 - DNA, 1551 bp, Artificial Sequence
  Description of Artificial Sequence: Synthetic coding sequence
atgagcaccgagagaaccagctggaccagcctgagcaccatccagaagatcgccctgggcctgggcatccccgccagcgccaccgtggcctacatcctgtacagaagatacagagagagcagagaggagagactgaccttcgtgggcgaggacgacatcgagatcgagatgagagtgccccaggaggccgtgaagctgatcatcggcagacagggcgccaacatcaagcagctgagaaagcagaccggcgccagaatcgacgtggacaccgaggacgtgggcgacgagagagtgctgctgatcagcggcttccccgtgcaggccagcggcgccaagatcacctgcgacaaggagagcgagggcaccctgctgctgagcagactgatcaagatcagcggcacccagaaggaggtggccgccgccaagcacctgatcctggagaaggtgagcgaggacgaggagctgagaaagagaatcgcccacagcgccgagaccagagtgcccagaaagcagcccatcagcgtgagaagagaggacatgaccgagcccggcggcgccggcgagcccgccctgtggaagaacaccagcagcagcatggagcccaccgcccccctggtgacccccccccccaagggcggcggcgacatggccgtggtggtgagcaaggagggcagctgggagaagcccagcgacgacagcttccagaagagcgaggcccaggccatccccgagatgcccatgttcgagatccccagccccgacttcagcttccacgccgacgagtacctggaggtgtacgtgagcgccagcgagcaccccaaccacttctggatccagatcgtgggcagcagaagcctgcagctggacaagctggtgaacgagatgacccagcactacgagaacagcgtgcccgaggacctgaccgtgcacgtgggcgacatcgtggccgcccccctgcccaccaacggcagctggtacagagccagagtgctgggcaccctggagaacggcaacctggacctgtacttcgtggacttcggcgacaacggcgactgccccctgaaggacctgagagccctgagaagcgacttcctgagcctgcccttccaggccatcgagtgcagcctggccagaatcgcccccagcggcgaccagtgggaggaggaggccctggacgagttcgacagactgacccactgcgccgactggaagcccctggtggccaagatcagcagctacgtgcagaccggcatcagcacctggcccaagatctacctgtacgacaccagcaacggcaagaagctggacatcggcctggagctggtgcacaagggctacgccatcgagctgcccgaggacatcgaggagaacagagccgtgcccgacatgctgaaggacatggccaccgagaccgacgccagcctgagcaccctgctgaccgagaccaagaagagcagcggcgagatcacccacaccctgagctgcctgagcctgagcgaggccgccagcatgagcggcgacgacaacctggaggacgactacctgctgtag

SEQ ID NO: 23702 - DNA, 1686 bp, Artificial Sequence; identical to SEQ ID NO: 23698
  Description of Artificial Sequence: Synthetic coding sequence

SEQ ID NO: 23703 - DNA, 1014 bp, Artificial Sequence
  Description of Artificial Sequence: Synthetic coding sequence
atgaccgagcccggcggcgccggcgagcccgccctgtggaagaacaccagcagcagcatggagcccaccgcccccctggtgacccccccccccaagggcggcggcgacatggccgtggtggtgagcaaggagggcagctgggagaagcccagcgacgacagcttccagaagagcgaggcccaggccatccccgagatgcccatgttcgagatccccagccccgacttcagcttccacgccgacgagtacctggaggtgtacgtgagcgccagcgagcaccccaaccacttctggatccagatcgtgggcagcagaagcctgcagctggacaagctggtgaacgagatgacccagcactacgagaacagcgtgcccgaggacctgaccgtgcacgtgggcgacatcgtggccgcccccctgcccaccaacggcagctggtacagagccagagtgctgggcaccctggagaacggcaacctggacctgtacttcgtggacttcggcgacaacggcgactgccccctgaaggacctgagagccctgagaagcgacttcctgagcctgcccttccaggccatcgagtgcagcctggccagaatcgcccccagcggcgaccagtgggaggaggaggccctggacgagttcgacagactgacccactgcgccgactggaagcccctggtggccaagatcagcagctacgtgcagaccggcatcagcacctggcccaagatctacctgtacgacaccagcaacggcaagaagctggacatcggcctggagctggtgcacaagggctacgccatcgagctgcccgaggacatcgaggagaacagagccgtgcccgacatgctgaaggacatggccaccgagaccgacgccagcctgagcaccctgctgaccgagaccaagaagagcagcggcgagatcacccacaccctgagctgcctgagcctgagcgaggccgccagcatgagcggcgacgacaacctggaggacgactacctgctgtag

SEQ ID NO: 23704 - DNA, 1686 bp, Artificial Sequence; identical to SEQ ID NO: 23698
  Description of Artificial Sequence: Synthetic coding sequence

SEQ ID NO: 23705 - DNA, 396 bp, Artificial Sequence
  Description of Artificial Sequence: Synthetic coding sequence
atgagcaccgagagaaccagctggaccagcctgagcaccatccagaagatcgccctgggcctgggcatccccgccagcgccaccgtggcctacatcctgtacagaagatacagagagagcagagaggagagactgaccttcgtgggcgaggacgacatcgagatcgagatgagagtgccccaggaggccgtgaagctgatcatcggcagacagggcgccaacatcaagcagctgagaaagcagaccggcgccagaatcgacgtggacaccgaggacgtgggcgacgagagagtgctgctgatcagcggcttccccgtgcaggtgtgcaaggccaaggccgccatccaccagatcctgaccgagaacacccccgtgagcgagcagctgagcgtgtag

SEQ ID NO: 23706 - DNA, 1254 bp, Artificial Sequence
  Description of Artificial Sequence: Synthetic coding sequence
atggccctgaaggtgctgctggagcaggagaagaccttcttcaccctgctggtgctgctgggctacctgagctgcaaggtgacctgcgagagcggcgactgcagacagcaggagttcagagacagaagcggcaactgcgtgccctgcaaccagtgcggccccggcatggagctgagcaaggagtgcggcttcggctacggcgaggacgcccagtgcgtgacctgcagactgcacagattcaaggaggactggggcttccagaagtgcaagccctgcctggactgcgccgtggtgaacagattccagaaggccaactgcagcgccaccagcgacgccatctgcggcgactgcctgcccggcttctacagaaagaccaagctggtgggcttccaggacatggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggaggcctag

SEQ ID NO: 23707 - DNA, 1272 bp, Artificial Sequence
  Description of Artificial Sequence: Synthetic coding sequence
atggccctgaaggtgctgctggagcaggagaagaccttcttcaccctgctggtgctgctgggctacctgagctgcaaggtgacctgcgagagcggcgactgcagacagcaggagttcagagacagaagcggcaactgcgtgccctgcaaccagtgcggccccggcatggagctgagcaaggagtgcggcttcggctacggcgaggacgcccagtgcgtgacctgcagactgcacagattcaaggaggactggggcttccagaagtgcaagccctgcctggactgcgccgtggtgaacagattccagaaggccaactgcagcgccaccagcgacgccatctgcggcgactgcctgcccggcttctacagaaagaccaagctggtgggcttccaggacatggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggtgagacagagactgggcagcctgtag

SEQ ID NO: 23708 - DNA, 1254 bp, Artificial Sequence; identical to SEQ ID NO: 23706
  Description of Artificial Sequence: Synthetic coding sequence

SEQ ID NO: 23709 - DNA, 858 bp, Artificial Sequence
  Description of Artificial Sequence: Synthetic coding sequence
atggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggaggcctag

SEQ ID NO: 23710 - DNA, 570 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttcagcggcatcgccatcatggccctggccttccccgaccagctgtacgacgccgtgttcgacggcgcccaggtgaccagcaagacccccatcagactgtacggcggcgccctgctgagcatcagcctgatcatgtggaacgccctgtacaccgccgagaaggtgatcatcagatggaccctgctgaccgaggcctgctacttcggcgtgcagttcctggtggtgaccgccaccctggccgagaccggcctgatgagcctgggcatcctgctgctgctggtgagcagactgctgttcgtggtgatcagcatctactactactaccaggtgggcagaagacccaagaaggcctag

SEQ ID NO: 23711 - DNA, 411 bp, Artificial Sequence
  Description of Artificial Sequence: Synthetic coding sequence
atgaccaccggcagatgcatcgcccccagagtgtggcagttcgtgagcgccgtgctgttcagcggcatcgccatcatggccctggccttccccgaccagctgtacgacgccgtgttcgacggcgcccaggtgaccagcaagacccccatcagactgtacggcggcgccctgctgagcatcagcctgatcatgtggaacgccctgtacaccgccgagaaggtgatcatcagatggaccctgctgaccgaggcctgctacttcggcgtgcagttcctggtggtgaccgccaccctggccgagaccggcctgatgagcctgggcatcctgctgctgctggtgagcagactgctgttcgtggtgatcagcatctactactactaccaggtgggcagaagacccaagaaggcctag

SEQ ID NO: 23712 - DNA, 570 bp, Artificial Sequence; identical to SEQ ID NO: 23710
  Description of Artificial Sequence: Synthetic coding sequence

SEQ ID NO: 23713 - DNA, 570 bp, Artificial Sequence; identical to SEQ ID NO: 23710
  Description of Artificial Sequence: Synthetic coding sequence

SEQ ID NO: 23714 - DNA, 297 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttcagcggcatcgccatcatggccctggccttccccgaccagctgtacgacgccgtgttcgacggcgcccaggtgacctag

SEQ ID NO: 23715 - DNA, 222 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttctag

SEQ ID NO: 23716 - DNA, 477 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttcagcggcatcgccatcatggccctggccttccccgaccagctgtacgacgccgtgttcgacggcgcccaggtgaccagcaagacccccatcagactgtacggcggcgccctgctgagcatcagcctgatcatgtggaacgccctgtacaccgccgagaaggtgatcatcagatggaccctgctgaccgaggcctgctacttcggcgtgcagttcctggtggtgaccgccaccctggccgagaccggcctgatgagctag

SEQ ID NO: 23717 - DNA, 240 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttcagcggcatcgccatcatgtag

SEQ ID NO: 23718 - DNA, 282 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgagagtgtggcagttcgtgagcgccgtgctgttcagcggcatcgccatcatggccctggccttccccgaccagctgtacgacgccgtgttcgactag

SEQ ID NO: 23719 - DNA, 189 bp, Artificial Sequence
  Description of Artificial Sequence: Synthetic coding sequence
atggccgccaagcagcccccccccctgatgaagaagcacagccagaccgacctggtgagcagactgaagaccagaaagatcctgggcgtgggcggcgaggacgacgacggcgaggtgcacagaagcaagatcagccaggtgctgggcaacgagatcaagttcaccatcagagagcccctgggcctgtag

SEQ ID NO: 23720 - DNA, 570 bp, Artificial Sequence; identical to SEQ ID NO: 23710
  Description of Artificial Sequence: Synthetic coding sequence

SEQ ID NO: 23721 - DNA, 1182 bp, Artificial Sequence
  Description of Artificial Sequence: Synthetic coding sequence
atggccccccccccccccagcccccagctgctgctgctggccgccctggccagactgctgggccccagcgaggtgatggccggccccgccgaggaggccggcgcccactgccccgagagcctgtggcccctgcccccccaggtgagccccagagtgacctacaccagagtgagccccggccaggccgaggacgtgaccttcctgtaccacccctgcgcccacccctggctgaagctgcagctggccctgctggcctacgcctgcatggccaaccccagcctgacccccgacttcagcctgacccaggacagacccctggtgctgaccgcctggggcctggccctggagatggcctgggtggagcccgcctgggccgcccactggctgatgagaagaagaagaagaaagcagagaaagaagaaggcctggatctactgcgagagcctgagcggccccgcccccagcgagcccacccccggcagaggcagactgtgcagaagaggctgcgtgcaggccctggccctggccttcgccctgagaagctggagaccccccggcaccgaggtgaccagccagggccccagacagcccagcagcagcggcgccaagagaagaagactgagagccgccctgggcccccagcccaccagaagcgccctgagattccccagcgccagccccggcagcctgaaggccaagcagagcatggccggcatccccggcagagagagcaacgcccccagcgtgcccaccgtgagcctgctgcccggcgcccccggcggcaacgccagcagcagaaccgaggcccaggtgcccaacggccagggcagccccggcggctgcgtgtgcagcagccaggccagccccgcccccagagccgccgccccccccagagccgccagaggccccacccccagaaccgaggaggccgcctgggccgccatggccctgaccttcctgctggtgctgctgaccctggccaccctgtgcaccagactgcacagaaacttcagaagaggcgagagcatctactggggccccaccgccgacagccaggacaccgtggccgccgtgctgaagagaagactgctgcagcccagcagaagagtgaagagaagcagaagaagacccctgctgccccccacccccgacagcggccccgagggcgagagcagcgagtag

SEQ ID NO: 23722 - DNA, 414 bp, Artificial Sequence
  Description of Artificial Sequence: Synthetic coding sequence
gccaagcagagcatggccggcatccccggcagagagagcaacgcccccagcgtgcccaccgtgagcctgctgcccggcgcccccggcggcaacgccagcagcagaaccgaggcccaggtgcccaacggccagggccccagaggcctgtgcctgttcaagagcggcttccccggccccagcagaagcagccccagagccgccagaggccccacccccagaaccgaggaggccgcctgggccgccatggccctgaccttcctgctggtgctgctgaccctggccaccctgtgcaccagactgcacagaaacttcagaagaggcgagagcatctactggggccccaccgccgacagccaggacaccacccccccccccgcccacgacagcggccccgagggcgagagcagcgagtag

SEQ ID NO: 23723 - DNA, 1605 bp, Artificial Sequence
  Description of Artificial Sequence: Synthetic coding sequence
atgcaggccgccagagtggactacatcgccccctggtgggtggtgtggctgcacagcgtgccccacgtgggcctgagactgcagcccgtgaacagcaccttcagccccggcgacgagagctaccaggagagcctgctgttcctgggcctggtggccgccgtgtgcctgggcctgaacctgatcttcctggtggcctacctggtgtgcgcctgccactgcagaagagacgacgccgtgcagaccaagcagcaccacagctgctgcatcacctggaccgccgtggtggccggcctgatctgctgcgccgccgtgggcgtgggcttctacggcaacagcgagaccaacgacggcgcctaccagctgatgtacagcctggacgacgccaaccacaccttcagcggcatcgacgccctggtgagcggcaccacccagaagatgaaggtggacctggagcagcacctggccagactgagcgagatcttcgccgccagaggcgactacctgcagaccctgaagttcatccagcagatggccggcagcgtggtggtgcagctgagcggcctgcccgtgtggagagaggtgaccatggagctgaccaagctgagcgaccagaccggctacgtggagtactacagatggctgagctacctgctgctgttcatcctggacctggtgatctgcctgatcgcctgcctgggcctggccaagagaagcaagtgcctgctggccagcatgctgtgctgcggcgccctgagcctgctgctgagctgggccagcctggccgccgacggcagcgccgccgtggccaccagcgacttctgcgtggcccccgacaccttcatcctgaacgtgaccgagggccagatcagcaccgaggtgaccagatactacctgtactgcagccagagcggcagcagccccttccagcagaccctgaccaccttccagagagccctgaccaccatgcagatccaggtggccggcctgctgcagttcgccgtgcccctgttcagcaccgccgaggaggacctgctggccatccagctgctgctgaacagcagcgagagcagcctgcaccagctgaccgccatggtggactgcagaggcctgcacaaggactacctggacgccctggccggcatctgctacgacggcctgcagggcctgctgtacctgggcctgttcagcttcctggccgccctggccttcagcaccatgatctgcgccggccccagagcctggaagcacttcaccaccagaaacagagactacgacgacatcgacgacgacgaccccttcaacccccaggcctggagaatggccgcccacagcccccccagaggccagctgcacagcttctgcagctacagcagcggcctgggcagccagaccagcctgcagccccccgcccagaccatcagcaacgcccccgtgagcgagtacatgaaccaggccatgctgttcggcagaaaccccagatacgagaacgtgcccctgatcggcagagccagccccccccccacctacagccccagcatgagagccacctacctgagcgtggccgacgagcacctgagacactacggcaaccagttccccgcctag

SEQ ID NO: 23724 - DNA, 642 bp, Artificial Sequence
  Description of Artificial Sequence: Synthetic coding sequence
atgcagatccaggtggccggcctgctgcagttcgccgtgcccctgttcagcaccgccgaggaggacctgctggccatccagctgctgctgaacagcagcgagagcagcctgcaccagctgaccgccatggtggactgcagaggcctgcacaaggactacctggacgccctggccggcatctgctacgacggcctgcagggcctgctgtacctgggcctgttcagcttcctggccgccctggccttcagcaccatgatctgcgccggccccagagcctggaagcacttcaccaccagaaacagagactacgacgacatcgacgacgacgaccccttcaacccccaggcctggagaatggccgcccacagcccccccagaggccagctgcacagcttctgcagctacagcagcggcctgggcagccagaccagcctgcagccccccgcccagaccatcagcaacgcccccgtgagcgagtacatgaaccaggccatgctgttcggcagaaaccccagatacgagaacgtgcccctgatcggcagagccagccccccccccacctacagccccagcatgagagccacctacctgagcgtggccgacgagcacctgagacactacggcaaccagttccccgcctag

SEQ ID NO: 23725 - DNA, 1572 bp, Artificial Sequence
  Description of Artificial Sequence: Synthetic coding sequence
atggccggcgtgagctacgccgccccctggtgggtgagcctgctgcacagactgccccacttcgacctgagctgggaggccaccagcagccagttcagacccgaggacaccgactaccagcaggccctgctgctgctgggcgccgccgccctggcctgcctggccctggacctgctgttcctgctgttctacagcttctggctgtgctgcagaagaagaaagagcgaggagcacctggacgccgactgctgctgcaccgcctggtgcgtgatcatcgccaccctggtgtgcagcgccggcatcgccgtgggcttctacggcaacggcgagaccagcgacggcatccacagagccacctacagcctgagacacgccaacagaaccgtggccggcgtgcaggacagagtgtgggacaccgccgtgggcctgaaccacaccgccgagcccagcctgcagaccctggagagacagctggccggcagacccgagcccctgagagccgtgcagagactgcagggcctgctggagaccctgctgggctacaccgccgccatccccttctggagaaacaccgccgtgagcctggaggtgctggccgagcaggtggacctgtacgactggtacagatggctgggctacctgggcctgctgctgctggacgtgatcatctgcctgctggtgctggtgggcctgatcagaagcagcaagggcatcctggtgggcgtgtgcctgctgggcgtgctggccctggtgatcagctggggcgccctgggcctggagctggccgtgagcgtgggcagcagcgacttctgcgtggaccccgacgcctacgtgaccaagatggtggaggagtacagcgtgctgagcggcgacatcctgcagtactacctggcctgcagccccagagccgccaaccccttccagcagaagctgagcggcagccacaaggccctggtggagatgcaggacgtggtggccgagctgctgagaaccgtgccctgggagcagcccgccaccaaggaccccctgctgagagtgcaggaggtgctgaacggcaccgaggtgaacctgcagcacctgaccgccctggtggactgcagaagcctgcacctggactacgtgcaggccctgaccggcttctgctacgacggcgtggagggcctgatctacctggccctgttcagcttcgtgaccgccctgatgttcagcagcatcgtgtgcagcgtgccccacacctggcagcagaagagaggccccgacgaggacggcgaggaggaggccgcccccggccccagacaggcccacgacagcctgtacagagtgcacatgcccagcctgtacagctgcggcagcagctacggcagcgagaccagcatccccgccgccgcccacaccgtgagcaacgcccccgtgaccgagtacatgagccagaacgccaacttccagaaccccagatgcgagaacacccccctgatcggcagagagagccccccccccagctacaccagcagcatgagagccaagtacctggccaccagccagcccagacccgacagcagcggcagccactag

SEQ ID NO: 23726 - DNA, 1059 bp, Artificial Sequence
  Description of Artificial Sequence: Synthetic coding sequence
atgcccagcggcgtgcccggctgctggccccagctgcccctgaagggcccctggagacccacccccagacccagagtgcccgtgccctggagaacccccagattcgcctgcagatggctgggctacctgggcctgctgctgctggacgtgatcatctgcctgctggtgctggtgggcctgatcagaagcagcaagggcatcctggtgggcgtgtgcctgctgggcgtgctggccctggtgatcagctggggcgccctgggcctggagctggccgtgagcgtgggcagcagcgacttctgcgtggaccccgacgcctacgtgaccaagatggtggaggagtacagcgtgctgagcggcgacatcctgcagtactacctggcctgcagccccagagccgccaaccccttccagcagaagctgagcggcagccacaaggccctggtggagatgcaggacgtggtggccgagctgctgagaaccgtgccctgggagcagcccgccaccaaggaccccctgctgagagtgcaggaggtgctgaacggcaccgaggtgaacctgcagcacctgaccgccctggtggactgcagaagcctgcacctggactacgtgcaggccctgaccggcttctgctacgacggcgtggagggcctgatctacctggccctgttcagcttcgtgaccgccctgatgttcagcagcatcgtgtgcagcgtgccccacacctggcagcagaagagaggccccgacgaggacggcgaggaggaggccgcccccggccccagacaggcccacgacagcctgtacagagtgcacatgcccagcctgtacagctgcggcagcagctacggcagcgagaccagcatccccgccgccgcccacaccgtgagcaacgcccccgtgaccgagtacatgagccagaacgccaacttccagaaccccagatgcgagaacacccccctgatcggcagagagagccccccccccagctacaccagcagcatgagagccaagtacctggccaccagccagcccagacccgacagcagcggcagccactag

SEQ ID NO: 23727 - DNA, 1476 bp, Artificial Sequence
  Description of Artificial Sequence: Synthetic coding sequence
atggccggcgtgagctacgccgccccctggtgggtgagcctgctgcacagactgccccacttcgacctgagctgggaggccaccagcagccagttcagacccgaggacaccgactaccagcaggccctgctgctgctgggcgccgccgccctggcctgcctggccctggacctgctgttcctgctgttctacagcttctggctgtgctgcagaagaagaaagagcgaggagcacctggacgccgactgctgctgcaccgcctggtgcgtgatcatcgccaccctggtgtgcagcgccggcatcgccgtgggcttctacggcaacggcgagaccagcgacggcatccacagagccacctacagcctgagacacgccaacagaaccgtggccggcgtgcaggacagagtgtgggacaccgccgtgggcctgaaccacaccgccgagcccagcctgcagaccctggagagacagctggccggcagacccgagcccctgagagccgtgcagagactgcagggcctgctggagaccctgctgggctacaccgccgccatccccttctggagaaacaccgccgtgagcctggaggtgctggccgagcaggtggacctgtacgactggtacagagtgtgcctgctgggcgtgctggccctggtgatcagctggggcgccctgggcctggagctggccgtgagcgtgggcagcagcgacttctgcgtggaccccgacgcctacgtgaccaagatggtggaggagtacagcgtgctgagcggcgacatcctgcagtactacctggcctgcagccccagagccgccaaccccttccagcagaagctgagcggcagccacaaggccctggtggagatgcaggacgtggtggccgagctgctgagaaccgtgccctgggagcagcccgccaccaaggaccccctgctgagagtgcaggaggtgctgaacggcaccgaggtgaacctgcagcacctgaccgccctggtggactgcagaagcctgcacctggactacgtgcaggccctgaccggcttctgctacgacggcgtggagggcctgatctacctggccctgttcagcttcgtgaccgccctgatgttcagcagcatcgtgtgcagcgtgccccacacctggcagcagaagagaggccccgacgaggacggcgaggaggaggccgcccccggccccagacaggcccacgacagcctgtacagagtgcacatgcccagcctgtacagctgcggcagcagctacggcagcgagaccagcatccccgccgccgcccacaccgtgagcaacgcccccgtgaccgagtacatgagccagaacgccaacttccagaaccccagatgcgagaacacccccctgatcggcagagagagccccccccccagctacaccagcagcatgagagccaagtacctggccaccagccagcccagacccgacagcagcggcagccactag

SEQ ID NO: 23728 - DNA, 609 bp, Artificial Sequence
  Description of Artificial Sequence: Synthetic coding sequence
atggccgagtacctggccagcatcttcggcaccgagaaggacaaggtgaactgcagcttctacttcaagatcggcgtgtgcagacacggcgacagatgcagcagactgcacaacaagcccaccttcagccaggaggtgttcaccgagctgcaggagaagtacggcgagatcgaggagatgaacgtgtgcgacaacctgggcgaccacctggtgggcaacgtgtacgtgaagttcagaagagaggaggacggcgagagagccgtggccgagctgagcaacagatggttcaacggccaggccgtgcacggcaacgtgcccgaggtggccagcgccaccagctgcatctgcggccccttccccagaaccagcagaggcagcagcatgggcggcgaccccggcgccggccaccccagaggcagcatcctggccaccatccccgagagaggcaccatcggcgtgcccctgatcaccggcatggccgccagcgaggccctggcccccctgcccttcacccccaacagagacagatgcagctggcaggacctgagcagcaagccccccagcctgagctgccccatcctgcccagactgcccggcagcatcatgtag

SEQ ID NO: 23729 - DNA, 546 bp, Artificial Sequence
  Description of Artificial Sequence: Synthetic coding sequence
atggccgagtacctggccagcatcttcggcaccgagaaggacaaggtgaactgcagcttctacttcaagatcggcgtgtgcagacacggcgacagatgcagcagactgcacaacaagcccaccttcagccaggaggtgttcaccgagctgcaggagaagtacggcgagatcgaggagatgaacgtgtgcgacaacctgggcgaccacctggtgggcaacgtgtacgtgaagttcagaagagaggaggacggcgagagagccgtggccgagctgagcaacagatggttcaacggccaggccgtgcacggcgagctgagccccgtgaccgacttcagagagagctgctgcagacagtacgagatgggcgagtgcaccagaggcggcttctgcaacttcatgcacctgagacccatcagccagaacctgcagagacagctgtacggcagaggccccagaagaagaagcccccccagattccacaccggccaccaccccagagagagaaaccacagatgcagccccgaccactggcacggcagattctag

SEQ ID NO: 23730 - DNA, 552 bp, Artificial Sequence
  Description of Artificial Sequence: Synthetic coding sequence
atgtgcgccaccaccctgggcaccaccagctgggccaccagcatgagcagcagcggcggcagaagaatggagagcggcccctggctgaacagcgtgaccgccggcagcaccggcagactgtgcaccggcatgtaccccagatggctgctgcagctgcacgccagcgccgcccacttccccgagccccccgaggccgccctgtgggccggcacccaggcccaggtgccccaggaccagcccgccatgagcccccacgtgctgagacccctgtacccccagatgagcctgaccctgagccccagcaaccacgtgcccaagaacttcttcttcttcttcttcttcgagatggagccccacagcgtggcccaggccggcgtgcactggcaccacctgggcagctggcagctgcccccccccggcttcaagcagttcagcgccagcgccagccagatcgccggcatcaccggcacctgccaccacgccagactgatcttcgtgttcctggtggagatgggcttccaccacctgggccaggccggcctgaacagctag

SEQ ID NO: 23731 - DNA, 663 bp, Artificial Sequence
  Description of Artificial Sequence: Synthetic coding sequence
atggccgagtacctggccagcatcttcggcaccgagaaggacaaggtgaactgcagcttctacttcaagatcggcgtgtgcagacacggcgacagatgcagcagactgcacaacaagcccaccttcagccagaccatcgtgctgctgaacctgtacagaaacccccagaacaccgcccagaccgccgacggcagccactgccacgtgagcgacgtggaggtgcaggagcactacgacagcttcttcgaggaggtgttcaccgagctgcaggagaagtacggcgagatcgaggagatgaacgtgtgcgacaacctgggcgaccacctggtgggcaacgtgtacgtgaagttcagaagagaggaggacggcgagagagccgtggccgagctgagcaacagatggttcaacggccaggccgtgcacggcgagctgagccccgtgaccgacttcagagagagctgctgcagacagtacgagatgggcgagtgcaccagaggcggcttctgcaacttcatgcacctgagacccatcagccagaacctgcagagacagctgtacggcagaggccccagaagaagaagcccccccagattccacaccggccaccaccccagagagagaaaccacagatgcagccccgaccactggcacggcagattctag

SEQ ID NO: 23732 - DNA, 930 bp, Artificial Sequence
  Description of Artificial Sequence: Synthetic coding sequence
atgtgcttcttcttcagcctgcaggaggagttcctggacaagcacaccctgatgagagtgctgagcagcggcggcaagctgggcagcagaggcgagggcgcccagctgtgctgctggatgctgctgttcagctggagagtgagcggcggccagcagaccagaagactgtgcagaagagccttctgctggagccccgtgcccagccccagctgcagccccagcagctgcctgaccgccagaagcagcctgtgcatgaccttcacccagagcagaaccaccagcagcctggcccccgtgttcgccctgttcgtgcccttctactgcagcatccccagagtgcaggtggcccagatcctgggccccctgagcatcaccaacaagaccctgatctacatcctgggcctgcagctgttcaccagcggcagctacatctggatcgtggccatcagcggcctgatgagcggcctgtgctacgacagcaagatgttccaggtgcaccaggtgctgtgcatccccagctggatggccaagttcttcagctggaccctggagcccatcttcagcagcagcgagcccaccagcgaggccagaatcggcatgggcgccaccctggacatccagagacagcagagaatggagctgctggacagacagctgatgttcagccagttcgcccagggcagaagacagagacagcagcagggcggcatgatcaactggaacagactgttcccccccctgagacagagacagaacgtgaactaccagggcggcagacagagcgagcccgccgccccccccctggaggtgagcgaggagcaggtggccagactgatggagatgggcttcagcagaggcgacgccctggaggccctgagagccagcaacaacgacctgaacgtggccaccaacttcctgctgcagcactag

SEQ ID NO: 23733 - DNA, 1035 bp, Artificial Sequence
  Description of Artificial Sequence: Synthetic coding sequence
atgttcaccagcaccggcagcagcggcctgtacaaggcccccctgagcaagagcctgctgctggtgcccagcgccctgagcctgctgctggccctgctgctgccccactgccagaagctgttcgtgtacgacctgcacgccgtgaagaacgacttccagatctggagactgatctgcggcagaatcatctgcctggacctgaaggacaccttctgcagcagcctgctgatctacaacttcagaatcttcgagagaagatacggcagcagaaagttcgccagcttcctgctgggcagctgggtgctgagcgccctgttcgacttcctgctgatcgaggccatgcagtacttcttcggcatcaccgccgccagcaacctgcccagcggcttcctggcccccgtgttcgccctgttcgtgcccttctactgcagcatccccagagtgcaggtggcccagatcctgggccccctgagcatcaccaacaagaccctgatctacatcctgggcctgcagctgttcaccagcggcagctacatctggatcgtggccatcagcggcctgatgagcggcctgtgctacgacagcaagatgttccaggtgcaccaggtgctgtgcatccccagctggatggccaagttcttcagctggaccctggagcccatcttcagcagcagcgagcccaccagcgaggccagaatcggcatgggcgccaccctggacatccagagacagcagagaatggagctgctggacagacagctgatgttcagccagttcgcccagggcagaagacagagacagcagcagggcggcatgatcaactggaacagactgttcccccccctgagacagagacagaacgtgaactaccagggcggcagacagagcgagcccgccgccccccccctggaggtgagcgaggagcaggtggccagactgatggagatgggcttcagcagaggcgacgccctggaggccctgagagccagcaacaacgacctgaacgtggccaccaacttcctgctgcagcactag

SEQ ID NO: 23734 - DNA, 192 bp, Artificial Sequence
  Description of Artificial Sequence: Synthetic coding sequence
atggccgccgccaccctgaccagcaagctgtacagcctgctgttcagaagaaccagcaccttcgccctgaccatcatcgtgggcgtgatgttcttcgagagagccttcgaccagggcgccgacgccatctacgaccacatcaacgagggcaagctgtggaagcacatcaagcacaagtacgagaacaagtag

SEQ ID NO: 23735 - DNA, 399 bp, Artificial Sequence
  Description of Artificial Sequence: Synthetic coding sequence
atggccgccgccaccctgaccagcaagctgtacagcctgctgttcagaagacccccccccagccccagccccagcagctgggccagctgcagcagcagcgcccccagcatcaaggccagaaccctgagcaccaccaccagcaccagaggcagctgcggcaacaccagcagcaccagcatgagaaccagcagcagcctggaggcccccatccaggccagaagaaccagaagcacccagcagctgttcgcccagagctggagcctgagcctgaagatgatgctgaaggtgctgttcatggaccaccacagcctgctggccagaaacggcttcacctacaagaccgacagcctgcccagcgccgtgttcgaggtgtgcctggtgagcatgctgagaaagtag

SEQ ID NO: 23736 - DNA, 189 bp, Artificial Sequence
  Description of Artificial Sequence: Synthetic coding sequence
atggccgccgccaccctgaccagcaagctgtacagcctgctgttcagaagaaccagcaccttcgccctgaccatcatcgtgggcgtgatgttcttcgagagagccttcgaccagggcgccgacgccatctacgaccacatcaacgagggcgtgagagcctgcgccatccccgacctgggccccgcctag

SEQ ID NO: 23737 - DNA, 249 bp, Artificial Sequence
  Description of Artificial Sequence: Synthetic coding sequence
atggccgccgccaccctgaccagcaagctgtacagcctgctgttcagaagaaccagcaccttcgccctgaccatcatcgtgggcgtgatgttcttcgagagagccttcgaccagggcgccgacgccatctacgaccacatcaacgagggcgtgagagcctgcgccatccccccctggaccagactgagaggcgacagcggcgtggagaagctgtggaagcacatcaagcacaagtacgagaacaagtag

SEQ ID NO: 23738 - DNA, 171 bp, Artificial Sequence
  Description of Artificial Sequence: Synthetic coding sequence
atggtgaccagattcctgggccccagatacagagagctggtgaagaactgggtgcccaccgcctacacctggggcgccgtgggcgccgtgggcctggtgtgggccaccgactggagactgatcctggactgggtgccctacatcaacggcaagttcaagaaggacaactag

SEQ ID NO: 23739 - DNA, 15531 bp, Artificial Sequence
  Description of Artificial Sequence: Synthetic coding sequence
atggccaccagcggcggcgaggaggccgccgccgccgcccccgcccccggcacccccgccaccggcgccgacaccacccccggctgggaggtggccgtgagacccctgctgagcgccagctacagcgccttcgagatgaaggagctgccccagctggtggccagcgtgatcgagagcgagagcgagatcctgcaccacgagaagcagtacgagcccttctacagcagcttcgtggccctgagcacccactacatcaccaccgtgtgcagcctgatccccagaaaccagctgcagagcgtggccgccgcctgcaaggtgctgatcgagttcagcctgctgagactggagaaccccgacgaggcctgcgccgtgagccagaagcacctgatcctgctgatcaagggcctgtgcaccggctgcagcagactggacagaaccgagatcatcaccttcaccgccatgatgaagagcgccaagctgccccagaccgtgaagaccctgagcgacgtggaggaccagaaggagctggccagccccgtgagccccgagctgagacagaaggaggtgcagatgaacttcctgaaccagctgaccagcgtgttcaaccccagaaccgtggccagccagcccatcagcacccagaccctggtggagggcgagaacgacgagcagagcagcaccgaccaggccagcgccatcaagaccaagaacgtgttcatcgcccagaacgtggccagcctgcaggagctgggcggcagcgagaagctgctgagagtgtgcctgaacctgccctacttcctgagatacatcaacagattccaggacgccgtgctggccaacagcttcttcatcatgcccgccaccgtggccgacgccaccgccgtgagaaacggcttccacagcctggtgatcgacgtgaccatggccctggacaccctgagcctgcccgtgctggagcccctgaaccccagcagactgcaggacgtgaccgtgctgagcctgagctgcctgtacgccggcgtgagcgtggccacctgcatggccatcctgcacgtgggcagcgcccagcaggtgagaaccggcagcaccagcagcaaggaggacgactacgagagcgacgccgccaccatcgtgcagaagtgcctggagatctacgacatgatcggccaggccatcagcagcagcagaagagccggcggcgagcactaccagaacttccagctgctgggcgcctggtgcctgctgaacagcctgttcctgatcctgaacctgagccccaccgccctggccgacaagggcaaggagaaggaccccctggccgccctgagagtgagagacatcctgagcagaaccaaggagggcgtgggcagccccaagctgggccccggcaagggccaccagggcttcggcgtgctgagcgtgatcctggccaaccacgccatcaagctgctgaccagcctgttccaggacctgcaggtggaggccctgcacaagggctgggagaccgacggcccccccgccgccctgagcatcatggcccagagcaccagcatccagagaatccagagactgatcgacagcgtgcccctgatgaacctgctgctgaccctgctgagcaccagctacagaaaggcctgcgtgctgcagagacagagaaagggcagcatgagcagcgacgccagcgccagcaccgacagcaacacctactacgaggacgacttcagcagcaccgaggaggacagcagccaggacgacgacagcgagcccatcctgggccagtggttcgaggagaccatcagccccagcaaggagaaggccgcccccccccccccccccccccccccccccctggagagcagccccagagtgaagagccccagcaagcaggcccccggcgagaagggcaacatcctggccagcagaaaggaccccgagctgttcctgggcctggccagcaacatcctgaacttcatcaccagcagcatgctgaacagcagaaacaacttcatcagaaactacctgagcgtgagcctgagcgagcaccacatggccaccctggccagcatcatcaaggaggtggacaaggacggcctgaagggcagcagcgacgaggagttcgccgccgccctgtaccacttcaaccacagcctggtgaccagcgacctgcagagccccaacctgcagaacaccctgctgcagcagctgggcgtggcccccttcagcgagggcccctggcccctgtacatccacccccagagcctgagcgtgctgagcagactgctgctgatctggcagcacaaggccagcgcccagggcgaccccgacgtgcccgagtgcctgaaggtgtgggacagattcctgagcaccatgaagcagaacgccctgcagggcgtggtgcccagcgagaccgaggacctgaacgtggagcacctgcagatgctgctgctgatcttccacaacttcaccgagaccggcagaagagccatcctgagcctgttcgtgcagatcatccaggagctgagcgtgaacatggacgcccagatgagattcgtgcccctgatcctggccagactgctgctgatcttcgactacctgctgcaccagtacagcaaggcccccgtgtacctgttcgagcaggtgcagcacaacctgctgagcccccccttcggctgggccagcggcagccaggacagcaacagcagaagagccaccacccccctgtaccacggcttcaaggaggtggaggagaactggagcaagcacttcagcagcgacgccgtgccccaccccagattctactgcgtgctgagccccgaggccagcgaggacgacctgaacagactggacagcgtggcctgcgacgtgctgttcagcaagctggtgaagtacgacgagctgtacgccgccctgaccgccctgctggccgccggcagccagctggacaccgtgagaagaaaggagaacaagaacgtgaccgccctggaggcctgcgccctgcagtactacttcctgatcctgtggagaatcctgggcatcctgccccccagcaagacctacatcaaccagctgagcatgaacagccccgagatgagcgagtgcgacatcctgcacaccctgagatggagcagcagactgagaatcagcagctacgtgaactggatcaaggaccacctgatcaagcagggcatgaaggccgagcacgccagcagcctgctggagctggccagcaccaccaagtgcagcagcgtgaagtacgacgtggagatcgtggaggagtacttcgccagacagatcagcagcttctgcagcatcgactgcaccaccatcctgcagctgcacgagatccccagcctgcagagcatctacaccctggacgccgccatcagcaaggtgcaggtgagcctggacgagcacttcagcaagatggccgccgagaccgacccccacaagagcagcgagatcaccaagaacctgctgcccgccaccctgcagctgatcgacacctacgccagcttcaccagagcctacctgctgcagaacttcaacgaggagggcaccaccgagaagcccagcaaggagaagctgcagggcttcgccgccgtgctggccatcggcagcagcagatgcaaggccaacaccctgggccccaccctggtgcagaacctgcccagcagcgtgcagaccgtgtgcgagagctggaacaacatcaacaccaacgagttccccaacatcggcagctggagaaacgccttcgccaacgacaccatccccagcgagagctacatcagcgccgtgcaggccgcccacctgggcaccctgtgcagccagagcctgcccctggccgccagcctgaagcacaccctgctgagcctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgactgcttcttccccagatgcgcctgctggagcctgggcatcgtgggcatcctgatcggcgcccccctggagacccccagccccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcaggcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaaggaggagaaggagaaggagaaggacggcgagaccagcggcagccaggaggaccagctgtgcaccgccctggtgaaccagctgaacaagttcgccgacaaggagaccctgatccagttcctgagatgcttcctgctggagagcaacagcagcagcgtgagatggcaggcccactgcctgaccctgcacatctacagaaacagcagcaagagccagcaggagctgctgctggacctgatgtggagcatctggcccgagctgcccgcctacggcagaaaggccgcccagttcgtggacctgctgggctacttcagcctgaagaccccccagaccgagaagaagctgaaggagtacagccagaaggccgtggagatcctgagaacccagaaccacatcctgaccaaccaccccaacagcaacatctacaacaccctgagcggcctggtggagttcgacggctactacctggagagcgacccctgcctggtgtgcaacaaccccgaggtgcccttctgctacatcaagctgagcagcatcaaggtggacaccagatacaccaccacccagcaggtggtgaagctgatcggcagccacaccatcagcaaggtgaccgtgaagatcggcgacctgaagagaaccaagatggtgagaaccatcaacctgtactacaacaacagaaccgtgcaggccatcgtggagctgaagaacaagcccgccagatggcacaaggccaagaaggtgcagctgacccccggccagaccgaggtgaagatcgacctgcccctgcccatcgtggccagcaacctgatgatcgagttcgccgacttctacgagaactaccaggccagcaccgagaccctgcagtgccccagatgcagcgccagcgtgcccgccaaccccggcgtgtgcggcaactgcggcgagaacgtgtaccagtgccacaagtgcagaagcatcaactacgacgagaaggaccccttcctgtgcaacgcctgcggcttctgcaagtacgccagattcgacttcatgctgtacgccaagccctgctgcgccgtggaccccatcgagaacgaggaggacagaaagaaggccgtgagcaacatcaacaccctgctggacaaggccgacagagtgtaccaccagctgatgggccacagaccccagctggagaacctgctgtgcaaggtgaacgaggccgcccccgagaagccccaggacgacagcggcaccgccggcggcatcagcagcaccagcgccagcgtgaacagatacatcctgcagctggcccaggagtactgcggcgactgcaagaacagcttcgacgagctgagcaagatcatccagaaggtgttcgccagcagaaaggagctgctggagtacgacctgcagcagagagaggccgccaccaagagcagcagaaccagcgtgcagcccaccttcaccgccagccagtacagagccctgagcgtgctgggctgcggccacaccagcagcaccaagtgctacggctgcgccagcgccgtgaccgagcactgcatcaccctgctgagagccctggccaccaaccccgccctgagacacatcctggtgagccagggcctgatcagagagctgttcgactacaacctgagaagaggcgccgccgccatgagagaggaggtgagacagctgatgtgcctgctgaccagagacaaccccgaggccacccagcagatgaacgacctgatcatcggcaaggtgagcaccgccctgaagggccactgggccaaccccgacctggccagcagcctgcagtacgagatgctgctgctgaccgacagcatcagcaaggaggacagctgctgggagctgagactgagatgcgccctgagcctgttcctgatggccgtgaacatcaagacccccgtggtggtggagaacatcaccctgatgtgcctgagaatcctgcagaagctgatcaagccccccgcccccaccagcaagaagaacaaggacgtgcccgtggaggccctgaccaccgtgaagccctactgcaacgagatccacgcccaggcccagctgtggctgaagagagaccccaaggccagctacgacgcctggaagaagtgcctgcccatcagaggcatcgacggcaacggcaaggcccccagcaagagcgagctgagacacctgtacctgaccgagaagtacgtgtggagatggaagcagttcctgagcagaagaggcaagagaaccagccccctggacctgaagctgggccacaacaactggctgagacaggtgctgttcacccccgccacccaggccgccagacaggccgcctgcaccatcgtggaggccctggccaccatccccagcagaaagcagcaggtgctggacctgctgaccagctacctggacgagctgagcatcgccggcgagtgcgccgccgagtacctggccctgtaccagaagctgatcaccagcgcccactggaaggtgtacctggccgccagaggcgtgctgccctacgtgggcaacctgatcaccaaggagatcgccagactgctggccctggaggaggccaccctgagcaccgacctgcagcagggctacgccctgaagagcctgaccggcctgctgagcagcttcgtggaggtggagagcatcaagagacacttcaagagcagactggtgggcaccgtgctgaacggctacctgtgcctgagaaagctggtggtgcagagaaccaagctgatcgacgagacccaggacatgctgctggagatgctggaggacatgaccaccggcaccgagagcgagaccaaggccttcatggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagctgctggtgaacaacaagatcatcagcctggacctgcccgtggccgaggtgtacaagaaggtgtggtgcaccaccaacgagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23740 - DNA, 639 bp, Artificial Sequence
  Description of Artificial Sequence: Synthetic coding sequence
atggtgagaaccatcaacctgtactacaacaacagaaccgtgcaggccatcgtggagctgaagaacaagcccgccagatggcacaaggccaagaaggtgcagctgacccccggccagaccgaggtgaagatcgacctgcccctgcccatcgtggccagcaacctgatgatcgagttcgccgacttctacgagaactaccaggccagcaccgagaccctgcagtgccccagatgcagcgccagcgtgcccgccaaccccggcgtgtgcggcaactgcggcgagaacgtgtaccagtgccacaagtgcagaagcatcaactacgacgagaaggaccccttcctgtgcaacgcctgcggcttctgcaagtacgccagattcgacttcatgctgtacgccaagccctgctgcgccgtggaccccatcgagaacgaggaggacagaaagaaggccgtgagcaacatcaacaccctgctggacaaggccgacagagtgtaccaccagctgatgggccacagaccccagctggagaacctgctgtgcaaggtgaacgaggccgcccccgagaagccccaggtggtgcccagatgcaagggccacctggacaagggcctgggcctggaccagaagaccgccagctag

SEQ ID NO: 23741 - DNA, 2673 bp, Artificial Sequence
  Description of Artificial Sequence: Synthetic coding sequence
atgctggaggacatgaccaccggcaccgagagcgagaccaaggccttcatggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagctgctggtgaacaacaagatcatcagcctggacctgcccgtggccgaggtgtacaagaaggtgtggtgcaccaccaacgagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23742 - DNA, 777 bp, Artificial Sequence
  Description of Artificial Sequence: Synthetic coding sequence
atgggccccggcaagaagggcagatgcagagaggagggccccggcagaggcagaagagcctggatcatcagaggcagcggcagcagcagacagggctgggtgggcagcgtggagagcagcaagagaagcgccaacgtgaccagacagagacagatcgagcagatcctgcccgccctggccgccggcagctgcttccaccccgccttcatcctgagctgcagattcagcagcagaaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23743 - DNA, 15480 bp, Artificial Sequence
  Description of Artificial Sequence: Synthetic coding sequence
atggccaccagcggcggcgaggaggccgccgccgccgcccccgcccccggcacccccgccaccggcgccgacaccacccccggctgggaggtggccgtgagacccctgctgagcgccagctacagcgccttcgagatgaaggagctgccccagctggtggccagcgtgatcgagagcgagagcgagatcctgcaccacgagaagcagtacgagcccttctacagcagcttcgtggccctgagcacccactacatcaccaccgtgtgcagcctgatccccagaaaccagctgcagagcgtggccgccgcctgcaaggtgctgatcgagttcagcctgctgagactggagaaccccgacgaggcctgcgccgtgagccagaagcacctgatcctgctgatcaagggcctgtgcaccggctgcagcagactggacagaaccgagatcatcaccttcaccgccatgatgaagagcgccaagctgccccagaccgtgaagaccctgagcgacgtggaggaccagaaggagctggccagccccgtgagccccgagctgagacagaaggaggtgcagatgaacttcctgaaccagctgaccagcgtgttcaaccccagaaccgtggccagccagcccatcagcacccagaccctggtggagggcgagaacgacgagcagagcagcaccgaccaggccagcgccatcaagaccaagaacgtgttcatcgcccagaacgtggccagcctgcaggagctgggcggcagcgagaagctgctgagagtgtgcctgaacctgccctacttcctgagatacatcaacagattccaggacgccgtgctggccaacagcttcttcatcatgcccgccaccgtggccgacgccaccgccgtgagaaacggcttccacagcctggtgatcgacgtgaccatggccctggacaccctgagcctgcccgtgctggagcccctgaaccccagcagactgcaggacgtgaccgtgctgagcctgagctgcctgtacgccggcgtgagcgtggccacctgcatggccatcctgcacgtgggcagcgcccagcaggtgagaaccggcagcaccagcagcaaggaggacgactacgagagcgacgccgccaccatcgtgcagaagtgcctggagatctacgacatgatcggccaggccatcagcagcagcagaagagccggcggcgagcactaccagaacttccagctgctgggcgcctggtgcctgctgaacagcctgttcctgatcctgaacctgagccccaccgccctggccgacaagggcaaggagaaggaccccctggccgccctgagagtgagagacatcctgagcagaaccaaggagggcgtgggcagccccaagctgggccccggcaagggccaccagggcttcggcgtgctgagcgtgatcctggccaaccacgccatcaagctgctgaccagcctgttccaggacctgcaggtggaggccctgcacaagggctgggagaccgacggcccccccgccgccctgagcatcatggcccagagcaccagcatccagagaatccagagactgatcgacagcgtgcccctgatgaacctgctgctgaccctgctgagcaccagctacagaaaggcctgcgtgctgcagagacagagaaagggcagcatgagcagcgacgccagcgccagcaccgacagcaacacctactacgaggacgacttcagcagcaccgaggaggacagcagccaggacgacgacagcgagcccatcctgggccagtggttcgaggagaccatcagccccagcaaggagaaggccgcccccccccccccccccccccccccccccctggagagcagccccagagtgaagagccccagcaagcaggcccccggcgagaagggcaacatcctggccagcagaaaggaccccgagctgttcctgggcctggccagcaacatcctgaacttcatcaccagcagcatgctgaacagcagaaacaacttcatcagaaactacctgagcgtgagcctgagcgagcaccacatggccaccctggccagcatcatcaaggaggtggacaaggacggcctgaagggcagcagcgacgaggagttcgccgccgccctgtaccacttcaaccacagcctggtgaccagcgacctgcagagccccaacctgcagaacaccctgctgcagcagctgggcgtggcccccttcagcgagggcccctggcccctgtacatccacccccagagcctgagcgtgctgagcagactgctgctgatctggcagcacaaggccagcgcccagggcgaccccgacgtgcccgagtgcctgaaggtgtgggacagattcctgagcaccatgaagcagaacgccctgcagggcgtggtgcccagcgagaccgaggacctgaacgtggagcacctgcagatgctgctgctgatcttccacaacttcaccgagaccggcagaagagccatcctgagcctgttcgtgcagatcatccaggagctgagcgtgaacatggacgcccagatgagattcgtgcccctgatcctggccagactgctgctgatcttcgactacctgctgcaccagtacagcaaggcccccgtgtacctgttcgagcaggtgcagcacaacctgctgagcccccccttcggctgggccagcggcagccaggacagcaacagcagaagagccaccacccccctgtaccacggcttcaaggaggtggaggagaactggagcaagcacttcagcagcgacgccgtgccccaccccagattctactgcgtgctgagccccgaggccagcgaggacgacctgaacagactggacagcgtggcctgcgacgtgctgttcagcaagctggtgaagtacgacgagctgtacgccgccctgaccgccctgctggccgccggcagccagctggacaccgtgagaagaaaggagaacaagaacgtgaccgccctggaggcctgcgccctgcagtactacttcctgatcctgtggagaatcctgggcatcctgccccccagcaagacctacatcaaccagctgagcatgaacagccccgagatgagcgagtgcgacatcctgcacaccctgagatggagcagcagactgagaatcagcagctacgtgaactggatcaaggaccacctgatcaagcagggcatgaaggccgagcacgccagcagcctgctggagctggccagcaccaccaagtgcagcagcgtgaagtacgacgtggagatcgtggaggagtacttcgccagacagatcagcagcttctgcagcatcgactgcaccaccatcctgcagctgcacgagatccccagcctgcagagcatctacaccctggacgccgccatcagcaaggtgcaggtgagcctggacgagcacttcagcaagatggccgccgagaccgacccccacaagagcagcgagatcaccaagaacctgctgcccgccaccctgcagctgatcgacacctacgccagcttcaccagagcctacctgctgcagaacttcaacgaggagggcaccaccgagaagcccagcaaggagaagctgcagggcttcgccgccgtgctggccatcggcagcagcagatgcaaggccaacaccctgggccccaccctggtgcagaacctgcccagcagcgtgcagaccgtgtgcgagagctggaacaacatcaacaccaacgagttccccaacatcggcagctggagaaacgccttcgccaacgacaccatccccagcgagagctacatcagcgccgtgcaggccgcccacctgggcaccctgtgcagccagagcctgcccctggccgccagcctgaagcacaccctgctgagcctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagcagcgagaccgagagcctgaccaagctggacagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcaggcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaaggaggagaaggagaaggagaaggacggcgagaccagcggcagccaggaggaccagctgtgcaccgccctggtgaaccagctgaacaagttcgccgacaaggagaccctgatccagttcctgagatgcttcctgctggagagcaacagcagcagcgtgagatggcaggcccactgcctgaccctgcacatctacagaaacagcagcaagagccagcaggagctgctgctggacctgatgtggagcatctggcccgagctgcccgcctacggcagaaaggccgcccagttcgtggacctgctgggctacttcagcctgaagaccccccagaccgagaagaagctgaaggagtacagccagaaggccgtggagatcctgagaacccagaaccacatcctgaccaaccaccccaacagcaacatctacaacaccctgagcggcctggtggagttcgacggctactacctggagagcgacccctgcctggtgtgcaacaaccccgaggtgcccttctgctacatcaagctgagcagcatcaaggtggacaccagatacaccaccacccagcaggtggtgaagctgatcggcagccacaccatcagcaaggtgaccgtgaagatcggcgacctgaagagaaccaagatggtgagaaccatcaacctgtactacaacaacagaaccgtgcaggccatcgtggagctgaagaacaagcccgccagatggcacaaggccaagaaggtgcagctgacccccggccagaccgaggtgaagatcgacctgcccctgcccatcgtggccagcaacctgatgatcgagttcgccgacttctacgagaactaccaggccagcaccgagaccctgcagtgccccagatgcagcgccagcgtgcccgccaaccccggcgtgtgcggcaactgcggcgagaacgtgtaccagtgccacaagtgcagaagcatcaactacgacgagaaggaccccttcctgtgcaacgcctgcggcttctgcaagtacgccagattcgacttcatgctgtacgccaagccctgctgcgccgtggaccccatcgagaacgaggaggacagaaagaaggccgtgagcaacatcaacaccctgctggacaaggccgacagagtgtaccaccagctgatgggccacagaccccagctggagaacctgctgtgcaaggtgaacgaggccgcccccgagaagccccaggacgacagcggcaccgccggcggcatcagcagcaccagcgccagcgtgaacagatacatcctgcagctggcccaggagtactgcggcgactgcaagaacagcttcgacgagctgagcaagatcatccagaaggtgttcgccagcagaaaggagctgctggagtacgacctgcagcagagagaggccgccaccaagagcagcagaaccagcgtgcagcccaccttcaccgccagccagtacagagccctgagcgtgctgggctgcggccacaccagcagcaccaagtgctacggctgcgccagcgccgtgaccgagcactgcatcaccctgctgagagccctggccaccaaccccgccctgagacacatcctggtgagccagggcctgatcagagagctgttcgactacaacctgagaagaggcgccgccgccatgagagaggaggtgagacagctgatgtgcctgctgaccagagacaaccccgaggccacccagcagatgaacgacctgatcatcggcaaggtgagcaccgccctgaagggccactgggccaaccccgacctggccagcagcctgcagtacgagatgctgctgctgaccgacagcatcagcaaggaggacagctgctgggagctgagactgagatgcgccctgagcctgttcctgatggccgtgaacatcaagacccccgtggtggtggagaacatcaccctgatgtgcctgagaatcctgcagaagctgatcaagccccccgcccccaccagcaagaagaacaaggacgtgcccgtggaggccctgaccaccgtgaagccctactgcaacgagatccacgcccaggcccagctgtggctgaagagagaccccaaggccagctacgacgcctggaagaagtgcctgcccatcagaggcatcgacggcaacggcaaggcccccagcaagagcgagctgagacacctgtacctgaccgagaagtacgtgtggagatggaagcagttcctgagcagaagaggcaagagaaccagccccctggacctgaagctgggccacaacaactggctgagacaggtgctgttcacccccgccacccaggccgccagacaggccgcctgcaccatcgtggaggccctggccaccatccccagcagaaagcagcaggtgctggacctgctgaccagctacctggacgagctgagcatcgccggcgagtgcgccgccgagtacctggccctgtaccagaagctgatcaccagcgcccactggaaggtgtacctggccgccagaggcgtgctgccctacgtgggcaacctgatcaccaaggagatcgccagactgctggccctggaggaggccaccctgagcaccgacctgcagcagggctacgccctgaagagcctgaccggcctgctgagcagcttcgtggaggtggagagcatcaagagacacttcaagagcagactggtgggcaccgtgctgaacggctacctgtgcctgagaaagctggtggtgcagagaaccaagctgatcgacgagacccaggacatgctgctggagatgctggaggacatgaccaccggcaccgagagcgagaccaaggccttcatggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagctgctggtgaacaacaagatcatcagcctggacctgcccgtggccgaggtgtacaagaaggtgtggtgcaccaccaacgagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23744 - DNA, 15552 bp, Artificial Sequence
  Description of Artificial Sequence: Synthetic coding sequence
atggccaccagcggcggcgaggaggccgccgccgccgcccccgcccccggcacccccgccaccggcgccgacaccacccccggctgggaggtggccgtgagacccctgctgagcgccagctacagcgccttcgagatgaaggagctgccccagctggtggccagcgtgatcgagagcgagagcgagatcctgcaccacgagaagcagtacgagcccttctacagcagcttcgtggccctgagcacccactacatcaccaccgtgtgcagcctgatccccagaaaccagctgcagagcgtggccgccgcctgcaaggtgctgatcgagttcagcctgctgagactggagaaccccgacgaggcctgcgccgtgagccagaagcacctgatcctgctgatcaagggcctgtgcaccggctgcagcagactggacagaaccgagatcatcaccttcaccgccatgatgaagagcgccaagctgccccagaccgtgaagaccctgagcgacgtggaggaccagaaggagctggccagccccgtgagccccgagctgagacagaaggaggtgcagatgaacttcctgaaccagctgaccagcgtgttcaaccccagaaccgtggccagccagcccatcagcacccagaccctggtggagggcgagaacgacgagcagagcagcaccgaccaggccagcgccatcaagaccaagaacgtgttcatcgcccagaacgtggccagcctgcaggagctgggcggcagcgagaagctgctgagagtgtgcctgaacctgccctacttcctgagatacatcaacagattccaggacgccgtgctggccaacagcttcttcatcatgcccgccaccgtggccgacgccaccgccgtgagaaacggcttccacagcctggtgatcgacgtgaccatggccctggacaccctgagcctgcccgtgctggagcccctgaaccccagcagactgcaggacgtgaccgtgctgagcctgagctgcctgtacgccggcgtgagcgtggccacctgcatggccatcctgcacgtgggcagcgcccagcaggtgagaaccggcagcaccagcagcaaggaggacgactacgagagcgacgccgccaccatcgtgcagaagtgcctggagatctacgacatgatcggccaggccatcagcagcagcagaagagccggcggcgagcactaccagaacttccagctgctgggcgcctggtgcctgctgaacagcctgttcctgatcctgaacctgagccccaccgccctggccgacaagggcaaggagaaggaccccctggccgccctgagagtgagagacatcctgagcagaaccaaggagggcgtgggcagccccaagctgggccccggcaagggccaccagggcttcggcgtgctgagcgtgatcctggccaaccacgccatcaagctgctgaccagcctgttccaggacctgcaggtggaggccctgcacaagggctgggagaccgacggcccccccgccgccctgagcatcatggcccagagcaccagcatccagagaatccagagactgatcgacagcgtgcccctgatgaacctgctgctgaccctgctgagcaccagctacagaaaggcctgcgtgctgcagagacagagaaagggcagcatgagcagcgacgccagcgccagcaccgacagcaacacctactacgaggacgacttcagcagcaccgaggaggacagcagccaggacgacgacagcgagcccatcctgggccagtggttcgaggagaccatcagccccagcaaggagaaggccgcccccccccccccccccccccccccccccctggagagcagccccagagtgaagagccccagcaagcaggcccccggcgagaagggcaacatcctggccagcagaaaggaccccgagctgttcctgggcctggccagcaacatcctgaacttcatcaccagcagcatgctgaacagcagaaacaacttcatcagaaactacctgagcgtgagcctgagcgagcaccacatggccaccctggccagcatcatcaaggaggtggacaaggacggcctgaagggcagcagcgacgaggagttcgccgccgccctgtaccacttcaaccacagcctggtgaccagcgacctgcagagccccaacctgcagaacaccctgctgcagcagctgggcgtggcccccttcagcgagggcccctggcccctgtacatccacccccagagcctgagcgtgctgagcagactgctgctgatctggcagcacaaggccagcgcccagggcgaccccgacgtgcccgagtgcctgaaggtgtgggacagattcctgagcaccatgaagcagaacgccctgcagggcgtggtgcccagcgagaccgaggacctgaacgtggagcacctgcagatgctgctgctgatcttccacaacttcaccgagaccggcagaagagccatcctgagcctgttcgtgcagatcatccaggagctgagcgtgaacatggacgcccagatgagattcgtgcccctgatcctggccagactgctgctgatcttcgactacctgctgcaccagtacagcaaggcccccgtgtacctgttcgagcaggtgcagcacaacctgctgagcccccccttcggctgggccagcggcagccaggacagcaacagcagaagagccaccacccccctgtaccacggcttcaaggaggtggaggagaactggagcaagcacttcagcagcgacgccgtgccccaccccagattctactgcgtgctgagccccgaggccagcgaggacgacctgaacagactggacagcgtggcctgcgacgtgctgttcagcaagctggtgaagtacgacgagctgtacgccgccctgaccgccctgctggccgccggcagccagctggacaccgtgagaagaaaggagaacaagaacgtgaccgccctggaggcctgcgccctgcagtactacttcctgatcctgtggagaatcctgggcatcctgccccccagcaagacctacatcaaccagctgagcatgaacagccccgagatgagcgagtgcgacatcctgcacaccctgagatggagcagcagactgagaatcagcagctacgtgaactggatcaaggaccacctgatcaagcagggcatgaaggccgagcacgccagcagcctgctggagctggccagcaccaccaagtgcagcagcgtgaagtacgacgtggagatcgtggaggagtacttcgccagacagatcagcagcttctgcagcatcgactgcaccaccatcctgcagctgcacgagatccccagcctgcagagcatctacaccctggacgccgccatcagcaaggtgcaggtgagcctggacgagcacttcagcaagatggccgccgagaccgacccccacaagagcagcgagatcaccaagaacctgctgcccgccaccctgcagctgatcgacacctacgccagcttcaccagagcctacctgctgcagaacttcaacgaggagggcaccaccgagaagcccagcaaggagaagctgcagggcttcgccgccgtgctggccatcggcagcagcagatgcaaggccaacaccctgggccccaccctggtgcagaacctgcccagcagcgtgcagaccgtgtgcgagagctggaacaacatcaacaccaacgagttccccaacatcggcagctggagaaacgccttcgccaacgacaccatccccagcgagagctacatcagcgccgtgcaggccgcccacctgggcaccctgtgcagccagagcctgcccctggccgccagcctgaagcacaccctgctgagcctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcagggcagcagcagcagcgccctgggcctgcagagcctgggcctgagcggccaggcccccagcagcagcagcctggacgccggcaccctgagcgacaccaccgccagcgcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaaggaggagaaggagaaggagaaggacggcgagaccagcggcagccaggaggaccagctgtgcaccgccctggtgaaccagctgaacaagttcgccgacaaggagaccctgatccagttcctgagatgcttcctgctggagagcaacagcagcagcgtgagatggcaggcccactgcctgaccctgcacatctacagaaacagcagcaagagccagcaggagctgctgctggacctgatgtggagcatctggcccgagctgcccgcctacggcagaaaggccgcccagttcgtggacctgctgggctacttcagcctgaagaccccccagaccgagaagaagctgaaggagtacagccagaaggccgtggagatcctgagaacccagaaccacatcctgaccaaccaccccaacagcaacatctacaacaccctgagcggcctggtggagttcgacggctactacctggagagcgacccctgcctggtgtgcaacaaccccgaggtgcccttctgctacatcaagctgagcagcatcaaggtggacaccagatacaccaccacccagcaggtggtgaagctgatcggcagccacaccatcagcaaggtgaccgtgaagatcggcgacctgaagagaaccaagatggtgagaaccatcaacctgtactacaacaacagaaccgtgcaggccatcgtggagctgaagaacaagcccgccagatggcacaaggccaagaaggtgcagctgacccccggccagaccgaggtgaagatcgacctgcccctgcccatcgtggccagcaacctgatgatcgagttcgccgacttctacgagaactaccaggccagcaccgagaccctgcagtgccccagatgcagcgccagcgtgcccgccaaccccggcgtgtgcggcaactgcggcgagaacgtgtaccagtgccacaagtgcagaagcatcaactacgacgagaaggaccccttcctgtgcaacgcctgcggcttctgcaagtacgccagattcgacttcatgctgtacgccaagccctgctgcgccgtggaccccatcgagaacgaggaggacagaaagaaggccgtgagcaacatcaacaccctgctggacaaggccgacagagtgtaccaccagctgatgggccacagaccccagctggagaacctgctgtgcaaggtgaacgaggccgcccccgagaagccccaggacgacagcggcaccgccggcggcatcagcagcaccagcgccagcgtgaacagatacatcctgcagctggcccaggagtactgcggcgactgcaagaacagcttcgacgagctgagcaagatcatccagaaggtgttcgccagcagaaaggagctgctggagtacgacctgcagcagagagaggccgccaccaagagcagcagaaccagcgtgcagcccaccttcaccgccagccagtacagagccctgagcgtgctgggctgcggccacaccagcagcaccaagtgctacggctgcgccagcgccgtgaccgagcactgcatcaccctgctgagagccctggccaccaaccccgccctgagacacatcctggtgagccagggcctgatcagagagctgttcgactacaacctgagaagaggcgccgccgccatgagagaggaggtgagacagctgatgtgcctgctgaccagagacaaccccgaggccacccagcagatgaacgacctgatcatcggcaaggtgagcaccgccctgaagggccactgggccaaccccgacctggccagcagcctgcagtacgagatgctgctgctgaccgacagcatcagcaaggaggacagctgctgggagctgagactgagatgcgccctgagcctgttcctgatggccgtgaacatcaagacccccgtggtggtggagaacatcaccctgatgtgcctgagaatcctgcagaagctgatcaagccccccgcccccaccagcaagaagaacaaggacgtgcccgtggaggccctgaccaccgtgaagccctactgcaacgagatccacgcccaggcccagctgtggctgaagagagaccccaaggccagctacgacgcctggaagaagtgcctgcccatcagaggcatcgacggcaacggcaaggcccccagcaagagcgagctgagacacctgtacctgaccgagaagtacgtgtggagatggaagcagttcctgagcagaagaggcaagagaaccagccccctggacctgaagctgggccacaacaactggctgagacaggtgctgttcacccccgccacccaggccgccagacaggccgcctgcaccatcgtggaggccctggccaccatccccagcagaaagcagcaggtgctggacctgctgaccagctacctggacgagctgagcatcgccggcgagtgcgccgccgagtacctggccctgtaccagaagctgatcaccagcgcccactggaaggtgtacctggccgccagaggcgtgctgccctacgtgggcaacctgatcaccaaggagatcgccagactgctggccctggaggaggccaccctgagcaccgacctgcagcagggctacgccctgaagagcctgaccggcctgctgagcagcttcgtggaggtggagagcatcaagagacacttcaagagcagactggtgggcaccgtgctgaacggctacctgtgcctgagaaagctggtggtgcagagaaccaagctgatcgacgagacccaggacatgctgctggagatgctggaggacatgaccaccggcaccgagagcgagaccaaggccttcatggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagctgctggtgaacaacaagatcatcagcctggacctgcccgtggccgaggtgtacaagaaggtgtggtgcaccaccaacgagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23745 - DNA, 15615 bp, Artificial Sequence
  Description of Artificial Sequence: Synthetic coding sequence
atggccaccagcggcggcgaggaggccgccgccgccgcccccgcccccggcacccccgccaccggcgccgacaccacccccggctgggaggtggccgtgagacccctgctgagcgccagctacagcgccttcgagatgaaggagctgccccagctggtggccagcgtgatcgagagcgagagcgagatcctgcaccacgagaagcagtacgagcccttctacagcagcttcgtggccctgagcacccactacatcaccaccgtgtgcagcctgatccccagaaaccagctgcagagcgtggccgccgcctgcaaggtgctgatcgagttcagcctgctgagactggagaaccccgacgaggcctgcgccgtgagccagaagcacctgatcctgctgatcaagggcctgtgcaccggctgcagcagactggacagaaccgagatcatcaccttcaccgccatgatgaagagcgccaagctgccccagaccgtgaagaccctgagcgacgtggaggaccagaaggagctggccagccccgtgagccccgagctgagacagaaggaggtgcagatgaacttcctgaaccagctgaccagcgtgttcaaccccagaaccgtggccagccagcccatcagcacccagaccctggtggagggcgagaacgacgagcagagcagcaccgaccaggccagcgccatcaagaccaagaacgtgttcatcgcccagaacgtggccagcctgcaggagctgggcggcagcgagaagctgctgagagtgtgcctgaacctgccctacttcctgagatacatcaacagattccaggacgccgtgctggccaacagcttcttcatcatgcccgccaccgtggccgacgccaccgccgtgagaaacggcttccacagcctggtgatcgacgtgaccatggccctggacaccctgagcctgcccgtgctggagcccctgaaccccagcagactgcaggacgtgaccgtgctgagcctgagctgcctgtacgccggcgtgagcgtggccacctgcatggccatcctgcacgtgggcagcgcccagcaggtgagaaccggcagcaccagcagcaaggaggacgactacgagagcgacgccgccaccatcgtgcagaagtgcctggagatctacgacatgatcggccaggccatcagcagcagcagaagagccggcggcgagcactaccagaacttccagctgctgggcgcctggtgcctgctgaacagcctgttcctgatcctgaacctgagccccaccgccctggccgacaagggcaaggagaaggaccccctggccgccctgagagtgagagacatcctgagcagaaccaaggagggcgtgggcagccccaagctgggccccggcaagggccaccagggcttcggcgtgctgagcgtgatcctggccaaccacgccatcaagctgctgaccagcctgttccaggacctgcaggtggaggccctgcacaagggctgggagaccgacggcccccccgccgccctgagcatcatggcccagagcaccagcatccagagaatccagagactgatcgacagcgtgcccctgatgaacctgctgctgaccctgctgagcaccagctacagaaaggcctgcgtgctgcagagacagagaaagggcagcatgagcagcgacgccagcgccagcaccgacagcaacacctactacgaggacgacttcagcagcaccgaggaggacagcagccaggacgacgacagcgagcccatcctgggccagtggttcgaggagaccatcagccccagcaaggagaaggccgcccccccccccccccccccccccccccccctggagagcagccccagagtgaagagccccagcaagcaggcccccggcgagaagggcaacatcctggccagcagaaaggaccccgagctgttcctgggcctggccagcaacatcctgaacttcatcaccagcagcatgctgaacagcagaaacaacttcatcagaaactacctgagcgtgagcctgagcgagcaccacatggccaccctggccagcatcatcaaggaggtggacaaggacggcctgaagggcagcagcgacgaggagttcgccgccgccctgtaccacttcaaccacagcctggtgaccagcgacctgcagagccccaacctgcagaacaccctgctgcagcagctgggcgtggcccccttcagcgagggcccctggcccctgtacatccacccccagagcctgagcgtgctgagcagactgctgctgatctggcagcacaaggccagcgcccagggcgaccccgacgtgcccgagtgcctgaaggtgtgggacagattcctgagcaccatgaagcagaacgccctgcagggcgtggtgcccagcgagaccgaggacctgaacgtggagcacctgcagatgctgctgctgatcttccacaacttcaccgagaccggcagaagagccatcctgagcctgttcgtgcagatcatccaggagctgagcgtgaacatggacgcccagatgagattcgtgcccctgatcctggccagactgctgctgatcttcgactacctgctgcaccagtacagcaaggcccccgtgtacctgttcgagcaggtgcagcacaacctgctgagcccccccttcggctgggccagcggcagccaggacagcaacagcagaagagccaccacccccctgtaccacggcttcaaggaggtggaggagaactggagcaagcacttcagcagcgacgccgtgccccaccccagattctactgcgtgctgagccccgaggccagcgaggacgacctgaacagactggacagcgtggcctgcgacgtgctgttcagcaagctggtgaagtacgacgagctgtacgccgccctgaccgccctgctggccgccggcagccagctggacaccgtgagaagaaaggagaacaagaacgtgaccgccctggaggcctgcgccctgcagtactacttcctgatcctgtggagaatcctgggcatcctgccccccagcaagacctacatcaaccagctgagcatgaacagccccgagatgagcgagtgcgacatcctgcacaccctgagatggagcagcagactgagaatcagcagctacgtgaactggatcaaggaccacctgatcaagcagggcatgaaggccgagcacgccagcagcctgctggagctggccagcaccaccaagtgcagcagcgtgaagtacgacgtggagatcgtggaggagtacttcgccagacagatcagcagcttctgcagcatcgactgcaccaccatcctgcagctgcacgagatccccagcctgcagagcatctacaccctggacgccgccatcagcaaggtgcaggtgagcctggacgagcacttcagcaagatggccgccgagaccgacccccacaagagcagcgagatcaccaagaacctgctgcccgccaccctgcagctgatcgacacctacgccagcttcaccagagcctacctgctgcagaacttcaacgaggagggcaccaccgagaagcccagcaaggagaagctgcagggcttcgccgccgtgctggccatcggcagcagcagatgcaaggccaacaccctgggccccaccctggtgcagaacctgcccagcagcgtgcagaccgtgtgcgagagctggaacaacatcaacaccaacgagttccccaacatcggcagctggagaaacgccttcgccaacgacaccatccccagcgagagctacatcagcgccgtgcaggccgcccacctgggcaccctgtgcagccagagcctgcccctggccgccagcctgaagcacaccctgctgagcctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcagggcagcagcagcagcgccctgggcctgcagagcctgggcctgagcggccaggcccccagcagcagcagcctggacgccggcaccctgagcgacaccaccgccagcgcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaaggaggagaaggagaaggagaaggacggcgagaccagcggcagccaggaggaccagctgtgcaccgccctggtgaaccagctgaacaagttcgccgacaaggagaccctgatccagttcctgagatgcttcctgctggagagcaacagcagcagcgtgagatggcaggcccactgcctgaccctgcacatctacagaaacagcagcaagagccagcaggagctgctgctggacctgatgtggagcatctggcccgagctgcccgcctacggcagaaaggccgcccagttcgtggacctgctgggctacttcagcctgaagaccccccagaccgagaagaagctgaaggagtacagccagaaggccgtggagatcctgagaacccagaaccacatcctgaccaaccaccccaacagcaacatctacaacaccctgagcggcctggtggagttcgacggctactacctggagagcgacccctgcctggtgtgcaacaaccccgaggtgcccttctgctacatcaagctgagcagcatcaaggtggacaccagatacaccaccacccagcaggtggtgaagctgatcggcagccacaccatcagcaaggtgaccgtgaagatcggcgacctgaagagaaccaagatggtgagaaccatcaacctgtactacaacaacagaaccgtgcaggccatcgtggagctgaagaacaagcccgccagatggcacaaggccaagaaggtgcagctgacccccggccagaccgaggtgaagatcgacctgcccctgcccatcgtggccagcaacctgatgatcgagttcgccgacttctacgagaactaccaggccagcaccgagaccctgcagtgccccagatgcagcgccagcgtgcccgccaaccccggcgtgtgcggcaactgcggcgagaacgtgtaccagtgccacaagtgcagaagcatcaactacgacgagaaggaccccttcctgtgcaacgcctgcggcttctgcaagtacgccagattcgacttcatgctgtacgccaagccctgctgcgccgtggaccccatcgagaacgaggaggacagaaagaaggccgtgagcaacatcaacaccctgctggacaaggccgacagagtgtaccaccagctgatgggccacagaccccagctggagaacctgctgtgcaaggtgaacgaggccgcccccgagaagccccaggacgacagcggcaccgccggcggcatcagcagcaccagcgccagcgtgaacagatacatcctgcagctggcccaggagtactgcggcgactgcaagaacagcttcgacgagctgagcaagatcatccagaaggtgttcgccagcagaaaggagctgctggagtacgacctgcagcagagagaggccgccaccaagagcagcagaaccagcgtgcagcccaccttcaccgccagccagtacagagccctgagcgtgctgggctgcggccacaccagcagcaccaagtgctacggctgcgccagcgccgtgaccgagcactgcatcaccctgctgagagccctggccaccaaccccgccctgagacacatcctggtgagccagggcctgatcagagagctgttcgactacaacctgagaagaggcgccgccgccatgagagaggaggtgagacagctgatgtgcctgctgaccagagacaaccccgaggccacccagcagatgaacgacctgatcatcggcaaggtgagcaccgccctgaagggccactgggccaaccccgacctggccagcagcctgcagtacgagatgctgctgctgaccgacagcatcagcaaggaggacagctgctgggagctgagactgagatgcgccctgagcctgttcctgatggccgtgaacatcaagacccccgtggtggtggagaacatcaccctgatgtgcctgagaatcctgcagaagctgatcaagccccccgcccccaccagcaagaagaacaaggacgtgcccgtggaggccctgaccaccgtgaagccctactgcaacgagatccacgcccaggcccagctgtggctgaagagagaccccaaggccagctacgacgcctggaagaagtgcctgcccatcagaggcatcgacggcaacggcaaggcccccagcaagagcgagctgagacacctgtacctgaccgagaagtacgtgtggagatggaagcagttcctgagcagaagaggcaagagaaccagccccctggacctgaagctgggccacaacaactggctgagacaggtgctgttcacccccgccacccaggccgccagacaggccgcctgcaccatcgtggaggccctggccaccatccccagcagaaagcagcaggtgctggacctgctgaccagctacctggacgagctgagcatcgccggcgagtgcgccgccgagtacctggccctgtaccagaagctgatcaccagcgcccactggaaggtgtacctggccgccagaggcgtgctgccctacgtgggcaacctgatcaccaaggagatcgccagactgctggccctggaggaggccaccctgagcaccgacctgcagcagggctacgccctgaagagcctgaccggcctgctgagcagcttcgtggaggtggagagcatcaagagacacttcaagagcagactggtgggcaccgtgctgaacggctacctgtgcctgagaaagctggtggtgcagagaaccaagctgatcgacgagacccaggacatgctgctggagatgctggaggacatgaccaccggcaccgagagcgagaccaaggccttcatggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagctgctggtgaacaacaagatcatcagcctggacctgcccgtggccgaggtgtacaagaaggtgtggtgcaccaccaacgagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaagcagaccacccccaccgtgggcggcatcgacaccggcagcctggagccctgcgtgtgcgagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23746 - DNA, 6177 bp, Artificial Sequence
  Description of Artificial Sequence: Synthetic coding sequence
ctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagcagcgagaccgagagcctgaccaagctggacagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcaggcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaagtag

SEQ ID NO: 23747 - DNA, 5019 bp, Artificial Sequence
  Description of Artificial Sequence: Synthetic coding sequence
agattcctgagcaccatgaagcagaacgccctgcagggcgtggtgcccagcgagaccgaggacctgaacgtggagcacctgcagatgctgctgctgatcttccacaacttcaccgagaccggcagaagagccatcctgagcctgttcgtgcagatcatccaggagctgagcgtgaacatggacgcccagatgagattcgtgcccctgatcctggccagactgctgctgatcttcgactacctgctgcaccagtacagcaaggcccccgtgtacctgttcgagcaggtgcagcacaacctgctgagcccccccttcggctgggccagcggcagccaggacagcaacagcagaagagccaccacccccctgtaccacggcttcaaggaggtggaggagaactggagcaagcacttcagcagcgacgccgtgccccaccccagattctactgcgtgctgagccccgaggccagcgaggacgacctgaacagactggacagcgtggcctgcgacgtgctgttcagcaagctggtgaagtacgacgagctgtacgccgccctgaccgccctgctggccgccggcagccagctggacaccgtgagaagaaaggagaacaagaacgtgaccgccctggaggcctgcgccctgcagtactacttcctgatcctgtggagaatcctgggcatcctgccccccagcaagacctacatcaaccagctgagcatgaacagccccgagatgagcgagtgcgacatcctgcacaccctgagatggagcagcagactgagaatcagcagctacgtgaactggatcaaggaccacctgatcaagcagggcatgaaggccgagcacgccagcagcctgctggagctggccagcaccaccaagtgcagcagcgtgaagtacgacgtggagatcgtggaggagtacttcgccagacagatcagcagcttctgcagcatcgactgcaccaccatcctgcagctgcacgagatccccagcctgcagagcatctacaccctggacgccgccatcagcaaggtgcaggtgagcctggacgagcacttcagcaagatggccgccgagaccgacccccacaagagcagcgagatcaccaagaacctgctgcccgccaccctgcagctgatcgacacctacgccagcttcaccagagcctacctgctgcagaacttcaacgaggagggcaccaccgagaagcccagcaaggagaagctgcagggcttcgccgccgtgctggccatcggcagcagcagatgcaaggccaacaccctgggccccaccctggtgcagaacctgcccagcagcgtgcagaccgtgtgcgagagctggaacaacatcaacaccaacgagttccccaacatcggcagctggagaaacgccttcgccaacgacaccatccccagcgagagctacatcagcgccgtgcaggccgcccacctgggcaccctgtgcagccagagcctgcccctggccgccagcctgaagcacaccctgctgagcctggtgagactgaccggcgacctgatcgtgtggagcgacgagatgaaccccccccaggtgatcagaaccctgctgcccctgctgctggagagcagcaccgagagcgtggccgagatcagcagcaacagcctggagagaatcctgggccccgccgagagcgacgagttcctggccagagtgtacgagaagctgatcaccggctgctacaacatcctggccaaccacgccgaccccaacagcggcctggacgagagcatcctggaggagtgcctgcagtacctggagaagcagctggagagcagccaggccagaaaggccatggaggagttcttcagcgacagcggcgagctggtgcagatcatgatggccaccgccaacgagaacctgagcgccaagttctgcaacagagtgctgaagttcttcaccaagctgttccagctgaccgagaagagccccaaccccagcctgctgcacctgtgcggcagcctggcccagctggcctgcgtggagcccgtgagactgcaggcctggctgaccagaatgaccaccagcccccccaaggacagcgaccagctggacgtgatccaggagaacagacagctgctgcagctgctgaccacctacatcgtgagagagaacagccaggtgggcgagggcgtgtgcgccgtgctgctgggcaccctgacccccatggccaccgagatgctggccaacggcgacggcaccggcttccccgagctgatggtggtgatggccaccctggccagcgccggccagggcgccggccacctgcagctgcacaacgccgccgtggactggctgagcagatgcaagaagtacctgagccagaagaacgtggtggagaagctgaacgccaacgtgatgcacggcaagcacgtgatgatcctggagtgcacctgccacatcatgagctacctggccgacgtgaccaacgccctgagccagagcaacggccagggccccagccacctgagcgtggacggcgaggagagagccatcgaggtggacagcgactgggtggaggagctggccgtggaggaggaggacagccaggccgaggacagcgacgaggacagcctgtgcaacaagctgtgcaccttcaccatcacccagaaggagttcatgaaccagcactggtaccactgccacacctgcaagatggtggacggcgtgggcgtgtgcaccgtgtgcgccaaggtgtgccacaaggaccacgagatcagctacgccaagtacggcagcttcttctgcgactgcggcgccaaggaggacggcagctgcctggccctggtgaagagaacccccagcagcggcatgagcagcaccatgaaggagagcgccttccagagcgagcccagaatcagcgagagcctggtgagacacgccagcaccagcagccccgccgacaaggccaaggtgaccatcagcgacggcaaggtggccgacgaggagaagcccaagaagagcagcctgtgcagaaccgtggagggctgcagagaggagctgcagaaccaggccaacttcagcttcgcccccctggtgctggacatgctgaacttcctgatggacgccatccagaccaacttccagcaggccagcgccgtgggcagcagcagcagagcccagcaggccctgagcgagctgcacaccgtggagaaggccgtggagatgaccgaccagctgatggtgcccaccctgggcagccaggagggcgccttcgagaacgtgagaatgaactacagcggcgaccagggccagaccatcagacagctgatcagcgcccacgtgctgagaagagtggccatgtgcgtgctgagcagcccccacggcagaagacagcacctggccgtgagccacgagaagggcaagatcaccgtgctgcagctgagcgccctgctgaagcaggccgacagcagcaagagaaagctgaccctgaccagactggccagcgcccccgtgcccttcaccgtgctgagcctgaccggcaacccctgcaaggaggactacctggccgtgtgcggcctgaaggactgccacgtgctgaccttcagcagcagcggcagcgtgagcgaccacctggtgctgcacccccagctggccaccggcaacttcatcatcaaggccgtgtggctgcccggcagccagaccgagctggccatcgtgaccgccgacttcgtgaagatctacgacctgtgcgtggacgccctgagccccaccttctacttcctgctgcccagcagcaagatcagagacgtgaccttcctgttcaacgaggagggcaagaacatcatcgtgatcatgagcagcgccggctacatctacacccagctgatggaggaggccagcagcgcccagcagggccccttctacgtgaccaacgtgctggagatcaaccacgaggacctgaagcaggacagcaacagccaggtggccggcggcggcgtgagcgtgtactacagccacgtgctgcagatgctgttcttcagctactgccagggcaagagcttcgccgccaccatcagcagaaccaccctggaggtgctgcagctgttccccatcaacatcaagagcagcaacggcggcagcaagaccagccccgccctgtgccagtggagcgaggtgatgaaccaccccggcctggtgtgctgcgtgcagcagaccaccggcgtgcccctggtggtgatggtgaagcccgacaccttcctgatccaggagatcaagaccctgcccgccaaggccaagatccaggacatggtggccatcagacacaccgcctgcaacgagcagcagagaaccaccatgatcctgctgtgcgaggacggcagcctgagaatctacatggccaacgtggagaacaccagctactggctgcagcccagcctgcagcccagcagcgtgatcagcatcatgaagcccgtgagaaagagaaagaccgccaccatcaccaccagaaccagcagccaggtgaccttccccatcgacttcttcgagcacaaccagcagctgaccgacgtggagttcggcggcaacgacctgctgcaggtgtacaacgcccagcagatcaagcacagactgaacagcaccggcatgtacgtggccaacaccaagcccggcggcttcaccatcgagatcagcaacaacaacagcaccatggtgatgaccggcatgagaatccagatcggcacccaggccatcgagagagcccccagctacatcgagatcttcggcagaaccatgcagctgaacctgagcagaagcagatggttcgacttccccttcaccagagaggaggccctgcaggccgacaagaagctgaacctgttcagcgagagccccacccccggcgccgacagcgtgctgatcgtgaccgccaagctgggcgccaccggcctgtggctgagcaacatcctgggcagcctgcacagcgccgacttcagcgtgctgagcagcggcaacttcgagctgcacctgatgtactag

SEQ ID NO: 23748 - DNA, 2955 bp, Artificial Sequence
  Description of Artificial Sequence: Synthetic coding sequence
gacttccccttcaccagagaggaggccctgcaggccgacaagaagctgaacctgttcatcggcgccagcgtggaccccgccggcgtgaccatgatcgacgccgtgaagatctacggcaagaccaaggagcagttcggctggcccgacgagccccccgaggagttccccagcgccagcgtgagcaacatctgccccagcaacctgaaccagagcaacggcaccggcgacagcgacagcgccgcccccaccaccaccagcggcaccgtgctggagagactggtggtgagcagcctggaggccctggagagctgcttcgccgtgggccccatcatcgagaaggagagaaacaagaacgccgcccaggagctggccaccctgctgctgagcctgcccgcccccgccagcgtgcagcagcagagcaagagcctgctggccagcctgcacaccagcagaagcgcctaccacagccacaaggaccaggccctgctgagcaaggccgtgcagtgcctgaacaccagcagcaaggagggcaaggacctggaccccgaggtgttccagagactggtgatcaccgccagaagcatcgccatcatgagacccaacaacctggtgcacttcaccgagagcaagctgccccagatggagaccgactgcttcttccccagatgcgcctgctggagcctgggcatcgtgggcatcctgatcggcgcccccctggagacccccagccccgagggcatggacgagggcaaggagccccagaagcagctggagggcgactgctgcagcttcatcacccagctggtgaaccacttctggaagctgcacgccagcaagcccaagaacgccttcctggcccccgcctgcctgcccggcctgacccacatcgaggccaccgtgaacgccctggtggacatcatccacggctactgcacctgcgagctggactgcatcaacaccgccagcaagatctacatgcagatgctgctgtgccccgaccccgccgtgagcttcagctgcaagcaggccctgatcagagtgctgagacccagaaacaagagaagacacgtgaccctgcccagcagccccagaagcaacacccccatgggcgacaaggacgacgacgacgacgacgacgccgacgagaagatgcagagcagcggcatccccaacggcggccacatcagacaggagagccaggagcagagcgaggtggaccacggcgacttcgagatggtgagcgagagcatggtgctggagaccgccgagaacgtgaacaacggcaaccccagccccctggaggccctgctggccggcgccgagggcttcccccccatgctggacatcccccccgacgccgacgacgagaccatggtggagctggccatcgccctgagcctgcagcaggaccagcaggcccccgccagcgacgacgagggcagcaccgccgccaccgacggcagcaccctgagaaccagccccgccgaccacggcggcagcgtgggcagcgagagcggcggcagcgccgtggacagcgtggccggcgagcacagcgtgagcggcagaagcagcgcctacggcgacgccaccgccgagggccaccccgccggccccggcagcgtgagcagcagcaccggcgccatcagcaccaccaccggccaccaggagggcgacggcagcgagggcgagggcgagggcgagaccgagggcgacgtgcacaccagcaacagactgcacatggtgagactgatgctgctggagagactgctgcagaccctgccccagctgagaaacgtgggcggcgtgagagccatcccctacatgcaggtgatcctgatgctgaccaccgacctggacggcgaggacgagaaggacaagggcgccctggacaacctgctgagccagctgatcgccgagctgggcatggacaagaaggacgtgagcaagaagaacgagagaagcgccctgaacgaggtgcacctggtggtgatgagactgctgagcgtgttcatgagcagaaccaagagcggcagcaagagcagcatctgcgagagcagcagcctgatcagcagcgccaccgccgccgccctgctgagcagcggcgccgtggactactgcctgcacgtgctgaagagcctgctggagtactggaagagccagcagaacgacgaggagcccgtggccaccagccagctgctgaagccccacaccaccagcagcccccccgacatgagccccttcttcctgagacagtacgtgaagggccacgccgccgacgtgttcgaggcctacacccagctgctgaccgagatggtgctgagactgccctaccagatcaagaagatcaccgacaccaacagcagaatccccccccccgtgttcgaccacagctggttctacttcctgagcgagtacctgatgatccagcagacccccttcgtgagaagacaggtgagaaagctgctgctgttcatctgcggcagcaaggagaagtacagacagctgagagacctgcacaccctggacagccacgtgagaggcatcaagaagctgctggaggagcagggcatcttcctgagagccagcgtggtgaccgccagcagcggcagcgccctgcagtacgacaccctgatcagcctgatggagcacctgaaggcctgcgccgagatcgccgcccagagaaccatcaactggcagaagttctgcatcaaggacgacagcgtgctgtacttcctgctgcaggtgagcttcctggtggacgagggcgtgagccccgtgctgctgcagctgctgagctgcgccctgtgcggcagcaaggtgctggccgccctggccgccagcagcggcagcagcagcgccagcagcagcagcgcccccgtggccgccagcagcggccaggccaccacccagagcaagagcagcaccaagaagagcaagaaggaggagaaggagtag

SEQ ID NO: 23749 - DNA, 2121 bp, Artificial Sequence
  Description of Artificial Sequence: Synthetic coding sequence
atgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctgggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23750 - DNA, 2544 bp, Artificial Sequence
  Description of Artificial Sequence: Synthetic coding sequence
atggccgtgtgcatcgagaccgccaagagatacaacctggacgactacagaacccccgtgttcatcttcgagagactgtgcagcatcatctaccccgaggagaacgaggtgaccgagttcttcgtgaccctggagaaggacccccagcaggaggacttcctgcagggcagaatgcccggcaacccctacagcagcaacgagcccggcatcggccccctgatgagagacatcaagaacaagatctgccaggactgcgacctggtggccctgctggaggacgacagcggcatggagggcgagcccatgagaatcgtgtacagaatgagaggcctgctgggcgacgccaccgaggagttcatcgagagcctggacagcaccaccgacgaggaggaggacgaggaggaggtgtacaagatggccggcgtgatggcccagtgcggcggcctggagtgcatgctgaacagactggccggcatcagagacttcaagcagggcagacacctgctgaccgtgctgctgaagctgttcagctactgcgtgaaggtgaaggtgaacagacagcagctggtgaagctggagatgaacaccctgaacgtgatgctgggcaccctgaacctggccctggtggccgagcaggagagcaaggacagcggcggcgccgccgtggccgagcaggtgctgagcatcatggagatcatcctggacgagagcaacgccgagcccctgagcgaggacaagggcaacctgctgctgaccggcgacaaggaccagctggtgatgctgctggaccagatcaacagcaccttcgtgagaagcaaccccagcgtgctgcagggcctgctgagaatcatcccctacctgagcttcggcgaggtggagaagatgcagatcctggtggagagattcaagccctactgcaacttcgacaagtacgacgaggaccacagcggcgacgacaaggtgttcctggactgcttctgcaagatcgccgccggcatcaagaacaacagcaacggccaccagctgaaggacctgatcctgcagaagggcatcacccagaacgccctggactacatgaagaagcacatccccagcgccaagaacctggacgccgacatctggaagaagttcctgagcagacccgccctgcccttcatcctgagactgctgagaggcctggccatccagcaccccggcacccaggtgctgatcggcaccgacagcatccccaacctgcacaagctggagcaggtgagcagcgacgagggcatcggcaccctggccgagaacctgctggaggccctgagagagcaccccgacgtgaacaagaagatcgacgccgccagaagagagaccagagccgagaagaagagaatggccatggccatgagacagaaggccctgggcaccctgggcatgaccaccaacgagaagggccaggtggtgaccaagaccgccctgctgaagcagatggaggagctgatcgaggagcccggcctgacctgctgcatctgcagagagggctacaagttccagcccaccaaggtgctgggcatctacaccttcaccaagagagtggccctggaggagatggagaacaagcccagaaagcagcagggctacagcaccgtgagccacttcaacatcgtgcactacgactgccacctggccgccgtgagactggccagaggcagagaggagtgggagagcgccgccctgcagaacgccaacaccaagtgcaacggcctgctgcccgtgtggggcccccacgtgcccgagagcgccttcgccacctgcctggccagacacaacacctacctgcaggagtgcaccggccagagagagcccacctaccagctgaacatccacgacatcaagctgctgttcctgagattcgccatggagcagagcttcagcgccgacaccggcggcggcggcagagagagcaacatccacctgatcccctacatcatccacaccgtgctgtacgtgctgaacaccaccagagccaccagcagagaggagaagaacctgcagggcttcctggagcagcccaaggagaagtgggtggagagcgccttcgaggtggacggcccctactacttcaccgtgctggccctgcacatcctgccccccgagcagtggagagccaccagagtggagatcctgagaagactgctggtgaccagccaggccagagccgtggcccccggcggcgccaccagactgaccgacaaggccgtgaaggactacagcgcctacagaagcagcctgctgttctgggccctggtggacctgatctacaacatgttcaagaaggtgcccaccagcaacaccgagggcggctggagctgcagcctggccgagtacatcagacacaacgacatgcccatctacgaggccgccgacaaggccctgaagaccttccaggaggagttcatgcccgtggagaccttcagcgagttcctggacgtggccggcctgctgagcgagatcaccgaccccgagagcttcctgaaggacctgctgaacagcgtgccctag

SEQ ID NO: 23751 - DNA, 3957 bp, Artificial Sequence
  Description of Artificial Sequence: Synthetic coding sequence
atgagcggcggcgccagcgccaccggccccagaagaggcccccccggcctggaggacaccaccagcaagaagaagcagaaggacagagccaaccaggagagcaaggacggcgaccccagaaaggagaccggcagcagatacgtggcccaggccggcctggagcccctggccagcggcgaccccagcgccagcgccagccacgccgccggcatcaccggcagcagacacagaaccagactgttcttccccagcagcagcggcagcgccagcaccccccaggaggagcagaccaaggagggcgcctgcgaggacccccacgacctgctggccacccccacccccgagctgctgctggactggagacagagcgccgaggaggtgatcgtgaagctgagagtgggcgtgggccccctgcagctggaggacgtggacgccgccttcaccgacaccgactgcgtggtgagattcgccggcggccagcagtggggcggcgtgttctacgccgagatcaagagcagctgcgccaaggtgcagaccagaaagggcagcctgctgcacctgaccctgcccaagaaggtgcccatgctgacctggcccagcctgctggtggaggccgacgagcagctgtgcatcccccccctgaacagccagacctgcctgctgggcagcgaggagaacctggcccccctggccggcgagaaggccgtgccccccggcaacgaccccgtgagccccgccatggtgagaagcagaaaccccggcaaggacgactgcgccaaggaggagatggccgtggccgccgacgccgccaccctggtggacgagcccgagagcatggtgaacctggccttcgtgaagaacgacagctacgagaagggccccgacagcgtggtggtgcacgtgtacgtgaaggagatctgcagagacaccagcagagtgctgttcagagagcaggacttcaccctgatcttccagaccagagacggcaacttcctgagactgcaccccggctgcggcccccacaccaccttcagatggcaggtgaagctgagaaacctgatcgagcccgagcagtgcaccttctgcttcaccgccagcagaatcgacatctgcctgagaaagagacagagccagagatggggcggcctggaggcccccgccgccagagtgggcggcgccaaggtggccgtgcccaccggccccacccccctggacagcaccccccccggcggcgccccccaccccctgaccggccaggaggaggccagagccgtggagaaggacaagagcaaggccagaagcgaggacaccggcctggacagcgtggccaccagaacccccatggagcacgtgacccccaagcccgagacccacctggccagccccaagcccacctgcatggtgccccccatgccccacagccccgtgagcggcgacagcgtggaggaggaggaggaggaggagaagaaggtgtgcctgcccggcttcaccggcctggtgaacctgggcaacacctgcttcatgaacagcgtgatccagagcctgagcaacaccagagagctgagagacttcttccacgacagaagcttcgaggccgagatcaactacaacaaccccctgggcaccggcggcagactggccatcggcttcgccgtgctgctgagagccctgtggaagggcacccaccacgccttccagcccagcaagctgaaggccatcgtggccagcaaggccagccagttcaccggctacgcccagcacgacgcccaggagttcatggccttcctgctggacggcctgcacgaggacctgaacagaatccagaacaagccctacaccgagaccgtggacagcgacggcagacccgacgaggtggtggccgaggaggcctggcagagacacaagatgagaaacgacagcttcatcgtggacctgttccagggccagtacaagagcaagctggtgtgccccgtgtgcgccaaggtgagcatcaccttcgaccccttcctgtacctgcccgtgcccctgccccagaagcagaaggtgctgcccgtgttctacttcgccagagagccccacagcaagcccatcaagttcctggtgagcgtgagcaaggagaacagcaccgccagcgaggtgctggacagcctgagccagagcgtgcacgtgaagcccgagaacctgagactggccgaggtgatcaagaacagattccacagagtgttcctgcccagccacagcctggacaccgtgagccccagcgacaccctgctgtgcttcgagctgctgagcagcgagctggccaaggagagagtggtggtgctggaggtgcagcagagaccccaggtgcccagcgtgcccatcagcaagtgcgccgcctgccagagaaagcagcagagcgaggacgagaagctgaagagatgcaccagatgctacagagtgggctactgcaaccagctgtgccagaagacccactggcccgaccacaagggcctgtgcagacccgagaacatcggctaccccttcctggtgagcgtgcccgccagcagactgacctacgccagactggcccagctgctggagggctacgccagatacagcgtgagcgtgttccagccccccttccagcccggcagaatggccctggagagccagagccccggctgcaccaccctgctgagcaccggcagcctggaggccggcgacagcgagagagaccccatccagccccccgagctgcagctggtgacccccatggccgagggcgacaccggcctgcccagagtgtgggccgcccccgacagaggccccgtgcccagcaccagcggcatcagcagcgagatgctggccagcggccccatcgaggtgggcagcctgcccgccggcgagagagtgagcagacccgaggccgccgtgcccggctaccagcaccccagcgaggccatgaacgcccacaccccccagttcttcatctacaagatcgacagcagcaacagagagcagagactggaggacaagggcgacacccccctggagctgggcgacgactgcagcctggccctggtgtggagaaacaacgagagactgcaggagttcgtgctggtggccagcaaggagctggagtgcgccgaggaccccggcagcgccggcgaggccgccagagccggccacttcaccctggaccagtgcctgaacctgttcaccagacccgaggtgctggcccccgaggaggcctggtactgcccccagtgcaagcagcacagagaggccagcaagcagctgctgctgtggagactgcccaacgtgctgatcgtgcagctgaagagattcagcttcagaagcttcatctggagagacaagatcaacgacctggtggagttccccgtgagaaacctggacctgagcaagttctgcatcggccagaaggaggagcagctgcccagctacgacctgtacgccgtgatcaaccactacggcggcatgatcggcggccactacaccgcctgcgccagactgcccaacgacagaagcagccagagaagcgacgtgggctggagactgttcgacgacagcaccgtgaccaccgtggacgagagccaggtggtgaccagatacgcctacgtgctgttctacagaagaagaaacagccccgtggagagaccccccagagccggccacagcgagcaccaccccgacctgggccccgccgccgaggccgccgccagccaggccagcagaatctggcaggagctggaggccgaggaggagcccgtgcccgagggcagcggccccctgggcccctggggcccccaggactgggtgggccccctgcccagaggccccaccacccccgacgagggctgcctgagatacttcgtgctgggcaccgtggccgccctggtggccctggtgctgaacgtgttctaccccctggtgagccagagcagatggagatag

SEQ ID NO: 23752 - DNA, 1548 bp, Artificial Sequence
  Description of Artificial Sequence: Synthetic coding sequence
atgagcggcggcgccagcgccaccggccccagaagaggcccccccggcctggaggacaccaccagcaagaagaagcagaaggacagagccaaccaggagagcaaggacggcgaccccagaaaggagaccggcagcagatacgtggcccaggccggcctggagcccctggccagcggcgaccccagcgccagcgccagccacgccgccggcatcaccggcagcagacacagaaccagactgttcttccccagcagcagcggcagcgccagcaccccccaggaggagcagaccaaggaggagctgctgctggactggagacagagcgccgaggaggtgatcgtgaagctgagagtgggcgtgggccccctgcagctggaggacgtggacgccgccttcaccgacaccgactgcgtggtgagattcgccggcggccagcagtggggcggcgtgttctacgccgagatcaagagcagctgcgccaaggtgcagaccagaaagggcagcctgctgcacctgaccctgcccaagaaggtgcccatgctgacctggcccagcctgctgaagaagcccctgggcacccaggagctggtgcccggcctgagatgccaggagaacggccaggagctgagccccatcgccctggagcccggccccgagccccacagagccaagcaggaggccagaaaccagaagagagcccagggcagaggcgaggtgggcgccggcgccggccccggcgcccaggccggccccagcgccaagagagccgtgcacctgtgcagaggccccgagggcgacggcagcagagacgaccccggccccagaggcgacgccccccccttcgtggccgaccccgccacccaggtggaggccgacgagcagctgtgcatcccccccctgaacagccagacctgcctgctgggcagcgaggagaacctggcccccctggccggcgagaaggccgtgccccccggcaacgaccccgtgagccccgccatggtgagaagcagaaaccccggcaaggacgactgcgccaaggaggagatggccgtggccgccgacgccgccaccctggtggacgagcccgagagcatggtgaacctggccttcgtgaagaacgacagctacgagaagggccccgacagcgtggtggtgcacgtgtacgtgaaggagatctgcagagacaccagcagagtgctgttcagagagcaggacttcaccctgatcttccagaccagagacggcaacttcctgagactgcaccccggctgcggcccccacaccaccttcagatggcaggtgaagctgagaaacctgatcgagcccgagcagtgcaccttctgcttcaccgccagcagaatcgacatctgcctgagaaagagacagagccagagatggggccccggcggccccggctgcaccagatgcagcggctggtgcaagggctgcagagccgacagaagcaaccccagcggcttcaaccccaccagaagatgcagccccccccccgacagacccggcggcggccccggctgcggcgagggctag

SEQ ID NO: 23753 - DNA, 4155 bp, Artificial Sequence
  Description of Artificial Sequence: Synthetic coding sequence
atgagcggcggcgccagcgccaccggccccagaagaggcccccccggcctggaggacaccaccagcaagaagaagcagaaggacagagccaaccaggagagcaaggacggcgaccccagaaaggagaccggcagcagatacgtggcccaggccggcctggagcccctggccagcggcgaccccagcgccagcgccagccacgccgccggcatcaccggcagcagacacagaaccagactgttcttccccagcagcagcggcagcgccagcaccccccaggaggagcagaccaaggagggcgcctgcgaggacccccacgacctgctggccacccccacccccgagctgctgctggactggagacagagcgccgaggaggtgatcgtgaagctgagagtgggcgtgggccccctgcagctggaggacgtggacgccgccttcaccgacaccgactgcgtggtgagattcgccggcggccagcagtggggcggcgtgttctacgccgagatcaagagcagctgcgccaaggtgcagaccagaaagggcagcctgctgcacctgaccctgcccaagaaggtgcccatgctgacctggcccagcctgctgaagaagcccctgggcacccaggagctggtgcccggcctgagatgccaggagaacggccaggagctgagccccatcgccctggagcccggccccgagccccacagagccaagcaggaggccagaaaccagaagagagcccagggcagaggcgaggtgggcgccggcgccggccccggcgcccaggccggccccagcgccaagagagccgtgcacctgtgcagaggccccgagggcgacggcagcagagacgaccccggccccagaggcgacgccccccccttcgtggccgaccccgccacccaggtggaggccgacgagcagctgtgcatcccccccctgaacagccagacctgcctgctgggcagcgaggagaacctggcccccctggccggcgagaaggccgtgccccccggcaacgaccccgtgagccccgccatggtgagaagcagaaaccccggcaaggacgactgcgccaaggaggagatggccgtggccgccgacgccgccaccctggtggacgagcccgagagcatggtgaacctggccttcgtgaagaacgacagctacgagaagggccccgacagcgtggtggtgcacgtgtacgtgaaggagatctgcagagacaccagcagagtgctgttcagagagcaggacttcaccctgatcttccagaccagagacggcaacttcctgagactgcaccccggctgcggcccccacaccaccttcagatggcaggtgaagctgagaaacctgatcgagcccgagcagtgcaccttctgcttcaccgccagcagaatcgacatctgcctgagaaagagacagagccagagatggggcggcctggaggcccccgccgccagaggcgccgtgggcggcgccaaggtggccgtgcccaccggccccacccccctggacagcaccccccccggcggcgccccccaccccctgaccggccaggaggaggccagagccgtggagaaggacaagagcaaggccagaagcgaggacaccggcctggacagcgtggccaccagaacccccatggagcacgtgacccccaagcccgagacccacctggccagccccaagcccacctgcatggtgccccccatgccccacagccccgtgagcggcgacagcgtggaggaggaggaggaggaggagaagaaggtgtgcctgcccggcttcaccggcctggtgaacctgggcaacacctgcttcatgaacagcgtgatccagagcctgagcaacaccagagagctgagagacttcttccacgacagaagcttcgaggccgagatcaactacaacaaccccctgggcaccggcggcagactggccatcggcttcgccgtgctgctgagagccctgtggaagggcacccaccacgccttccagcccagcaagctgaaggccatcgtggccagcaaggccagccagttcaccggctacgcccagcacgacgcccaggagttcatggccttcctgctggacggcctgcacgaggacctgaacagaatccagaacaagccctacaccgagaccgtggacagcgacggcagacccgacgaggtggtggccgaggaggcctggcagagacacaagatgagaaacgacagcttcatcgtggacctgttccagggccagtacaagagcaagctggtgtgccccgtgtgcgccaaggtgagcatcaccttcgaccccttcctgtacctgcccgtgcccctgccccagaagcagaaggtgctgcccgtgttctacttcgccagagagccccacagcaagcccatcaagttcctggtgagcgtgagcaaggagaacagcaccgccagcgaggtgctggacagcctgagccagagcgtgcacgtgaagcccgagaacctgagactggccgaggtgatcaagaacagattccacagagtgttcctgcccagccacagcctggacaccgtgagccccagcgacaccctgctgtgcttcgagctgctgagcagcgagctggccaaggagagagtggtggtgctggaggtgcagcagagaccccaggtgcccagcgtgcccatcagcaagtgcgccgcctgccagagaaagcagcagagcgaggacgagaagctgaagagatgcaccagatgctacagagtgggctactgcaaccagctgtgccagaagacccactggcccgaccacaagggcctgtgcagacccgagaacatcggctaccccttcctggtgagcgtgcccgccagcagactgacctacgccagactggcccagctgctggagggctacgccagatacagcgtgagcgtgttccagccccccttccagcccggcagaatggccctggagagccagagccccggctgcaccaccctgctgagcaccggcagcctggaggccggcgacagcgagagagaccccatccagccccccgagctgcagctggtgacccccatggccgagggcgacaccggcctgcccagagtgtgggccgcccccgacagaggccccgtgcccagcaccagcggcatcagcagcgagatgctggccagcggccccatcgaggtgggcagcctgcccgccggcgagagagtgagcagacccgaggccgccgtgcccggctaccagcaccccagcgaggccatgaacgcccacaccccccagttcttcatctacaagatcgacagcagcaacagagagcagagactggaggacaagggcgacacccccctggagctgggcgacgactgcagcctggccctggtgtggagaaacaacgagagactgcaggagttcgtgctggtggccagcaaggagctggagtgcgccgaggaccccggcagcgccggcgaggccgccagagccggccacttcaccctggaccagtgcctgaacctgttcaccagacccgaggtgctggcccccgaggaggcctggtactgcccccagtgcaagcagcacagagaggccagcaagcagctgctgctgtggagactgcccaacgtgctgatcgtgcagctgaagagattcagcttcagaagcttcatctggagagacaagatcaacgacctggtggagttccccgtgagaaacctggacctgagcaagttctgcatcggccagaaggaggagcagctgcccagctacgacctgtacgccgtgatcaaccactacggcggcatgatcggcggccactacaccgcctgcgccagactgcccaacgacagaagcagccagagaagcgacgtgggctggagactgttcgacgacagcaccgtgaccaccgtggacgagagccaggtggtgaccagatacgcctacgtgctgttctacagaagaagaaacagccccgtggagagaccccccagagccggccacagcgagcaccaccccgacctgggccccgccgccgaggccgccgccagccagggcctgggccccggccaggcccccgaggtggcccccaccagaaccgcccccgagagattcgccccccccgtggacagacccgcccccacctacagcaacatggaggaggtggactag

SEQ ID NO: 23754 - DNA, 4260 bp, Artificial Sequence
  Description of Artificial Sequence: Synthetic coding sequence
atgagcggcggcgccagcgccaccggccccagaagaggcccccccggcctggaggacaccaccagcaagaagaagcagaaggacagagccaaccaggagagcaaggacggcgaccccagaaaggagaccggcagcagatacgtggcccaggccggcctggagcccctggccagcggcgaccccagcgccagcgccagccacgccgccggcatcaccggcagcagacacagaaccagactgttcttccccagcagcagcggcagcgccagcaccccccaggaggagcagaccaaggagggcgcctgcgaggacccccacgacctgctggccacccccacccccgagctgctgctggactggagacagagcgccgaggaggtgatcgtgaagctgagagtgggcgtgggccccctgcagctggaggacgtggacgccgccttcaccgacaccgactgcgtggtgagattcgccggcggccagcagtggggcggcgtgttctacgccgagatcaagagcagctgcgccaaggtgcagaccagaaagggcagcctgctgcacctgaccctgcccaagaaggtgcccatgctgacctggcccagcctgctgaagaagcccctgggcacccaggagctggtgcccggcctgagatgccaggagaacggccaggagctgagccccatcgccctggagcccggccccgagccccacagagccaagcaggaggccagaaaccagaagagagcccagggcagaggcgaggtgggcgccggcgccggccccggcgcccaggccggccccagcgccaagagagccgtgcacctgtgcagaggccccgagggcgacggcagcagagacgaccccggccccagaggcgacgccccccccttcgtggccgaccccgccacccaggtggaggccgacgagcagctgtgcatcccccccctgaacagccagacctgcctgctgggcagcgaggagaacctggcccccctggccggcgagaaggccgtgccccccggcaacgaccccgtgagccccgccatggtgagaagcagaaaccccggcaaggacgactgcgccaaggaggagatggccgtggccgccgacgccgccaccctggtggacgagcccgagagcatggtgaacctggccttcgtgaagaacgacagctacgagaagggccccgacagcgtggtggtgcacgtgtacgtgaaggagatctgcagagacaccagcagagtgctgttcagagagcaggacttcaccctgatcttccagaccagagacggcaacttcctgagactgcaccccggctgcggcccccacaccaccttcagatggcaggtgaagctgagaaacctgatcgagcccgagcagtgcaccttctgcttcaccgccagcagaatcgacatctgcctgagaaagagacagagccagagatggggcggcctggaggcccccgccgccagagtgggcggcgccaaggtggccgtgcccaccggccccacccccctggacagcaccccccccggcggcgccccccaccccctgaccggccaggaggaggccagagccgtggagaaggacaagagcaaggccagaagcgaggacaccggcctggacagcgtggccaccagaacccccatggagcacgtgacccccaagcccgagacccacctggccagccccaagcccacctgcatggtgccccccatgccccacagccccgtgagcggcgacagcgtggaggaggaggaggaggaggagaagaaggtgtgcctgcccggcttcaccggcctggtgaacctgggcaacacctgcttcatgaacagcgtgatccagagcctgagcaacaccagagagctgagagacttcttccacgacagaagcttcgaggccgagatcaactacaacaaccccctgggcaccggcggcagactggccatcggcttcgccgtgctgctgagagccctgtggaagggcacccaccacgccttccagcccagcaagctgaaggccatcgtggccagcaaggccagccagttcaccggctacgcccagcacgacgcccaggagttcatggccttcctgctggacggcctgcacgaggacctgaacagaatccagaacaagccctacaccgagaccgtggacagcgacggcagacccgacgaggtggtggccgaggaggcctggcagagacacaagatgagaaacgacagcttcatcgtggacctgttccagggccagtacaagagcaagctggtgtgccccgtgtgcgccaaggtgagcatcaccttcgaccccttcctgtacctgcccgtgcccctgccccagaagcagaaggtgctgcccgtgttctacttcgccagagagccccacagcaagcccatcaagttcctggtgagcgtgagcaaggagaacagcaccgccagcgaggtgctggacagcctgagccagagcgtgcacgtgaagcccgagaacctgagactggccgaggtgatcaagaacagattccacagagtgttcctgcccagccacagcctggacaccgtgagccccagcgacaccctgctgtgcttcgagctgctgagcagcgagctggccaaggagagagtggtggtgctggaggtgcagcagagaccccaggtgcccagcgtgcccatcagcaagtgcgccgcctgccagagaaagcagcagagcgaggacgagaagctgaagagatgcaccagatgctacagagtgggctactgcaaccagctgtgccagaagacccactggcccgaccacaagggcctgtgcagacccgagaacatcggctaccccttcctggtgagcgtgcccgccagcagactgacctacgccagactggcccagctgctggagggctacgccagatacagcgtgagcgtgttccagccccccttccagcccggcagaatggccctggagagccagagccccggctgcaccaccctgctgagcaccggcagcctggaggccggcgacagcgagagagaccccatccagccccccgagctgcagctggtgacccccatggccgagggcgacaccggcctgcccagagtgtgggccgcccccgacagaggccccgtgcccagcaccagcggcatcagcagcgagatgctggccagcggccccatcgaggtgggcagcctgcccgccggcgagagagtgagcagacccgaggccgccgtgcccggctaccagcaccccagcgaggccatgaacgcccacaccccccagttcttcatctacaagatcgacagcagcaacagagagcagagactggaggacaagggcgacacccccctggagctgggcgacgactgcagcctggccctggtgtggagaaacaacgagagactgcaggagttcgtgctggtggccagcaaggagctggagtgcgccgaggaccccggcagcgccggcgaggccgccagagccggccacttcaccctggaccagtgcctgaacctgttcaccagacccgaggtgctggcccccgaggaggcctggtactgcccccagtgcaagcagcacagagaggccagcaagcagctgctgctgtggagactgcccaacgtgctgatcgtgcagctgaagagattcagcttcagaagcttcatctggagagacaagatcaacgacctggtggagttccccgtgagaaacctggacctgagcaagttctgcatcggccagaaggaggagcagctgcccagctacgacctgtacgccgtgatcaaccactacggcggcatgatcggcggccactacaccgcctgcgccagactgcccaacgacagaagcagccagagaagcgacgtgggctggagactgttcgacgacagcaccgtgaccaccgtggacgagagccaggtggtgaccagatacgcctacgtgctgttctacagaagaagaaacagccccgtggagagaccccccagagccggccacagcgagcaccaccccgacctgggccccgccgccgaggccgccgccagccaggccagcagaatctggcaggagctggaggccgaggaggagcccgtgcccgagggcagcggccccctgggcccctggggcccccaggactgggtgggccccctgcccagaggccccaccacccccgacgagggctgcctgagatacttcgtgctgggcaccgtggccgccctggtggccctggtgctgaacgtgttctaccccctggtgagccagagcagatggagatag

SEQ ID NO: 23755 - DNA, 4119 bp, Artificial Sequence
  Description of Artificial Sequence: Synthetic coding sequence
atgagcggcggcgccagcgccaccggccccagaagaggcccccccggcctggaggacaccaccagcaagaagaagcagaaggacagagccaaccaggagagcaaggacggcgaccccagaaaggagaccggcagcagatacgtggcccaggccggcctggagcccctggccagcggcgaccccagcgccagcgccagccacgccgccggcatcaccggcagcagacacagaaccagactgttcttccccagcagcagcggcagcgccagcaccccccaggaggagcagaccaaggagggcgcctgcgaggacccccacgacctgctggccacccccacccccgagctgctgctggactggagacagagcgccgaggaggtgatcgtgaagctgagagtgggcgtgggccccctgcagctggaggacgtggacgccgccttcaccgacaccgactgcgtggtgagattcgccggcggccagcagtggggcggcgtgttctacgccgagatcaagagcagctgcgccaaggtgcagaccagaaagggcagcctgctgcacctgaccctgcccaagaagaagaagcccctgggcacccaggagctggtgcccggcctgagatgccaggagaacggccaggagctgagccccatcgccctggagcccggccccgagccccacagagccaagcaggaggccagaaaccagaagagagcccagggcagaggcgaggtgggcgccggcgccggccccggcgcccaggccggccccagcgccaagagagccgtgcacctgtgcagaggccccgagggcgacggcagcagagacgaccccggccccagaggcgacgccccccccttcgtggccgaccccgccacccaggtggaggccgacgagcagctgtgcatcccccccctgaacagccagacctgcctgctgggcagcgaggagaacctggcccccctggccggcgagaaggccgtgccccccggcaacgaccccgtgagccccgccatggtgagaagcagaaaccccggcaaggacgactgcgccaaggaggagatggccgtggccgccgacgccgccaccctggtggacgagcccgagagcatggtgaacctggccttcgtgaagaacgacagctacgagaagggccccgacagcgtggtggtgcacgtgtacgtgaaggagatctgcagagacaccagcagagtgctgttcagagagcaggacttcaccctgatcttccagaccagagacggcaacttcctgagactgcaccccggctgcggcccccacaccaccttcagatggcaggtgaagctgagaaacctgatcgagcccgagcagtgcaccttctgcttcaccgccagcagaatcgacatctgcctgagaaagagacagagccagagatggggcggcctggaggcccccgccgccagagtgggcggcgccaaggtggccgtgcccaccggccccacccccctggacagcaccccccccggcggcgccccccaccccctgaccggccaggaggaggccagagccgtggagaaggacaagagcaaggccagaagcgaggacaccggcctggacagcgtggccaccagaacccccatggagcacgtgacccccaagcccgagacccacctggccagccccaagcccacctgcatggtgccccccatgccccacagccccgtgagcggcgacagcgtggaggaggaggaggaggaggagaagaaggtgtgcctgcccggcttcaccggcctggtgaacctgggcaacacctgcttcatgaacagcgtgatccagagcctgagcaacaccagagagctgagagacttcttccacgacagaagcttcgaggccgagatcaactacaacaaccccctgggcaccggcggcagactggccatcggcttcgccgtgctgctgagagccctgtggaagggcacccaccacgccttccagcccagcaagctgaaggccatcgtggccagcaaggccagccagttcaccggctacgcccagcacgacgcccaggagttcatggccttcctgctggacggcctgcacgaggacctgaacagaatccagaacaagccctacaccgagaccgtggacagcgacggcagacccgacgaggtggtggccgaggaggcctggcagagacacaagatgagaaacgacagcttcatcgtggacctgttccagggccagtacaagagcaagctggtgtgccccgtgtgcgccaaggtgagcatcaccttcgaccccttcctgtacctgcccgtgcccctgccccagaagcagaaggtgctgcccgtgttctacttcgccagagagccccacagcaagcccatcaagttcctggtgagcgtgagcaaggagaacagcaccgccagcgaggtgctggacagcctgagccagagcgtgcacgtgaagcccgagaacctgagactggccgaggtgatcaagaacagattccacagagtgttcctgcccagccacagcctggacaccgtgagccccagcgacaccctgctgtgcttcgagctgctgagcagcgagctggccaaggagagagtggtggtgctggaggtgcagcagagaccccaggtgcccagcgtgcccatcagcaagtgcgccgcctgccagagaaagcagcagagcgaggacgagaagctgaagagatgcaccagatgctacagagtgggctactgcaaccagctgtgccagaagacccactggcccgaccacaagggcctgtgcagacccgagaacatcggctaccccttcctggtgagcgtgcccgccagcagactgacctacgccagactggcccagctgctggagggctacgccagatacagcgtgagcgtgttccagccccccttccagcccggcagaatggccctggagagccagagccccggctgcaccaccctgctgagcaccggcagcctggaggccggcgacagcgagagagaccccatccagccccccgagctgcagctggtgacccccatggccgagggcgacaccggcctgcccagagtgtgggccgcccccgacagaggccccgtgcccagcaccagcggcatcagcagcgagatgctggccagcggccccatcgaggtgggcagcctgcccgccggcgagagagtgagcagacccgaggccgccgtgcccggctaccagcaccccagcgaggccatgaacgcccacaccccccagttcttcatctacaagatcgacagcagcaacagagagcagagactggaggacaagggcgacacccccctggagctgggcgacgactgcagcctggccctggtgtggagaaacaacgagagactgcaggagttcgtgctggtggccagcaaggagctggagtgcgccgaggaccccggcagcgccggcgaggccgccagagccggccacttcaccctggaccagtgcctgaacctgttcaccagacccgaggtgctggcccccgaggaggcctggtactgcccccagtgcaagcagcacagagaggccagcaagcagctgctgctgtggagactgcccaacgtgctgatcgtgcagctgaagagattcagcttcagaagcttcatctggagagacaagatcaacgacctggtggagttccccgtgagaaacctggacctgagcaagttctgcatcggccagaaggaggagcagctgcccagctacgacctgtacgccgtgatcaaccactacggcggcatgatcggcggccactacaccgcctgcgccagactgcccaacgacagaagcagccagagaagcgacgtgggctggagactgttcgacgacagcaccgtgaccaccgtggacgagagccaggtggtgaccagatacgcctacgtgctgttctacagaagaagaaacagccccgtggagagaccccccagagccggccacagcgagcaccaccccgacctgggccccgccgccgaggccgccgccagccagggcctgggccccggccaggcccccgaggtggcccccaccagaaccgcccccgagagattcgccccccccgtggacagacccgcccccacctacagcaacatggaggaggtggactag

SEQ ID NO: 23756 - DNA, 3357 bp, Artificial Sequence
  Description of Artificial Sequence: Synthetic coding sequence
atgcccgccgtggccagcgtgcccaaggagctgtacctgagcagcagcctgaaggacctgaacaagaagaccgaggtgaagcccgagaagatcagcaccaagagctacgtgcacagcgccctgaagatcttcaagaccgccgaggagtgcagactggacagagacgaggagagagcctacgtgctgtacatgaagtacgtgaccgtgtacaacctgatcaagaagagacccgacttcaagcagcagcaggactacttccacagcatcctgggccccggcaacatcaagaaggccgtggaggaggccgagagactgagcgagagcctgaagctgagatacgaggaggccgaggtgagaaagaagctggaggagaaggacagacaggaggaggcccagagactgcagcagaagagacaggagaccggcagagaggacggcggcaccctggccaagggcagcctggagaacgtgctggacagcaaggacaagacccagaagagcaacggcgagaagaacgagaagtgcgagaccaaggagaagggcgccatcaccgccaaggagctgtacaccatgatgaccgacaagaacatcagcctgatcatcatggacgccagaagaatgcaggactaccaggacagctgcatcctgcacagcctgagcgtgcccgaggaggccatcagccccggcgtgaccgccagctggatcgaggcccacctgcccgacgacagcaaggacacctggaagaagagaggcaacgtggagtacgtggtgctgctggactggttcagcagcgccaaggacctgcagatcggcaccaccctgagaagcctgaaggacgccctgttcaagtgggagagcaagaccgtgctgagaaacgagcccctggtgctggagggcggctacgagaactggctgctgtgctacccccagtacaccaccaacgccaaggtgacccccccccccagaagacagaacgaggaggtgagcatcagcctggacttcacctaccccagcctggaggagagcatccccagcaagcccgccgcccagaccccccccgccagcatcgaggtggacgagaacatcgagctgatcagcggccagaacgagagaatgggccccctgaacatcagcacccccgtggagcccgtggccgccagcaagagcgacgtgagccccatcatccagcccgtgcccagcatcaagaacgtgccccagatcgacagaaccaagaagcccgccgtgaagctgcccgaggagcacagaatcaagagcgagagcaccaaccacgagcagcagagcccccagagcggcaaggtgatccccgacagaagcaccaagcccgtggtgttcagccccaccctgatgctgaccgacgaggagaaggccagaatccacgccgagaccgccctgctgatggagaagaacaagcaggagaaggagctgagagagagacagcaggaggagcagaaggagaagctgagaaaggaggagcaggagcagaaggccaagaagaagcaggaggccgaggagaacgagatcaccgagaagcagcagaaggccaaggaggagatggagaagaaggagagcgagcaggccaagaaggaggacaaggagaccagcgccaagagaggcaaggagatcaccggcgtgaagagacagagcaagagcgagcacgagaccagcgacgccaagaagagcgtggaggacagaggcaagagatgccccacccccgagatccagaagaagagcaccggcgacgtgccccacaccagcgtgaccggcgacagcggcagcggcaagcccttcaagatcaagggccagcccgagagcggcatcctgagaaccggcaccttcagagaggacaccgacgacaccgagagaaacaaggcccagagagagcccctgaccagagccagaagcgaggagatgggcagaatcgtgcccggcctgcccagcggctgggccaagttcctggaccccatcaccggcaccttcagatactaccacagccccaccaacaccgtgcacatgtacccccccgagatggcccccagcagcgccccccccagcaccccccccacccacaaggccaagccccagatccccgccgagagagacagagagcccagcaagctgaagagaagctacagcagccccgacatcacccaggccatccaggaggaggagaagagaaagcccaccgtgacccccaccgtgaacagagagaacaagcccacctgctaccccaaggccgagatcagcagactgagcgccagccagatcagaaacctgaaccccgtgttcggcggcagcggccccgccctgaccggcctgagaaacctgggcaacacctgctacatgaacagcatcctgcagtgcctgtgcaacgccccccacctggccgactacttcaacagaaactgctaccaggacgacatcaacagaagcaacctgctgggccacaagggcgaggtggccgaggagttcggcatcatcatgaaggccctgtggaccggccagtacagatacatcagccccaaggacttcaagatcaccatcggcaagatcaacgaccagttcgccggctacagccagcaggacagccaggagctgctgctgttcctgatggacggcctgcacgaggacctgaacaaggccgacaacagaaagagatacaaggaggagaacaacgaccacctggacgacttcaaggccgccgagcacgcctggcagaagcacaagcagctgaacgagagcatcatcgtggccctgttccagggccagttcaagagcaccgtgcagtgcctgacctgccacaagaagagcagaaccttcgaggccttcatgtacctgagcctgcccctggccagcaccagcaagtgcaccctgcaggactgcctgagactgttcagcaaggaggagaagctgaccgacaacaacagattctactgcagccactgcagagccagaagagacagcctgaagaagatcgagatctggaagctgccccccgtgctgctggtgcacctgaagagattcagctacgacggcagatggaagcagaagctgcagaccagcgtggacttccccctggagaacctggacctgagccagtacgtgatcggccccaagaacaacctgaagaagtacaacctgttcagcgtgagcaaccactacggcggcctggacggcggccactacaccgcctactgcaagaacgccgccagacagagatggttcaagttcgacgaccacgaggtgagcgacatcagcgtgagcagcgtgaagagcagcgccgcctacatcctgttctacaccagcctgggccccagagtgaccgacgtggccacctag

SEQ ID NO: 23757 - DNA, 996 bp, Artificial Sequence
  Description of Artificial Sequence: Synthetic coding sequence
ctgaccggcctgagaaacctgggcaacacctgctacatgaacagcatcctgcagtgcctgtgcaacgccccccacctggccgactacttcctgaccggcaagtacatgagcaacctgctgggccacaagggcgaggtggccgaggagttcggcatcatcatgaaggccctgtggaccggccagtacagatacatcagccccaaggacttcaagatcaccatcggcaagatcaacgaccagttcgccggctacagccagcaggacagccaggagctgctgctgttcctgatggacggcctgcacgaggacctgaacaagttccaggccgacaacagaaagagatacaaggaggagaccgccgagcacgcctggcagaagcacaagcagctgaacgagagcatcatcgtggccctgttccagggccagttcaagagcaccgtgcagtgcctgacctgccacaagaagagcagaaccttcgaggccttcatgtacctgagcctgcccctggccagcaccagcaagtgcaccctgcaggactgcctgagactgttcagcaaggaggagaagctgaccgacaacaacagattctactgcagccactgcagagccagaagagacagcctgaagaagatcgagatctggaagctgccccccgtgctgctggtgcacctgaagagattcagctacgacggcagatggaagcagaagctgcagaccagcgtggacttccccctggagaacctggacctgagccagtacgtgatcggccccaagaacaacctgaagaagtacaacctgttcagcgtgagcaaccactacggcggcctggacggcggccactacaccgcctactgcaagaacgccgccagacagagatggttcaagttcgacgaccacgaggtgagcgacatcagcgtgagcagcgtgaagagcagcgccgcctacatcctgttctacaccagcctgggccccagagtgaccgacgtggccacctag

SEQ ID NO: 23758 - DNA, 3357 bp, Artificial Sequence; identical to SEQ ID NO: 23756
  Description of Artificial Sequence: Synthetic coding sequence

SEQ ID NO: 23759 - DNA, 3357 bp, Artificial Sequence; identical to SEQ ID NO: 23756
  Description of Artificial Sequence: Synthetic coding sequence

SEQ ID NO: 23760 - DNA, 408 bp, Artificial Sequence
  Description of Artificial Sequence: Synthetic coding sequence
atgcccgccgtggccagcgtgcccaaggagctgtacctgagcagcagcctgaaggacctgaacaagaagaccgaggtgaagcccgagaagatcagcaccaagagctacgtgcacagcgccctgaagatcttcaagaccgccgaggagtgcagactggacagagacgaggagagagcctacgtgctgtacatgaagtacgtgaccgtgtacaacctgatcaagaagagacccgacttcaagcagcagcaggactacttccacagcatcctgggccccggcaacatcaagaaggccgtggaggaggccgagagactgagcgagagcctgaagctgagatacgaggaggccgaggtgagaaagaagctggaggagaaggacagacaggaggaggcccagagactgcagtag

SEQ ID NO: 23761 - DNA, 291 bp, Artificial Sequence
  Description of Artificial Sequence: Synthetic coding sequence
atgcccgccgtggccagcgtgcccaaggagctgtacctgagcagcagcctgaaggacctgaacaagaagaccgaggtgaagcccgagaagatcagcaccaagagctacgtgcacagcgccctgaagatcttcaagaccgccgaggagtgcagactggacagagacgaggagagagcctacgtgctgtacatgaagtacgtgaccgtgtacaacctgatcaagaagagacccgacttcaagcagcagcaggactacttccacagcatcctgggccccggcaacatcaagtag

SEQ ID NO: 23762 - DNA, 222 bp, Artificial Sequence
  Description of Artificial Sequence: Synthetic coding sequence
atgcccgccgtggccagcgtgcccaaggagctgtacctgagcagcagcctgaaggacctgaacaagaagaccgaggtgaagcccgagaagatcagcaccaagagctacgtgcacagcgccctgaagatcttcaagaccgccgaggagtgcagactggacagagacgaggagagagcctacgtgctgtacatgaagtacgtgaccgtgtacaacctgatctag

SEQ ID NO: 23763 - DNA, 132 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtag

SEQ ID NO: 23764 - DNA, 957 bp, Artificial Sequence
  Description of Artificial Sequence: Synthetic coding sequence
atggagaccagatacaacctgaagagccccgccgtgaagagactgatgaaggaggccgccgagctgaaggaccccaccgaccactaccacgcccagcccctggaggacaacctgttcgagtggcacttcaccgtgagaggcccccccgacagcgacttcgacggcggcgtgtaccacggcagaatcgtgctgccccccgagtaccccatgaagccccccagcatcatcctgctgaccgccaacggcagattcgaggtgggcaagaagatctgcctgagcatcagcggccaccaccccgagacctggcagcccagctggagcatcagaaccgccctgctggccatcatcggcttcatgcccaccaagggcgagggcgccatcggcagcctggactacacccccgaggagagaagagccctggccaagaagagccaggacttctgctgcgagggctgcggcagcgccatgaaggacgtgctgctgcccctgaagagcggcagcgacagcagccaggccgaccaggaggccaaggagctggccagacagatcagcttcaaggccgaggtgaacagcagcggcaagaccatcagcgagagcgacctgaaccacagcttcagcctgaccgacctgcaggacgacatccccaccaccttccagggcgccaccgccagcaccagctacggcctgcagaacagcagcgccgccagcttccaccagcccacccagcccgtggccaagaacaccagcatgagccccagacagagaagagcccagcagcagagccagagaagactgagcaccagccccgacgtgatccagggccaccagcccagagacaaccacaccgaccacggcggcagcgccgtgctgatcgtgatcctgaccctggccctggccgccctgatcttcagaagaatctacctggccaacgagtacatcttcgacttcgagctgtag

SEQ ID NO: 23765 - DNA, 912 bp, Artificial Sequence
  Description of Artificial Sequence: Synthetic coding sequence
atgaaggaggccgccgagctgaaggaccccaccgaccactaccacgcccagcccctggaggacaacctgttcgagtggcacttcaccgtgagaggcccccccgacagcgacttcgacggcggcgtgtaccacggcagaatcgtgctgccccccgagtaccccatgaagccccccagcatcatcctgctgaccgccaacggcagattcgaggtgggcaagaagatctgcctgagcatcagcggccaccaccccgagacctggcagcccagctggagcatcagaaccgccctgctggccatcatcggcttcatgcccaccaagggcgagggcgccatcggcagcctggactacacccccgaggagagaagagccctggccaagaagagccaggacttctgctgcgagggctgcggcagcgccatgaaggacgtgctgctgcccctgaagagcggcagcgacagcagccaggccgaccaggaggccaaggagctggccagacagatcagcttcaaggccgaggtgaacagcagcggcaagaccatcagcgagagcgacctgaaccacagcttcagcctgaccgacctgcaggacgacatccccaccaccttccagggcgccaccgccagcaccagctacggcctgcagaacagcagcgccgccagcttccaccagcccacccagcccgtggccaagaacaccagcatgagccccagacagagaagagcccagcagcagagccagagaagactgagcaccagccccgacgtgatccagggccaccagcccagagacaaccacaccgaccacggcggcagcgccgtgctgatcgtgatcctgaccctggccctggccgccctgatcttcagaagaatctacctggccaacgagtacatcttcgacttcgagctgtag

SEQ ID NO: 23766 - DNA, 675 bp, Artificial Sequence
  Description of Artificial Sequence: Synthetic coding sequence
atgtggccccaggacatcgccggcagacactacgtggtgagaggccccgagatgaccccctacgagggcggctactaccacggcaagctgatcttccccagagagttccccttcaagccccccagcatctacatgatcacccccaacggcagattcaagtgcaacaccagactgtgcctgagcatcaccgacttccaccccgacacctggaaccccgcctggagcgtgagcaccatcctgaccggcctgctgagcttcatggtggagaagggccccaccctgggcagcatcgagaccagcgacttcaccaagagacagctggccgtgcagagcctggccttcaacctgaaggacaaggtgttctgcgagctgttccccgaggtggtggaggagatcaagcagaagcagaaggcccaggacgagctgagcagcagaccccagaccctgcccctgcccgacgtggtgcccgacggcgagacccacctggtgcagaacggcatccagctgctgaacggccacgcccccggcgccgtgcccaacctggccggcctgcagcaggccaacagacaccacggcctgctgggcggcgccctggccaacctgttcgtgatcgtgggcttcgccgccttcgcctacaccgtgaagtacgtgctgagaagcatcgcccaggagtag

SEQ ID NO: 23767 - DNA, 624 bp, Artificial Sequence
  Description of Artificial Sequence: Synthetic coding sequence
atgaccccctacgagggcggctactaccacggcaagctgatcttccccagagagttccccttcaagccccccagcatctacatgatcacccccaacggcagattcaagtgcaacaccagactgtgcctgagcatcaccgacttccaccccgacacctggaaccccgcctggagcgtgagcaccatcctgaccggcctgctgagcttcatggtggagaagggccccaccctgggcagcatcgagaccagcgacttcaccaagagacagctggccgtgcagagcctggccttcaacctgaaggacaaggtgttctgcgagctgttccccgaggtggtggaggagatcaagcagaagcagaaggcccaggacgagctgagcagcagaccccagaccctgcccctgcccgacgtggtgcccgacggcgagacccacctggtgcagaacggcatccagctgctgaacggccacgcccccggcgccgtgcccaacctggccggcctgcagcaggccaacagacaccacggcctgctgggcggcgccctggccaacctgttcgtgatcgtgggcttcgccgccttcgcctacaccgtgaagtacgtgctgagaagcatcgcccaggagtag

SEQ ID NO: 23768 - DNA, 624 bp, Artificial Sequence; identical to SEQ ID NO: 23767
  Description of Artificial Sequence: Synthetic coding sequence

SEQ ID NO: 23769 - DNA, 780 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtggcactacgtggtgagaggccccgagatgaccccctacgagggcggctactaccacggcaagctgatcttccccagagagttccccttcaagccccccagcatctacatgatcacccccaacggcagattcaagtgcaacaccagactgtgcctgagcatcaccgacttccaccccgacacctggaaccccgcctggagcgtgagcaccatcctgaccggcctgctgagcttcatggtggagaagggccccaccctgggcagcatcgagaccagcgacttcaccaagagacagctggccgtgcagagcctggccttcaacctgaaggacaaggtgttctgcgagctgttccccgaggtggtggaggagatcaagcagaagcagaaggcccaggacgagctgagcagcagaccccagaccctgcccctgcccgacgtggtgcccgacggcgagacccacctggtgcagaacggcatccagctgctgaacggccacgcccccggcgccgtgcccaacctggccggcctgcagcaggccaacagacaccacggcctgctgggcggcgccctggccaacctgttcgtgatcgtgggcttcgccgccttcgcctacaccgtgaagtacgtgctgagaagcatcgcccaggagtag

SEQ ID NO: 23770 - DNA, 780 bp, Artificial Sequence; identical to SEQ ID NO: 23769
  Description of Artificial Sequence: Synthetic coding sequence

SEQ ID NO: 23771 - DNA, 624 bp, Artificial Sequence; identical to SEQ ID NO: 23767
  Description of Artificial Sequence: Synthetic coding sequence

SEQ ID NO: 23772 - DNA, 828 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtggttcaagagattcagctggctgagcctgctgagcagctgggactacagacactacgtggtgagaggccccgagatgaccccctacgagggcggctactaccacggcaagctgatcttccccagagagttccccttcaagccccccagcatctacatgatcacccccaacggcagattcaagtgcaacaccagactgtgcctgagcatcaccgacttccaccccgacacctggaaccccgcctggagcgtgagcaccatcctgaccggcctgctgagcttcatggtggagaagggccccaccctgggcagcatcgagaccagcgacttcaccaagagacagctggccgtgcagagcctggccttcaacctgaaggacaaggtgttctgcgagctgttccccgaggtggtggaggagatcaagcagaagcagaaggcccaggacgagctgagcagcagaccccagaccctgcccctgcccgacgtggtgcccgacggcgagacccacctggtgcagaacggcatccagctgctgaacggccacgcccccggcgccgtgcccaacctggccggcctgcagcaggccaacagacaccacggcctgctgggcggcgccctggccaacctgttcgtgatcgtgggcttcgccgccttcgcctacaccgtgaagtacgtgctgagaagcatcgcccaggagtag

SEQ ID NO: 23773 - DNA, 306 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtggttcaagagattcagctggctgagcctgctgagcagctgggactacagacactacgtggtgagaggccccgagatgaccccctacgagggcggctactaccacggcaagctgatcttccccagagagttccccttcaagccccccagcatctacatgatcacccccaacggctag

SEQ ID NO: 23774 - DNA, 591 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtggcactacgtggtgagaggccccgagatgaccccctacgagggcggctactaccacggcaagctgatcttccccagagagttccccttcaagccccccagcatctacatgatcacccccaacggcagattcaagtgcaacaccagactgtgcctgagcatcaccgacttccaccccgacacctggaaccccgcctggagcgtgagcaccatcctgaccggcctgctgagcttcatggtggagaagggccccaccctgggcagcatcgagaccagcgacttcaccaagagacagctggccgtgcagagcctggccttcaacctgaaggacaaggtgttctgcgagctgttccccgaggtggtggaggagatcaagcagaagcagaaggcccaggacgagctgagcagcagaccccagaccctgcccctgcccgacgtggtgcccgacggcgagacccactag

SEQ ID NO: 23775 - DNA, 132 bp, Artificial Sequence; identical to SEQ ID NO: 23763
  Description of Artificial Sequence: Synthetic coding sequence

SEQ ID NO: 23776 - DNA, 216 bp, Artificial Sequence
  Description of Artificial Sequence: Synthetic coding sequence
atgagcagcaccagcagcaagagagcccccaccaccgccacccagagactgaagcaggactacctgagaatcaagaaggaccccgtgccctacatctgcgccgagcccctgcccagcaacatcctggagtggcactacgtggtgagaggccccgagatgaccccctacgagggcggctactaccacggcaagctgatcttccccagagagttctag

SEQ ID NO: 23777 - DNA, 444 bp, Artificial Sequence
  Description of Artificial Sequence: Synthetic coding sequence
atggccctgaagagaatcaacaaggagctgagcgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgccctgaccatcagcaaggtgctgctgagcatctgcagcctgctgtgcgaccccaaccccgacgaccccctggtgcccgagatcgccagaatctacaagaccgacagagacaagtacaacagaatcagcagagagtggacccagaagtacgccatgtag

SEQ ID NO: 23778 - DNA, 444 bp, Artificial Sequence; identical to SEQ ID NO: 23777
  Description of Artificial Sequence: Synthetic coding sequence

SEQ ID NO: 23779 - DNA, 447 bp, Artificial Sequence
  Description of Artificial Sequence: Synthetic coding sequence
atggccctgaagagaatcaacaaggagctgagcgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgccctgaccatcagcaaggtgctgctgagcatctgcagcctgctgtgcgaccccaaccccgacgaccccctggtgcccgagatcgccagaatctacaagaccgacagagacaagtacaacagactggccagagagtggaccgagaagtacgccatgctgtag

SEQ ID NO: 23780 - DNA, 444 bp, Artificial Sequence; identical to SEQ ID NO: 23777
  Description of Artificial Sequence: Synthetic coding sequence

SEQ ID NO: 23781 - DNA, 450 bp, Artificial Sequence
  Description of Artificial Sequence: Synthetic coding sequence
atgctgagcaacagaaagtgcctgagcaaggagctgagcgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgccctgaccatcagcaaggtgctgctgagcatctgcagcctgctgtgcgaccccaaccccgacgaccccctggtgcccgagatcgccagaatctacaagaccgacagagacaagtacaacagaatcagcagagagtggacccagaagtacgccatgtag

SEQ ID NO: 23782 - DNA, 444 bp, Artificial Sequence; identical to SEQ ID NO: 23777
  Description of Artificial Sequence: Synthetic coding sequence

SEQ ID NO: 23783 - DNA, 444 bp, Artificial Sequence; identical to SEQ ID NO: 23777
  Description of Artificial Sequence: Synthetic coding sequence

SEQ ID NO: 23784 - DNA, 444 bp, Artificial Sequence; identical to SEQ ID NO: 23777
  Description of Artificial Sequence: Synthetic coding sequence

SEQ ID NO: 23785 - DNA, 444 bp, Artificial Sequence; identical to SEQ ID NO: 23777
  Description of Artificial Sequence: Synthetic coding sequence

SEQ ID NO: 23786 - DNA, 237 bp, Artificial Sequence
  Description of Artificial Sequence: Synthetic coding sequence
atggccctgaagagaatcaacaaggagctgagcgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatctag

SEQ ID NO: 23787 - DNA, 291 bp, Artificial Sequence
  Description of Artificial Sequence: Synthetic coding sequence
atggccctgaagagaatcaacaaggagctgagcgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgcctag

SEQ ID NO: 23788 - DNA, 150 bp, Artificial Sequence
  Description of Artificial Sequence: Synthetic coding sequence
atggccctgaagagaatcaacaaggagctgagcgacctggccagagacccccccgcccagtgcagcgccggccccgtgggcgacgacatgttccactggcaggccaccatcatgggccccaacgacagcccctaccagggcggcgtgtag

SEQ ID NO: 23789 - DNA, 1527 bp, Artificial Sequence
  Description of Artificial Sequence: Synthetic coding sequence
atgctgtggttccagggcgccatccccgccgccatcgccaccgccaagagaagcggcgccgtgttcgtggtgttcgtggccggcgacgacgagcagagcacccagatggccgccagctgggaggacgacaaggtgaccgaggccagcagcaacagcttcgtggccatcaagatcgacaccaagagcgaggcctgcctgcagttcagccagatctaccccgtggtgtgcgtgcccagcagcttcttcatcggcgacagcggcatccccctggaggtgatcgccggcagcgtgagcgccgacgagctggtgaccagaatccacaaggtgagacagatgcacctgctgaagagcgagaccagcgtggccaacggcagccagagcgagagcagcgtgagcacccccagcgccagcttcgagcccaacaacacctgcgagaacagccagagcagaaacgccgagctgtgcgagatcccccccaccagcgacaccaagagcgacaccgccaccggcggcgagagcgccggccacgccaccagcagccaggagcccagcggctgcagcgaccagagacccgccgaggacctgaacatcagagtggagagactgaccaagaagctggaggagagaagagaggagaagagaaaggaggaggagcagagagagatcaagaaggagatcgagagaagaaagaccggcaaggagatgctggactacaagagaaagcaggaggaggagctgaccaagagaatgctggaggagagaaacagagagaaggccgaggacagagccgccagagagagaatcaagcagcagatcgccctggacagagccgagagagccgccagattcgccaagaccaaggaggaggtggaggccgccaaggccgccgccctgctggccaagcaggccgagatggaggtgaagagagagagctacgccagagagagaagcaccgtggccagaatccagttcagactgcccgacggcagcagcttcaccaaccagttccccagcgacgcccccctggaggaggccagacagttcgccgcccagaccgtgggcaacacctacggcaacttcagcctggccaccatgttccccagaagagagttcaccaaggaggactacaagaagaagctgctggacctggagctggcccccagcgccagcgtggtgctgctgcccgccggcagacccaccgccagcatcgtgcacagcagcagcggcgacatctggaccctgctgggcaccgtgctgtaccccttcctggccatctggagactgatcagcaacttcctgttcagcaaccccccccccacccagaccagcgtgagagtgaccagcagcgagccccccaaccccgccagcagcagcaagagcgagaagagagagcccgtgagaaagagagtgctggagaagagaggcgacgacttcaagaaggagggcaagatctacagactgagaacccaggacgacggcgaggacgagaacaacacctggaacggcaacagcacccagcagatgtag

SEQ ID NO: 23790 - DNA, 1473 bp, Artificial Sequence
  Description of Artificial Sequence: Synthetic coding sequence
atgctgtggttccagggcgccatccccgccgccatcgccaccgccaagagaagcggcgccgtgttcgtggtgttcgtggccggcgacgacgagcagagcacccagatggccgccagctgggaggacgacaaggtgaccgaggccagcagcaacagcttcgtggccatcaagatcgacaccaagagcgaggcctgcctgcagttcagccagatctaccccgtggtgtgcgtgcccagcagcttcttcatcggcgacagcggcatccccctggaggtgatcgccggcagcgtgagcgccgacgagctggtgaccagaatccacaaggtgagacagatgcacctgctgaagaccgccagcttcgagcccaacaacacctgcgagaacagccagagcagaaacgccgagctgtgcgagatcccccccaccagcgacaccaagagcgacaccgccaccggcggcgagagcgccggccacgccaccagcagccaggagcccagcggctgcagcgaccagagacccgccgaggacctgaacatcagagtggagagactgaccaagaagctggaggagagaagagaggagaagagaaaggaggaggagcagagagagatcaagaaggagatcgagagaagaaagaccggcaaggagatgctggactacaagagaaagcaggaggaggagctgaccaagagaatgctggaggagagaaacagagagaaggccgaggacagagccgccagagagagaatcaagcagcagatcgccctggacagagccgagagagccgccagattcgccaagaccaaggaggaggtggaggccgccaaggccgccgccctgctggccaagcaggccgagatggaggtgaagagagagagctacgccagagagagaagcaccgtggccagaatccagttcagactgcccgacggcagcagcttcaccaaccagttccccagcgacgcccccctggaggaggccagacagttcgccgcccagaccgtgggcaacacctacggcaacttcagcctggccaccatgttccccagaagagagttcaccaaggaggactacaagaagaagctgctggacctggagctggcccccagcgccagcgtggtgctgctgcccgccggcagacccaccgccagcatcgtgcacagcagcagcggcgacatctggaccctgctgggcaccgtgctgtaccccttcctggccatctggagactgatcagcaacttcctgttcagcaaccccccccccacccagaccagcgtgagagtgaccagcagcgagccccccaaccccgccagcagcagcaagagcgagaagagagagcccgtgagaaagagagtgctggagaagagaggcgacgacttcaagaaggagggcaagatctacagactgagaacccaggacgacggcgaggacgagaacaacacctggaacggcaacagcacccagcagatgtag

SEQ ID NO: 23791 - DNA, 1470 bp, Artificial Sequence
  Description of Artificial Sequence: Synthetic coding sequence
atggccgcccacggcggcagcgccgccagcagcgccctgaagggcctgatccagcagttcaccaccatcaccggcgccagcgagagcgtgggcaagcacatgctggaggcctgcaacaacaacctggagatggccgtgaccatgttcctggacggcggcggcatcgccgaggagcccagcaccagcagcgccagcgtgagcaccgtgagaccccacaccgaggaggaggtgagagcccccatcccccagaagcaggagatcctggtggagcccgagcccctgttcggcgcccccaagagaagaagacccgccagaagcatcttcgacggcttcagagacttccagaccgagaccatcagacaggagcaggagctgagaaacggcggcgccatcgacaagaagctgaccaccctggccgacctgttcagaccccccatcgacctgatgcacaagggcagcttcgagaccgccaaggagtgcggccagatgcagaacaagtggctgatgatcaacatccagaacgtgcaggacttcgcctgccagtgcctgaacagagacgtgtggagcaacgaggccgtgaagaacatcatcagagagcacttcatcttctggcaggtgtaccacgacagcgaggagggccagagatacatccagttctacaagctgggcgacttcccctacgtgagcatcctggaccccagaaccggccagaagctggtggagtggcaccagctggacgtgagcagcttcctggaccaggtgaccggcttcctgggcgagcacggccagctggacggcctgagcagcagcccccccaagaagtgcgccagaagcgagagcctgatcgacgccagcgaggacagccagctggaggccgccatcagagccagcctgcaggagacccacttcgacagcacccagaccaagcaggacagcagaagcgacgaggagagcgagagcgagctgttcagcggcagcgaggagttcatcagcgtgtgcggcagcgacgaggaggaggaggtggagaacctggccaagagcagaaagagcccccacaaggacctgggccacagaaaggaggagaacagaagacccctgaccgagccccccgtgagaaccgaccccggcaccgccaccaaccaccagggcctgcccgccgtggacagcgagatcctggagatgccccccgagaaggccgacggcgtggtggagggcatcgacgtgaacggccccaaggcccagctgatgctgagataccccgacggcaagagagagcagatcaccctgcccgagcaggccaagctgctggccctggtgaagcacgtgcagagcaagggctaccccaacgagagattcgagctgctgaccaacttccccagaagaaagctgagccacctggactacgacatcaccctgcaggaggccggcctgtgcccccaggagaccgtgttcgtgcaggagagaaactag

SEQ ID NO: 23792 - DNA, 1026 bp, Artificial Sequence
  Description of Artificial Sequence: Synthetic coding sequence
atgcacaagggcagcttcgagaccgccaaggagtgcggccagatgcagaacaagtggctgatgatcaacatccagaacgtgcaggacttcgcctgccagtgcctgaacagagacgtgtggagcaacgaggccgtgaagaacatcatcagagagcacttcatcttctggcaggtgtaccacgacagcgaggagggccagagatacatccagttctacaagctgggcgacttcccctacgtgagcatcctggaccccagaaccggccagaagctggtggagtggcaccagctggacgtgagcagcttcctggaccaggtgaccggcttcctgggcgagcacggccagctggacggcctgagcagcagcccccccaagaagtgcgccagaagcgagagcctgatcgacgccagcgaggacagccagctggaggccgccatcagagccagcctgcaggagacccacttcgacagcacccagaccaagcaggacagcagaagcgacgaggagagcgagagcgagctgttcagcggcagcgaggagttcatcagcgtgtgcggcagcgacgaggaggaggaggtggagaacctggccaagagcagaaagagcccccacaaggacctgggccacagaaaggaggagaacagaagacccctgaccgagccccccgtgagaaccgaccccggcaccgccaccaaccaccagggcctgcccgccgtggacagcgagatcctggagatgccccccgagaaggccgacggcgtggtggagggcatcgacgtgaacggccccaaggcccagctgatgctgagataccccgacggcaagagagagcagatcaccctgcccgagcaggccaagctgctggccctggtgaagcacgtgcagagcaagggctaccccaacgagagattcgagctgctgaccaacttccccagaagaaagctgagccacctggactacgacatcaccctgcaggaggccggcctgtgcccccaggagaccgtgttcgtgcaggagagaaactag

SEQ ID NO: 23793 - DNA, 1584 bp, Artificial Sequence
  Description of Artificial Sequence: Synthetic coding sequence
atgagaagcgacaagagcgccctggtgttcctgctgctgcagctgttctgcgtgggctgcggcttctgcggcaaggtgctggtgtggccctgcgacatgagccactggctgaacgtgaaggtgatcctggaggagctgatcgtgagaggccacgaggtgaccgtgctgacccacagcaagcccagcctgatcgactacagaaagcccagcgccctgaagttcgaggtggtgcacatgccccaggacagaaccgaggagaacgagatcttcgtggacctggccctgaacgtgctgcccggcctgagcacctggcagagcgtgatcaagctgaacgacttcttcgtggagatcagaggcaccctgaagatgatgtgcgagagcttcatctacaaccagaccctgatgaagaagctgcaggagaccaactacgacgtgatgctgatcgaccccgtgatcccctgcggcgacctgatggccgagctgctggccgtgcccttcgtgctgaccctgagaatcagcgtgggcggcaacatggagagaagctgcggcaagctgcccgcccccctgagctacgtgcccgtgcccatgaccggcctgaccgacagaatgaccttcctggagagagtgaagaacagcatgctgagcgtgctgttccacttctggatccaggactacgactaccacttctgggaggagttctacagcaaggccctgggcagacccaccaccctgtgcgagaccgtgggcaaggccgagatctggctgatcagaacctactgggacttcgagttcccccagccctaccagcccaacttcgagttcgtgggcggcctgcactgcaagcccgccaaggccctgcccaaggagatggagaacttcgtgcagagcagcggcgaggacggcatcgtggtgttcagcctgggcagcctgttccagaacgtgaccgaggagaaggccaacatcatcgccagcgccctggcccagatcccccagaaggtgctgtggagatacaagggcaagaagcccagcaccctgggcgccaacaccagactgtacgactggatcccccagaacgacctgctgggccaccccaagaccaaggccttcatcacccacggcggcatgaacggcatctacgaggccatctaccacggcgtgcccatggtgggcgtgcccatcttcggcgaccagctggacaacatcgcccacatgaaggccaagggcgccgccgtggagatcaacttcaagaccatgaccagcgaggacctgctgagagccctgagaaccgtgatcaccgacagcagctacaaggagaacgccatgagactgagcagaatccaccacgaccagcccgtgaagcccctggacagagccgtgttctggatcgagttcgtgatgagacacaagggcgccaagcacctgagaagcgccgcccacgacctgacctggttccagcactacagcatcgacgtgatcggcttcctgctggcctgcgtggccaccgccatcttcctgttcaccaagtgcttcctgttcagctgccagaagttcaacaagaccagaaagatcgagaagagagagtag

SEQ ID NO: 23794 - DNA, 717 bp, Artificial Sequence
  Description of Artificial Sequence: Synthetic coding sequence
atggagaacttcgtgcagagcagcggcgaggacggcatcgtggtgttcagcctgggcagcctgttccagaacgtgaccgaggagaaggccaacatcatcgccagcgccctggcccagatcccccagaaggtgctgtggagatacaagggcaagaagcccagcaccctgggcgccaacaccagactgtacgactggatcccccagaacgacctgctgggccaccccaagaccaaggccttcatcacccacggcggcatgaacggcatctacgaggccatctaccacggcgtgcccatggtgggcgtgcccatcttcggcgaccagctggacaacatcgcccacatgaaggccaagggcgccgccgtggagatcaacttcaagaccatgaccagcgaggacctgctgagagccctgagaaccgtgatcaccgacagcagctacaaggagaacgccatgagactgagcagaatccaccacgaccagcccgtgaagcccctggacagagccgtgttctggatcgagttcgtgatgagacacaagggcgccaagcacctgagaagcgccgcccacgacctgacctggttccagcactacagcatcgacgtgatcggcttcctgctggcctgcgtggccaccgccatcttcctgttcaccaagtgcttcctgttcagctgccagaagttcaacaagaccagaaagatcgagaagagagagtag

SEQ ID NO: 23795 - DNA, 1587 bp, Artificial Sequence
  Description of Artificial Sequence: Synthetic coding sequence
atggccctgaagtggaccaccgtgctgctgatccagctgagcttctacttcagcagcggcagctgcggcaaggtgctggtgtgggccgccgagtacagcctgtggatgaacatgaagaccatcctgaaggagctggtgcagagaggccacgaggtgaccgtgctggccagcagcgccagcatcctgttcgaccccaacgacagcagcaccctgaagctggaggtgtaccccaccagcctgaccaagaccgagttcgagaacatcatcatgcagctggtgaagagactgagcgagatccagaaggacaccttctggctgcccttcagccaggagcaggagatcctgtgggccatcaacgacatcatcagaaacttctgcaaggacgtggtgagcaacaagaagctgatgaagaagctgcaggagagcagattcgacatcgtgttcgccgacgcctacctgccctgcggcgagctgctggccgagctgttcaacatccccttcgtgtacagccacagcttcagccccggctacagcttcgagagacacagcggcggcttcatcttcccccccagctacgtgcccgtggtgatgagcaagctgagcgaccagatgaccttcatggagagagtgaagaacatgctgtacgtgctgtacttcgacttctggttccagatcttcaacatgaagaagtgggaccagttctacagcgaggtgctgggcagacccaccaccctgagcgagaccatgagaaaggccgacatctggctgatgagaaacagctggaacttcaagttcccccaccccttcctgcccaacgtggacttcgtgggcggcctgcactgcaagcccgccaagcccctgcccaaggagatggaggagttcgtgcagagcagcggcgagaacggcgtggtggtgttcagcctgggcagcatggtgagcaacatgaccgaggagagagccaacgtgatcgccaccgccctggccaagatcccccagaaggtgctgtggagattcgacggcaacaagcccgacgccctgggcctgaacaccagactgtacaagtggatcccccagaacgacctgctgggccaccccaagaccagagccttcatcacccacggcggcgccaacggcatctacgaggccatctaccacggcatccccatggtgggcatccccctgttcttcgaccagcccgacaacatcgcccacatgaaggccaagggcgccgccgtgagagtggacttcaacaccatgagcagcaccgacctgctgaacgccctgaagaccgtgatcaacgaccccagctacaaggagaacatcatgaagctgagcagaatccagcacgaccagcccgtgaagcccctggacagagccgtgttctggatcgagttcgtgatgagacacaagggcgccaagcacctgagagtggccgcccacaacctgacctggttccagtaccacagcctggacgtgatcggcttcctgctggcctgcgtggccaccgtgctgttcatcatcaccaagtgctgcctgttctgcttctggaagttcgccagaaagggcaagaagggcaagagagactag

SEQ ID NO: 23796 - DNA, 1572 bp, Artificial Sequence
  Description of Artificial Sequence: Synthetic coding sequence
atggtgggccagagagtgctgctgctggtggccttcctgctgagcggcgtgctgctgagcgaggccgccaagatcctgaccatcagcaccctgggcggcagccactacctgctgctggacagagtgagccagatcctgcaggagcacggccacaacgtgaccatgctgcaccagagcggcaagttcctgatccccgacatcaaggaggaggagaagagctaccaggtgatcagatggttcagccccgaggaccaccagaagagaatcaagaagcacttcgacagctacatcgagaccgccctggacggcagaaaggagagcgaggccctggtgaagctgatggagatcttcggcacccagtgcagctacctgctgagcagaaaggacatcatggacagcctgaagaacgagaactacgacctggtgttcgtggaggccttcgacttctgcagcttcctgatcgccgagaagctggtgaagcccttcgtggccatcctgcccaccaccttcggcagcctggacttcggcctgcccagccccctgagctacgtgcccgtgttccccagcctgctgaccgaccacatggacttctggggcagagtgaagaacttcctgatgttcttcagcttcagcagaagccagtgggacatgcagagcaccttcgacaacaccatcaaggagcacttccccgagggcagcagacccgtgctgagccacctgctgctgaaggccgagctgtggttcgtgaacagcgacttcgccttcgacttcgccagacccctgctgcccaacaccgtgtacatcggcggcctgatggagaagcccatcaagcccgtgccccaggacctggacaacttcatcgccaacttcggcgacgccggcttcgtgctggtggccttcggcagcatgctgaacacccaccagagccaggaggtgctgaagaagatgcacaacgccttcgcccacctgccccagggcgtgatctggacctgccagagcagccactggcccagagacgtgcacctggccaccaacgtgaagatcgtggactggctgccccagagcgacctgctggcccaccccagcatcagactgttcgtgacccacggcggccagaacagcgtgatggaggccatcagacacggcgtgcccatggtgggcctgcccgtgaacggcgaccagcacggcaacatggtgagagtggtggccaagaactacggcgtgagcatcagactgaaccaggtgaccgccgacaccctgaccctgaccatgaagcaggtgatcgaggacaagagatacaagagcgccgtggtggccgccagcgtgatcctgcacagccagcccctgagccccgcccagagactggtgggctggatcgaccacatcctgcagaccggcggcgccacccacctgaagccctacgccttccagcagccctggcacgagcagtacctgatcgacgtgttcgtgttcctgctgggcctgaccctgggcaccatgtggctgtgcggcaagctgctgggcgtggtggccagatggctgagaggcgccagaaaggtgaagaagacctag

SEQ ID NO: 23797 - DNA, 759 bp, Artificial Sequence
  Description of Artificial Sequence: Synthetic coding sequence
atgctgcaccagagcggcaagttcctgatccccgacatcaaggaggaggagaagagctaccaggtgatcagatggttcagccccgaggaccaccagaagagaatcaagaagcacttcgacagctacatcgagaccgccctggacggcagaaaggagagcgaggccctggtgaagctgatggagatcttcggcacccagtgcagctacctgctgagcagaaaggacatcatggacagcctgaagaacgagaactacgacctggtgttcgtggaggccttcgacttctgcagcttcctgatcgccgagaagctggtgaagcccttcgtggccatcctgcccaccaccttcggcagcctggacttcggcctgcccagccccctgagctacgtgcccgtgttccccagcctgctgaccgaccacatggacttctggggcagagtgaagaacttcctgatgttcttcagcttcagcagaagccagtgggacatgcagagcaccttcgacaacaccatcaaggagcacttccccgagggcagcagacccgtgctgagccacctgctgctgaaggccgagctgtggttcgtgaacagcgacttcgccttcgacttcgccagacccctgctgcccaacaccgtgtacatcggcggcctgatggagaagcccatcaagcccgtgccccagaacggccagcccgccctgttcaccacccccagcctgttcagcagcggcgtgtaccccgagcccctgagatggctgtag

SEQ ID NO: 23798 - DNA, 1626 bp, Artificial Sequence
  Description of Artificial Sequence: Synthetic coding sequence
atgaagagctacaccccctacttcatcctgctgtggagcgccgtgggcatcgccaaggccgccaagatcatcatcgtgccccccatcatgttcgagagccacatgtacatcttcaagaccctggccagcgccctgcacgagagaggccaccacaccgtgttcctgctgagcgagggcagagacatcgcccccagcaaccactacagcctgcagagataccccggcatcttcaacagcaccaccagcgacgccttcctgcagagcaagatgagaaacatcttcagcggcagactgaccgccatcgagctgttcgacatcctggaccactacaccaagaactgcgacctgatggtgggcaaccacgccctgatccagggcctgaagaaggagaagttcgacctgctgctggtggaccccaacgacatgtgcggcttcgtgatcgcccacctgctgggcgtgaagtacgccgtgttcagcaccggcctgtggtaccccgccgaggtgggcgcccccgcccccctggcctacgtgcccgagttcaacagcctgctgaccgacagaatgaacctgctgcagagaatgaagaacaccggcgtgtacctgatcagcagactgggcgtgagcttcctggtgctgcccaagtacgagagaatcatgcagaagtacaacctgctgcccgagaagagcatgtacgacctggtgcacggcagcagcctgtggatgctgtgcaccgacgtggccctggagttccccagacccaccctgcccaacgtggtgtacgtgggcggcatcctgaccaagcccgccagccccctgcccgaggacctgcagagatgggtgaacggcgccaacgagcacggcttcgtgctggtgagcttcggcgccggcgtgaagtacctgagcgaggacatcgccaacaagctggccggcgccctgggcagactgccccagaaggtgatctggagattcagcggccccaagcccaagaacctgggcaacaacaccaagctgatcgagtggctgccccagaacgacctgctgggccacagcaagatcaaggccttcctgagccacggcggcctgaacagcatcttcgagaccatctaccacggcgtgcccgtggtgggcatccccctgttcggcgaccactacgacaccatgaccagagtgcaggccaagggcatgggcatcctgctggagtggaagaccgtgaccgagaaggagctgtacgaggccctggtgaaggtgatcaacaaccccagctacagacagagagcccagaagctgagcgagatccacaaggaccagcccggccaccccgtgaacagaaccatctactggatcgactacatcatcagacacaacggcgcccaccacctgagagccgccgtgcaccagatcagcttctgccagtacttcctgctggacatcgccttcgtgctgctgctgggcgccgccctgctgtacttcctgctgagctgggtgaccaagttcatctacagaaagatcaagagcctgtggagcagaaacaagcacagcaccgtgaacggccactaccacaacggcatcctgaacggcaagtacaagagaaacggccacatcaagcacgagaagaaggtgaagtag

SEQ ID NO: 23799 - DNA, 1626 bp, Artificial Sequence; identical to SEQ ID NO: 23798
  Description of Artificial Sequence: Synthetic coding sequence

SEQ ID NO: 23800 - DNA, 426 bp, Artificial Sequence
  Description of Artificial Sequence: Synthetic coding sequence
atgaagagctacaccccctacttcatcctgctgtggagcgccgtgggcatcgccaaggccgccaagatcatcatcgtgccccccatcatgttcgagagccacatgtacatcttcaagaccctggccagcgccctgcacgagagaggccaccacaccgtgttcctgctgagcgagggcagagacatcgcccccagcaaccactacagcctgcagagataccccggcatcttcaacagcaccaccagcgacgccttcctgcagagcaagatgagaaacatcttcagcggcagactgaccgccatcgagctgttcgacatcctggaccactacaccaagaactgcgacctgatggtgggcaaccacgccctgatccagggcctgaagaaggagaagttcgacctgctgctggtggaccccaacgactag

SEQ ID NO: 23801 - DNA, 990 bp, Artificial Sequence
  Description of Artificial Sequence: Synthetic coding sequence
atgaagctgctgagaagagcctggagaagaagagccgccctgggcctgggcaccctggccctgtgcggcgccgccctgctgtacctggccagatgcgccgccgagcccggcgaccccagagccatgagcggcagaagcccccccccccccgcccccgccagagccgccgccttcctggccgtgctggtggccagcgcccccagagccgccgagagaagaagcgtgatcagaagcacctggctggccagaagaggcgcccccggcgacgtgtgggccagattcgccgtgggcaccgccggcctgggcgccgaggagagaagagccctggagagagagcaggccagacacggcgacctgctgctgctgcccgccctgagagacgcctacgagaacctgaccgccaaggtgctggccatgctggcctggctggacgagcacgtggccttcgagttcgtgctgaaggccgacgacgacagcttcgccagactggacgccctgctggccgagctgagagccagagagcccgccagaagaagaagactgtactggggcttcttcagcggcagaggcagagtgaagcccggcggcagatggagagaggccgcctggcagctgtgcgactactacctgccctacgccctgggcggcggctacgtgctgagcgccgacctggtgcactacctgagactgagcagagactacctgagagcctggcacagcgaggacgtgagcctgggcgcctggctggcccccgtggacgtgcagagagagcacgaccccagattcgacaccgagtacagaagcagaggctgcagcaaccagtacctggtgacccacaagcagagcctggaggacatgctggagaagcacgccaccctggccagagagggcagactgtgcaagagagaggtgcagctgagactgagctacgtgtacgactggagcgccccccccagccagtgctgccagagaagagagggcatcccctag

SEQ ID NO: 23802 - DNA, 981 bp, Artificial Sequence
  Description of Artificial Sequence: Synthetic coding sequence
atggccagcaaggtgagctgcctgtacgtgctgaccgtggtgtgctgggccagcgccctgtggtacctgagcatcaccagacccaccagcagctacaccggcagcaagcccttcagccacctgaccgtggccagaaagaacttcaccttcggcaacatcagaaccagacccatcaacccccacagcttcgagttcctgatcaacgagcccaacaagtgcgagaagaacatccccttcctggtgatcctgatcagcaccacccacaaggagttcgacgccagacaggccatcagagagacctggggcgacgagaacaacttcaagggcatcaagatcgccaccctgttcctgctgggcaagaacgccgaccccgtgctgaaccagatggtggagcaggagagccagatcttccacgacatcatcgtggaggacttcatcgacagctaccacaacctgaccctgaagaccctgatgggcatgagatgggtggccaccttctgcagcaaggccaagtacgtgatgaagaccgacagcgacatcttcgtgaacatggacaacctgatctacaagctgctgaagcccagcaccaagcccagaagaagatacttcaccggctacgtgatcaacggcggccccatcagagacgtgagaagcaagtggtacatgcccagagacctgtaccccgacagcaactacccccccttctgcagcggcaccggctacatcttcagcgccgacgtggccgagctgatctacaagaccagcctgcacaccagactgctgcacctggaggacgtgtacgtgggcctgtgcctgagaaagctgggcatccaccccttccagaacagcggcttcaaccactggaagatggcctacagcctgtgcagatacagaagagtgatcaccgtgcaccagatcagccccgaggagatgcacagaatctggaacgacatgagcagcaagaagcacctgagatgctag

SEQ ID NO: 23803 - DNA, 981 bp, Artificial Sequence; identical to SEQ ID NO: 23802
  Description of Artificial Sequence: Synthetic coding sequence

SEQ ID NO: 23804 - DNA, 1248 bp, Artificial Sequence
  Description of Artificial Sequence: Synthetic coding sequence
atgcagatgagctacgccatcagatgcgccttctaccagctgctgctggccgccctgatgctggtggccatgctgcagctgctgtacctgagcctgctgagcggcctgcacggccaggaggagcaggaccagtacttcgagttcttcccccccagccccagaagcgtggaccaggtgaaggcccagctgagaaccgccctggccagcggcggcgtgctggacgccagcggcgactacagagtgtacagaggcctgctgaagaccaccatggaccccaacgacgtgatcctggccacccacgccagcgtggacaacctgctgcacctgagcggcctgctggagagatgggagggccccctgagcgtgagcgtgttcgccgccaccaaggaggaggcccagctggccaccgtgctggcctacgccctgagcagccactgccccgacatgagagccagagtggccatgcacctggtgtgccccagcagatacgaggccgccgtgcccgaccccagagagcccggcgagttcgccctgctgagaagctgccaggaggtgttcgacaagctggccagagtggcccagcccggcatcaactacgccctgggcaccaacgtgagctaccccaacaacctgctgagaaacctggccagagagggcgccaactacgccctggtgatcgacgtggacatggtgcccagcgagggcctgtggagaggcctgagagagatgctggaccagagcaaccagtggggcggcaccgccctggtggtgcccgccttcgagatcagaagagccagaagaatgcccatgaacaagaacgagctggtgcagctgtaccaggtgggcgaggtgagacccttctactacggcctgtgcaccccctgccaggcccccaccaactacagcagatgggtgaacctgcccgaggagagcctgctgagacccgcctacgtggtgccctggcaggacccctgggagcccttctacgtggccggcggcaaggtgcccaccttcgacgagagattcagacagtacggcttcaacagaatcagccaggcctgcgagctgcacgtggccggcttcgacttcgaggtgctgaacgagggcttcctggtgcacaagggcttcaaggaggccctgaagttccacccccagaaggaggccgagaaccagcacaacaagatcctgtacagacagttcaagcaggagctgaaggccaagtaccccaacagccccagaagatgctag

SEQ ID NO: 23805 - DNA, 561 bp, Artificial Sequence
  Description of Artificial Sequence: Synthetic coding sequence
atggtgcccagcgagggcctgtggagaggcctgagagagatgctggaccagagcaaccagtggggcggcaccgccctggtggtgcccgccttcgagatcagaagagccagaagaatgcccatgaacaagaacgagctggtgcagctgtaccaggtgggcgaggtgagacccttctactacggcctgtgcaccccctgccaggcccccaccaactacagcagatgggtgaacctgcccgaggagagcctgctgagacccgcctacgtggtgccctggcaggacccctgggagcccttctacgtggccggcggcaaggtgcccaccttcgacgagagattcagacagtacggcttcaacagaatcagccaggcctgcgagctgcacgtggccggcttcgacttcgaggtgctgaacgagggcttcctggtgcacaagggcttcaaggaggccctgaagttccacccccagaaggaggccgagaaccagcacaacaagatcctgtacagacagttcaagcaggagctgaaggccaagtaccccaacagccccagaagatgctag

SEQ ID NO: 23806 - DNA, 1194 bp, Artificial Sequence
  Description of Artificial Sequence: Synthetic coding sequence
atgagcgtgggcagaagaagaatcaagctgctgggcatcctgatgatggccaacgtgttcatctacttcatcatggaggtgagcaagagcagcagccaggagaagaacggcaagggcgaggtgatcatccccaaggagaagttctggaagatcagcaccccccccgaggcctactggaacagagagcaggagaagctgaacagacagtacaaccccatcctgagcatgctgaccaaccagaccggcgaggccggcagactgagcaacatcagccacctgaactactgcgagcccgacctgagagtgaccagcgtggtgaccggcttcaacaacctgcccgacagattcaaggacttcctgctgtacctgagatgcagaaactacagcctgctgatcgaccagcccgacaagtgcgccaagaagcccttcctgctgctggccatcaagagcctgaccccccacttcgccagaagacaggccatcagagagagctggggccaggagagcaacgccggcaaccagaccgtggtgagagtgttcctgctgggccagaccccccccgaggacaaccaccccgacctgagcgacatgctgaagttcgagagcgagaagcaccaggacatcctgatgtggaactacagagacaccttcttcaacctgagcctgaaggaggtgctgttcctgagatgggtgagcaccagctgccccgacaccgagttcgtgttcaagggcgacgacgacgtgttcgtgaacacccaccacatcctgaactacctgaacagcctgagcaagaccaaggccaaggacctgttcatcggcgacgtgatccacaacgccggcccccacagagacaagaagctgaagtactacatccccgaggtggtgtacagcggcctgtaccccccctacgccggcggcggcggcttcctgtacagcggccacctggccctgagactgtaccacatcaccgaccaggtgcacctgtaccccatcgacgacgtgtacaccggcatgtgcctgcagaagctgggcctggtgcccgagaagcacaagggcttcagaaccttcgacatcgaggagaagaacaagaacaacatctgcagctacgtggacctgatgctggtgcacagcagaaagccccaggagatgatcgacatctggagccagctgcagagcgcccacctgaagtgctag

SEQ ID NO: 23807 - DNA, 1194 bp, Artificial Sequence; identical to SEQ ID NO: 23806
  Description of Artificial Sequence: Synthetic coding sequence

SEQ ID NO: 23808 - DNA, 1137 bp, Artificial Sequence
  Description of Artificial Sequence: Synthetic coding sequence
atgagaatgctggtgagcggcagaagagtgaagaagtggcagctgatcatccagctgttcgccacctgcttcctggccagcctgatgttcttctgggagcccatcgacaaccacatcgtgagccacatgaagagctacagctacagatacctgatcaacagctacgacttcgtgaacgacaccctgagcctgaagcacaccagcgccggccccagataccagtacctgatcaaccacaaggagaagtgccaggcccaggacgtgctgctgctgctgttcgtgaagaccgcccccgagaactacgacagaagaagcggcatcagaagaacctggggcaacgagaactacgtgagaagccagctgaacgccaacatcaagaccctgttcgccctgggcacccccaaccccctggagggcgaggagctgcagagaaagctggcctgggaggaccagagatacaacgacatcatccagcaggacttcgtggacagcttctacaacctgaccctgaagctgctgatgcagttcagctgggccaacacctactgcccccacgccaagttcctgatgaccgccgacgacgacatcttcatccacatgcccaacctgatcgagtacctgcagagcctggagcagatcggcgtgcaggacttctggatcggcagagtgcacagaggcgccccccccatcagagacaagagcagcaagtactacgtgagctacgagatgtaccagtggcccgcctaccccgactacaccgccggcgccgcctacgtgatcagcggcgacgtggccgccaaggtgtacgaggccagccagaccctgaacagcagcctgtacatcgacgacgtgttcatgggcctgtgcgccaacaagatcggcatcgtgccccaggaccacgtgttcttcagcggcgagggcaagaccccctaccacccctgcatctacgagaagatgatgaccagccacggccacctggaggacctgcaggacctgtggaagaacgccaccgaccccaaggtgaagaccatcagcaagggcttcttcggccagatctactgcagactgatgaagatcatcctgctgtgcaagatcagctacgtggacacctacccctgcagagccgccttcatctag

SEQ ID NO: 23809 - DNA, 1137 bp, Artificial Sequence; identical to SEQ ID NO: 23808
  Description of Artificial Sequence: Synthetic coding sequence

SEQ ID NO: 23810 - DNA, 189 bp, Artificial Sequence
  Description of Artificial Sequence: Synthetic coding sequence
atgagaatgctggtgagcggcagaagagtgaagaagtggcagctgatcatccagctgttcgccacctgcttcctggccagcctgatgttcttctgggagcccatcgacaaccacatcgtgagccacatgaagagctacagctacagatacctgatcaacagctacgacttcgtgaacgacaccctgtag

SEQ ID NO: 23811 - DNA, 246 bp, Artificial Sequence
  Description of Artificial Sequence: Synthetic coding sequence
atgagaatgctggtgagcggcagaagagtgaagaagtggcagctgatcatccagctgttcgccacctgcttcctggccagcctgatgttcttctgggagcccatcgacaaccacatcgtgagccacatgaagagctacagctacagatacctgatcaacagctacgacttcgtgaacgacaccctgagcctgaagcacaccagcgccggccccagataccagtacctgatcaaccacaaggagtag

SEQ ID NO: 23812 - DNA, 1137 bp, Artificial Sequence; identical to SEQ ID NO: 23808
  Description of Artificial Sequence: Synthetic coding sequence

SEQ ID NO: 23813 - DNA, 153 bp, Artificial Sequence
  Description of Artificial Sequence: Synthetic coding sequence
atgagaatgctggtgagcggcagaagagtgaagaagtggcagctgatcatccagctgttcgccacctgcttcctggccagcctgatgttcttctgggagcccatcgacaaccacatcgtgagccacatgaagagctacagctacagatactag

SEQ ID NO: 23814 - DNA, 1206 bp, Artificial Sequence
  Description of Artificial Sequence: Synthetic coding sequence
atgagcctgtggaagaagaccgtgtacagaagcctgtgcctggccctggccctgctggtggccgtgaccgtgttccagagaagcctgacccccggccagttcctgcaggagccccccccccccaccctggagccccagaaggcccagaagcccaacggccagctggtgaaccccaacaacttctggaagaaccccaaggacgtggccgcccccacccccatggccagccagggcccccaggcctgggacgtgaccaccaccaactgcagcgccaacatcaacctgacccaccagccctggttccaggtgctggagccccagttcagacagttcctgttctacagacactgcagatacttccccatgctgctgaaccaccccgagaagtgcagaggcgacgtgtacctgctggtggtggtgaagagcgtgatcacccagcacgacagaagagaggccatcagacagacctggggcagagagagacagagcgccggcggcggcagaggcgccgtgagaaccctgttcctgctgggcaccgccagcaagcaggaggagagaacccactaccagcagctgctggcctacgaggacagactgtacggcgacatcctgcagtggggcttcctggacaccttcttcaacctgaccctgaaggagatccacttcctgaagtggctggacatctactgcccccacgtgcccttcatcttcaagggcgacgacgacgtgttcgtgaaccccaccaacctgctggagttcctggccgacagacagccccaggagaacctgttcgtgggcgacgtgctgcagcacgccagacccatcagaagaaaggacaacaagtactacatccccggcgccctgtacggcaaggccagctaccccccctacgccggcggcggcggcttcctgatggccggcagcctggccagaagactgcaccacgcctgcgacaccctggagctgtaccccatcgacgacgtgttcctgggcatgtgcctggaggtgctgggcgtgcagcccaccgcccacgagggcttcaagaccttcggcatcagcagaaacagaaacagcagaatgaacaaggagccctgcttcttcagagccatgctggtggtgcacaagctgctgccccccgagctgctggccatgtggggcctggtgcacagcaacctgacctgcagcagaaagctgcaggtgctgtag

SEQ ID NO: 23815 - DNA, 1194 bp, Artificial Sequence
  Description of Artificial Sequence: Synthetic coding sequence
atgagatgccccaagtgcctgctgtgcctgagcgccctgctgaccctgctgggcctgaaggtgtacatcgagtggaccagcgagagcagactgagcaaggcctaccccagccccagaggcaccccccccagccccacccccgccaaccccgagcccaccctgcccgccaacctgagcaccagactgggccagaccatccccctgcccttcgcctactggaaccagcagcagtggagactgggcagcctgcccagcggcgacagcaccgagaccggcggctgccaggcctggggcgccgccgccgccaccgagatccccgacttcgccagctaccccaaggacctgagaagattcctgctgagcgccgcctgcagaagcttcccccagtggctgcccggcggcggcggcagccaggtgagcagctgcagcgacaccgacgtgccctacctgctgctggccgtgaagagcgagcccggcagattcgccgagagacaggccgtgagagagacctggggcagccccgcccccggcatcagactgctgttcctgctgggcagccccgtgggcgaggccggccccgacctggacagcctggtggcctgggagagcagaagatacagcgacctgctgctgtgggacttcctggacgtgcccttcaaccagaccctgaaggacctgctgctgctggcctggctgggcagacactgccccaccgtgagcttcgtgctgagagcccaggacgacgccttcgtgcacacccccgccctgctggcccacctgagagccctgccccccgccagcgccagaagcctgtacctgggcgaggtgttcacccaggccatgcccctgagaaagcccggcggccccttctacgtgcccgagagcttcttcgagggcggctaccccgcctacgccagcggcggcggctacgtgatcgccggcagactggccccctggctgctgagagccgccgccagagtggcccccttccccttcgaggacgtgtacaccggcctgtgcatcagagccctgggcctggtgccccaggcccaccccggcttcctgaccgcctggcccgccgacagaaccgccgaccactgcgccttcagaaacctgctgctggtgagacccctgggcccccaggccagcatcagactgtggaagcagctgcaggaccccagactgcagtgctag

SEQ ID NO: 23816 - DNA, 1209 bp, Artificial Sequence
  Description of Artificial Sequence: Synthetic coding sequence
atgagaagaagactgagactgagaagagacgccctgctgaccctgctgctgggcgccagcctgggcctgctgctgtacgcccagagagacggcgccgcccccaccgccagcgcccccagaggcagaggcagagccgcccccagacccacccccggccccagagccttccagctgcccgacgccggcgccgccccccccgcctacgagggcgacacccccgccccccccacccccaccggccccttcgacttcgccagatacctgagagccaaggaccagagaagattccccctgctgatcaaccagccccacaagtgcagaggcgacggcgcccccggcggcagacccgacctgctgatcgccgtgaagagcgtggccgaggacttcgagagaagacaggccgtgagacagacctggggcgccgagggcagagtgcagggcgccctggtgagaagagtgttcctgctgggcgtgcccagaggcgccggcagcggcggcgccgacgaggtgggcgagggcgccagaacccactggagagccctgctgagagccgagagcctggcctacgccgacatcctgctgtgggccttcgacgacaccttcttcaacctgaccctgaaggagatccacttcctggcctgggccagcgccttctgccccgacgtgagattcgtgttcaagggcgacgccgacgtgttcgtgaacgtgggcaacctgctggagttcctggcccccagagaccccgcccaggacctgctggccggcgacgtgatcgtgcacgccagacccatcagaaccagagccagcaagtactacatccccgaggccgtgtacggcctgcccgcctaccccgcctacgccggcggcggcggcttcgtgctgagcggcgccaccctgcacagactggccggcgcctgcgcccaggtggagctgttccccatcgacgacgtgttcctgggcatgtgcctgcagagactgagactgacccccgagccccaccccgccttcagaaccttcggcatcccccagcccagcgccgccccccacctgagcaccttcgacccctgcttctacagagagctggtggtggtgcacggcctgagcgccgccgacatctggctgatgtggagactgctgcacggcccccacggccccgcctgcgcccacccccagcccgtggccgccggccccttccagtgggacagctag

SEQ ID NO: 23817 - DNA, 1584 bp, Artificial Sequence; identical to SEQ ID NO: 23793
  Description of Artificial Sequence: Synthetic coding sequence

SEQ ID NO: 23818 - DNA, 717 bp, Artificial Sequence; identical to SEQ ID NO: 23794
  Description of Artificial Sequence: Synthetic coding sequence

SEQ ID NO: 23819 - DNA, 1587 bp, Artificial Sequence; identical to SEQ ID NO: 23795
  Description of Artificial Sequence: Synthetic coding sequence

SEQ ID NO: 23820 - DNA, 1827 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctgggcatgatcttcaacgagagagaccaggagctgagagacctgggctaccagaagcacgccttcaacatgctgatcagcgacagactgggctaccacagagacgtgcccgacaccagaaacgccgcctgcaaggagaagttctacccccccgacctgcccgccgccagcgtggtgatctgcttctacaacgaggccttcagcgccctgctgagaaccgtgcacagcgtgatcgacagaacccccgcccacctgctgcacgagatcatcctggtggacgacgacagcgacttcgacgacctgaagggcgagctggacgagtacgtgcagaagtacctgcccggcaagatcaaggtgatcagaaacaccaagagagagggcctgatcagaggcagaatgatcggcgccgcccacgccaccggcgaggtgctggtgttcctggacagccactgcgaggtgaacgtgatgtggctgcagcccctgctggccgccatcagagaggacagacacaccgtggtgtgccccgtgatcgacatcatcagcgccgacaccctggcctacagcagcagccccgtggtgagaggcggcttcaactggggcctgcacttcaagtgggacctggtgcccctgagcgagctgggcagagccgagggcgccaccgcccccatcaagagccccaccatggccggcggcctgttcgccatgaacagacagtacttccacgagctgggccagtacgacagcggcatggacatctggggcggcgagaacctggagatcagcttcagaatctggatgtgcggcggcaagctgttcatcatcccctgcagcagagtgggccacatcttcagaaagagaagaccctacggcagccccgagggccaggacaccatgacccacaacagcctgagactggcccacgtgtggctggacgagtacaaggagcagtacttcagcctgagacccgacctgaagaccaagagctacggcaacatcagcgagagagtggagctgagaaagaagctgggctgcaagagcttcaagtggtacctggacaacgtgtaccccgagatgcagatcagcggcagccacgccaagccccagcagcccatcttcgtgaacagaggccccaagagacccaaggtgctgcagagaggcagactgtaccacctgcagaccaacaagtgcctggtggcccagggcagacccagccagaagggcggcctggtggtgctgaaggcctgcgactacagcgaccccaaccagatctggatctacaacgaggagcacgagctggtgctgaacagcctgctgtgcctggacatgagcgagaccagaagcagcgacccccccagactgatgaagtgccacggcagcggcggcagccagcagtggaccttcggcaagaacaacagactgtaccaggtgagcgtgggccagtgcctgagagccgtggaccccctgggccagaagggcagcgtggccatggccatctgcgacggcagcagcagccagcagtggcacctggagggctag

SEQ ID NO: 23821 - DNA, 609 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctgggcatgatcttcaacgagagagaccaggagctgagagacctgggctaccagaagcacgccttcaacatgctgatcagcgacagactgggctaccacagagacgtgcccgacaccagaaacgccgcctgcaaggagaagttctacccccccgacctgcccgccgccagcgtggtgatctgcttctacaacgaggccttcagcgccctgctgagaaccgtgcacagcgtgatcgacagaacccccgcccacctgctgcacgagatcatcctggtggacgacgacagcgacttcggcaaggagtgctgcacctggtag

SEQ ID NO: 23822 - DNA, 561 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctgggcatgatcttcaacgagagagaccaggagctgagagacctgggctaccagaagcacgccttcaacatgctgatcagcgacagactgggctaccacagagacgtgcccgacaccagaaacgccgcctgcaaggagaagttctacccccccgacctgcccgccgccagcgtggtgatctgcttctacaacgaggccttcagcgccctgctgagaaccgtgcacagcgtgatcgacagaacccccgcccacctgctgcacgagatctag

SEQ ID NO: 23823 - DNA, 402 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctggacgtgaagaagagcagcacccacctgacctgccagctgctggtgctgctgagcgtgagcatcatgaagagattcctgccctgcttcggccagtgcaccgtgagctag

SEQ ID NO: 23824 - DNA, 1827 bp, Artificial Sequence; identical to SEQ ID NO: 23820
  Description of Artificial Sequence: Synthetic coding sequence

SEQ ID NO: 23825 - DNA, 297 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctgtag

SEQ ID NO: 23826 - DNA, 1827 bp, Artificial Sequence; identical to SEQ ID NO: 23820
  Description of Artificial Sequence: Synthetic coding sequence

SEQ ID NO: 23827 - DNA, 1827 bp, Artificial Sequence; identical to SEQ ID NO: 23820
  Description of Artificial Sequence: Synthetic coding sequence

SEQ ID NO: 23828 - DNA, 483 bp, Artificial Sequence
  Description of Artificial Sequence: Synthetic coding sequence
atgggcagcgtgaccgtgagatacttctgctacggctgcctgttcaccagcgccacctggaccgtgctgctgttcgtgtacttcaacttcagcgaggtgacccagcccctgaagaacgtgcccgtgaagggcagcggcccccacggccccagccccaagaagttctaccccagattcaccagaggccccagcagagtgctggagccccagttcaaggccaacaagatcgacgacgtgatcgacagcagagtggaggaccccgaggagggccacctgaagttcagcagcgagctgggcatgatcttcaacgagagagaccaggagctgagagacctgggctaccagaagcacgccttcaacatgctgatcagcgacagactgggctaccacagagacgtgcccgacaccagaaacgccgcctgcaaggagaagttctacccccccgacctgcccgccgccagcgtggtgatctgcttctactag

SEQ ID NO: 23829 - DNA, 1584 bp, Artificial Sequence
  Description of Artificial Sequence: Synthetic coding sequence
atgccccagcccgagagccagaaggccgccatcctgggctgcggccagggcggcatgatcttcaacgagagagaccaggagctgagagacctgggctaccagaagcacgccttcaacatgctgatcagcgacagactgggctaccacagagacgtgcccgacaccagaaacgccgcctgcaaggagaagttctacccccccgacctgcccgccgccagcgtggtgatctgcttctacaacgaggccttcagcgccctgctgagaaccgtgcacagcgtgatcgacagaacccccgcccacctgctgcacgagatcatcctggtggacgacgacagcgacttcgacgacctgaagggcgagctggacgagtacgtgcagaagtacctgcccggcaagatcaaggtgatcagaaacaccaagagagagggcctgatcagaggcagaatgatcggcgccgcccacgccaccggcgaggtgctggtgttcctggacagccactgcgaggtgaacgtgatgtggctgcagcccctgctggccgccatcagagaggacagacacaccgtggtgtgccccgtgatcgacatcatcagcgccgacaccctggcctacagcagcagccccgtggtgagaggcggcttcaactggggcctgcacttcaagtgggacctggtgcccctgagcgagctgggcagagccgagggcgccaccgcccccatcaagagccccaccatggccggcggcctgttcgccatgaacagacagtacttccacgagctgggccagtacgacagcggcatggacatctggggcggcgagaacctggagatcagcttcagaatctggatgtgcggcggcaagctgttcatcatcccctgcagcagagtgggccacatcttcagaaagagaagaccctacggcagccccgagggccaggacaccatgacccacaacagcctgagactggcccacgtgtggctggacgagtacaaggagcagtacttcagcctgagacccgacctgaagaccaagagctacggcaacatcagcgagagagtggagctgagaaagaagctgggctgcaagagcttcaagtggtacctggacaacgtgtaccccgagatgcagatcagcggcagccacgccaagccccagcagcccatcttcgtgaacagaggccccaagagacccaaggtgctgcagagaggcagactgtaccacctgcagaccaacaagtgcctggtggcccagggcagacccagccagaagggcggcctggtggtgctgaaggcctgcgactacagcgaccccaaccagatctggatctacaacgaggagcacgagctggtgctgaacagcctgctgtgcctggacatgagcgagaccagaagcagcgacccccccagactgatgaagtgccacggcagcggcggcagccagcagtggaccttcggcaagaacaacagactgtaccaggtgagcgtgggccagtgcctgagagccgtggaccccctgggccagaagggcagcgtggccatggccatctgcgacggcagcagcagccagcagtggcacctggagggctag

SEQ ID NO: 23830 - DNA, 2823 bp, Artificial Sequence
  Description of Artificial Sequence: Synthetic coding sequence
atgaacagaatcagaaagttcttcagaggcagcggcagagtgctggccttcatcttcgtggccagcgtgatctggctgctgttcgacatggccgccctgagactgagcttcagcgagatcaacaccagagtgatcaaggaggacatcgtgagaagagagagaatcggcttcagagtgcagcccgaccagggcaagatcttctacagcagcatcaaggagatgaagccccccctgagaggccacggcaagggcgcctggggcaaggagaacgtgagaaagaccgaggagagcgtgctgaaggtggaggtggacctggaccagacccagagagagagaaagatgcagaacgccctgggcagaggcaaggtggtgcccctgtggcaccccgcccacctgcagaccctgcccgtgacccccaacaagcagaagaccgacggcagaggcaccaagcccgaggccagcagccaccagggcacccccaagcagaccaccgcccagggcgcccccaagaccagcttcatcgccgccaagggcacccaggtggtgaagatcagcgtgcacatgggcagagtgagcctgaagcaggagcccagaaagagccacagccccagcagcgacaccagcaagctggccgccgagagagacctgaacgtgaccatcagcctgagcaccgacagacccaagcagagaagccaggccgtggccaacgagagagcccaccccgccagcaccgccgtgcccaagagcggcgaggccatggccctgaacaagaccaagacccagagcaaggaggtgaacgccaacaagcacaaggccaacaccagcctgcccttccccaagttcaccgtgaacagcaacagactgagaaagcagagcatcaacgagacccccctgggcagcctgagcaaggacgacggcgccagaggcgcccacggcaagaagctgaacttcagcgagagccacctggtgatcatcaccaaggaggaggagcagaaggccgaccccaaggaggtgagcaacagcaagaccaagaccatcttccccaaggtgctgggcaagagccagagcaagcacatcagcagaaacagaagcgagatgagcagcagcagcctggccccccacagagtgcccctgagccagaccaaccacgccctgaccggcggcctggagcccgccaagatcaacatcaccgccaaggcccccagcaccgagtacaaccagagccacatcaaggccctgctgcccgaggacagcggcacccaccaggtgctgagaatcgacgtgaccctgagccccagagaccccaaggcccccggccagttcggcagacccgtggtggtgccccacggcaaggagaaggaggccgagagaagatggaaggagggcaacttcaacgtgtacctgagcgacctgatccccgtggacagagccatcgaggacaccagacccgccggctgcgccgagcagctggtgcacaacaacctgcccaccaccagcgtgatcatgtgcttcgtggacgaggtgtggagcaccctgctgagaagcgtgcacagcgtgatcaacagaagccccccccacctgatcaaggagatcctgctggtggacgacttcagcaccaaggactacctgaaggacaacctggacaagtacatgagccagttccccaaggtgagaatcctgagactgaaggagagacacggcctgatcagagccagactggccggcgcccagaacgccaccggcgacgtgctgaccttcctggacagccacgtggagtgcaacgtgggctggctggagcccctgctggagagagtgtacctgagcagaaagaaggtggcctgccccgtgatcgaggtgatcaacgacaaggacatgagctacatgaccgtggacaacttccagagaggcatcttcgtgtggcccatgaacttcggctggagaaccatcccccccgacgtgatcgccaagaacagaatcaaggagaccgacaccatcagatgccccgtgatggccggcggcctgttcagcatcgacaagagctacttcttcgagctgggcacctacgaccccggcctggacgtgtggggcggcgagaacatggagctgagcttcaaggtgtggatgtgcggcggcgagatcgagatcatcccctgcagcagagtgggccacatcttcagaaacgacaacccctacagcttccccaaggacagaatgaagaccgtggagagaaacctggtgagagtggccgaggtgtggctggacgagtacaaggagctgttctacggccacggcgaccacctgatcgaccagggcctggacgtgggcaacctgacccagcagagagagctgagaaagaagctgaagtgcaagagcttcaagtggtacctggagaacgtgttccccgacctgagagcccccatcgtgagagccagcggcgtgctgatcaacgtggccctgggcaagtgcatcagcatcgagaacaccaccgtgatcctggaggactgcgacggcagcaaggagctgcagcagttcaactacacctggctgagactgatcaagtgcggcgagtggtgcatcgcccccatccccgacaagggcgccgtgagactgcacccctgcgacaacagaaacaagggcctgaagtggctgcacaagagcaccagcgtgttccaccccgagctggtgaaccacatcgtgttcgagaacaaccagcagctgctgtgcctggagggcaacttcagccagaagatcctgaaggtggccgcctgcgaccccgtgaagccctaccagaagtggaagttcgagaagtactacgaggcctag

SEQ ID NO: 23831 - DNA, 1677 bp, Artificial Sequence
  Description of Artificial Sequence: Synthetic coding sequence
atgagaaagatcagagccaacgccatcgccatcctgaccgtggcctggatcctgggcaccttctactacctgtggcaggacaacagagcccacgccgccagcagcggcggcagaggcgcccagagagccggcagaagaagcgagcagctgagagaggacagaaccatccccctgatcgtgaccggcacccccagcaagggcttcgacgagaaggcctacctgagcgccaagcagctgaaggccggcgaggacccctacagacagcacgccttcaaccagctggagagcgacaagctgagccccgacagacccatcagagacaccagacactacagctgccccagcgtgagctacagcagcgacctgcccgccaccagcgtgatcatcaccttccacaacgaggccagaagcaccctgctgagaaccgtgaagagcgtgctgaacagaacccccgccaacctgatccaggagatcatcctggtggacgacttcagcagcgaccccgaggactgcctgctgctgaccagaatccccaaggtgaagtgcctgagaaacgacagaagagagggcctgatcagaagcagagtgagaggcgccgacgtggccgccgccaccgtgctgaccttcctggacagccactgcgaggtgaacaccgagtggctgccccccatgctgcagagagtgaaggaggaccacaccagagtggtgagccccatcatcgacgtgatcagcctggacaacttcgcctacctggccgccagcgccgacctgagaggcggcttcgactggagcctgcacttcaagtgggagcagatccccctggagcagaagatgaccagaaccgaccccaccagacccatcagaacccccgtgatcgccggcggcatcttcgtgatcgacaagagctggttcaaccacctgggcaagtacgacgcccagatggacatctggggcggcgagaacttcgagctgagcttcagagtgtggatgtgcggcggcagcctggagatcgtgccctgcagcagagtgggccacgtgttcagaaagagacacccctacaacttccccgagggcaacgccctgacctacatcagaaacaccaagagaaccgccgaggtgtggatggacgagtacaagcagtactactacgaggccagacccagcgccatcggcaaggccttcggcagcgtggccaccagaatcgagcagagaaagaagatgaactgcaagagcttcagatggtacctggagaacgtgtaccccgagctgaccgtgcccgtgaaggaggccctgcccggcatcatcaagcagggcgtgaactgcctggagagccagggccagaacaccgccggcgacttcctgctgggcatgggcatctgcagaggcagcgccaagaacccccagcccgcccaggcctggctgttcagcgaccacctgatccagcagcagggcaagtgcctggccgccaccagcaccctgatgagcagccccggcagccccgtgatcctgcagatgtgcaaccccagagagggcaagcagaagtggagaagaaagggcagcttcatccagcacagcgtgagcggcctgtgcctggagaccaagcccgcccagctggtgaccagcaagtgccaggccgacgcccaggcccagcagtggcagctgctgccccacacctag

SEQ ID NO: 23832 - DNA, 1677 bp, Artificial Sequence; identical to SEQ ID NO: 23831
  Description of Artificial Sequence: Synthetic coding sequence

SEQ ID NO: 23833 - DNA, 555 bp, Artificial Sequence
  Description of Artificial Sequence: Synthetic coding sequence
atggacgagtacaagcagtactactacgaggccagacccagcgccatcggcaaggccttcggcagcgtggccaccagaatcgagcagagaaagaagatgaactgcaagagcttcagatggtacctggagaacgtgtaccccgagctgaccgtgcccgtgaaggaggccctgcccggcatcatcaagcagggcgtgaactgcctggagagccagggccagaacaccgccggcgacttcctgctgggcatgggcatctgcagaggcagcgccaagaacccccagcccgcccaggcctggctgttcagcgaccacctgatccagcagcagggcaagtgcctggccgccaccagcaccctgatgagcagccccggcagccccgtgatcctgcagatgtgcaaccccagagagggcaagcagaagtggagaagaaagggcagcttcatccagcacagcgtgagcggcctgtgcctggagaccaagcccgcccagctggtgaccagcaagtgccaggccgacgcccaggcccagcagtggcagctgctgccccacacctag

SEQ ID NO: 23834 - DNA, 1629 bp, Artificial Sequence
  Description of Artificial Sequence: Synthetic coding sequence
atgagaaagatcagagccaacgccatcgccatcctgaccgtggcctggatcctgggcaccttctactacctgtggcaggacaacagagcccacgccgccagcagcggcggcagaggcgcccagagagccggcagaagaagcgagcagctgagagaggacagaaccatccccctgatcgtgaccggcacccccagcaagggcttcgacgagaaggcctacctgagcgccaagcagctgaaggccggcgaggacccctacagacagcacgccttcaaccagctggagagcgacaagctgagccccgacagacccatcagagacaccagacactacagctgccccagcgtgagctacagcagcgacctgcccgccaccagcgtgatcatcaccttccacaacgaggccagaagcaccctgctgagaaccgtgaagagcgtgctgaacagaacccccgccaacctgatccaggagatcatcctggtggacgacttcagcagcgaccccgaggactgcctgctgctgaccagaatccccaaggtgaagtgcctgagaaacgacagaagagagggcctgatcagaagcagagtgagaggcgccgacgtggccgccgccaccgtgctgaccttcctggacagccactgcgaggtgaacaccgagtggctgccccccatgctgcagagagtgaaggaggaccacaccagagtggtgagccccatcatcgacgtgatcagcctggacaacttcgcctacctggccgccagcgccgacctgagaggcggcttcgactggagcctgcacttcaagtgggagcagatccccctggagcagaagatgaccagaaccgaccccaccagacccatcagaacccccgtgatcgccggcggcatcttcgtgatcgacaagagctggttcaaccacctgggcaagtacgacgcccagatggacatctggggcggcgagaacttcgagctgagcttcagagtgtggatgtgcggcggcagcctggagatcgtgccctgcagcagagtgggccacgtgttcagaaagagacacccctacaacttccccgagggcaacgccctgacctacatcagaaacaccaagagaaccgccgaggtgtggatggacgagtacaagcagtactactacgaggccagacccagcgccatcggcaaggccttcggcagcgtggccaccagaatcgagcagagaaagaagatgaactgcaagagcttcagatggtacctggagaacgtgtaccccgagctgaccgtgcccgtgaaggaggccctgcccggcatcatcaagcagggcgtgaactgcctggagagccagggccagaacaccgccggcgacttcctgctgggcatgggcatctgcagaggcagcgccaagaacccccagcccgcccaggcctggctgttcagcgaccacctgatccagcagcagggcaagtgcctggccgccaccagcaccctgatgagcagccccggcagccccgtgatcctgcagatgtgcaaccccagagagggcaagcaggtgagcctgctggccagcggccccgaggcccagcagcccgagggcccctgcctgagagtggccgacctgggcagaagagcccccgactag

SEQ ID NO: 23835 - DNA, 1920 bp, Artificial Sequence
  Description of Artificial Sequence: Synthetic coding sequence
atgctgctgagaaagagatacagacacagaccctgcagactgcagttcctgctgctgctgctgatgctgggctgcgtgctgatgatggtggccatgctgcaccccccccaccacaccctgcaccagaccgtgaccgcccaggccagcaagcacagccccgaggccagatacagactggacttcggcgagagccaggactgggtgctggaggccgaggacgagggcgaggagtacagccccctggagggcctgccccccttcatcagcctgagagaggaccagctgctggtggccgtggccctgccccaggccagaagaaaccagagccagggcagaagaggcggcagctacagactgatcaagcagcccagaagacaggacaaggaggcccccaagagagactggggcgccgacgaggacggcgaggtgagcgaggaggaggagctgacccccttcagcctggaccccagaggcctgcaggaggccctgagcgccagaatccccctgcagagagccctgcccgaggtgagacaccccctgtgcctgcagcagcacccccaggacagcctgcccaccgccagcgtgatcctgtgcttccacgacgaggcctggagcaccctgctgagaaccgtgcacagcatcctggacaccgtgcccagagccttcctgaaggagatcatcctggtggacgacctgagccagcagggccagctgaagagcgccctgagcgagtacgtggccagactggagggcgtgaagctgctgagaagcaacaagagactgggcgccatcagagccagaatgctgggcgccaccagagccaccggcgacgtgctggtgttcatggacgcccactgcgagtgccaccccggctggctggagcccctgctgagcagaatcgccggcgacagaagcagagtggtgagccccgtgatcgacgtgatcgactggaagaccttccagtactaccccagcaaggacctgcagagaggcgtgctggactggaagctggacttccactgggagcccctgcccgagcacgtgagaaaggccctgcagagccccatcagccccatcagaagccccgtggtgcccggcgaggtggtggccatggacagacactacttccagaacaccggcgcctacgacagcctgatgagcctgagaggcggcgagaacctggagctgagcttcaaggcctggctgtgcggcggcagcgtggagatcctgccctgcagcagagtgggccacatctaccagaaccaggacagccacagccccctggaccaggaggccaccctgagaaacagagtgagaatcgccgagacctggctgggcagcttcaaggagaccttctacaagcacagccccgaggccttcagcctgagcaaggccgagaagcccgactgcatggagagactgcagctgcagagaagactgggctgcagaaccttccactggttcctggccaacgtgtaccccgagctgtaccccagcgagcccagacccagcttcagcggcaagctgcacaacaccggcctgggcctgtgcgccgactgccaggccgagggcgacatcctgggctgccccatggtgctggccccctgcagcgacagcagacagcagcagtacctgcagcacaccagcagaaaggagatccacttcggcagcccccagcacctgtgcttcgccgtgagacaggagcaggtgatcctgcagaactgcaccgaggagggcctggccatccaccagcagcactgggacttccaggagaacggcatgatcgtgcacatcctgagcggcaagtgcatggaggccgtggtgcaggagaacaacaaggacctgtacctgagaccctgcgacggcaaggccagacagcagtggagattcgaccagatcaacgccgtggacgagagatag

SEQ ID NO: 23836 - DNA, 591 bp, Artificial Sequence
  Description of Artificial Sequence: Synthetic coding sequence
atggagagactgcagctgcagagaagactgggctgcagaaccttccactggttcctggccaacgtgtaccccgagctgtaccccagcgagcccagacccagcttcagcggcaagctgcacaacaccggcctgggcctgtgcgccgactgccaggccgagggcgacatcctgggctgccccatggtgctggccccctgcagcgacagcagacagcagcagtacctgcagcacaccagcagaaaggagatccacttcggcagcccccagcacctgtgcttcgccgtgagacaggagcaggtgatcctgcagaactgcaccgaggagggcctggccatccaccagcagcactgggacttccaggagaacggcatgatcgtgcacatcctgagcggcaagtgcatggaggccgtggtgcaggagaacaacaaggacctgtacctgagaccctgcgacgagaagcccgccagcagcggcgtgctgaccagaagcatgctgtggatgaacgacgagtgccagtgccagaaggagaagagaatcctggccatcaagatccagctgcaggtgaacctgaagagcctgtacatcagctag

SEQ ID NO: 23837 - DNA, 1737 bp, Artificial Sequence
  Description of Artificial Sequence: Synthetic coding sequence
atgctgccctgcctggtggtgctgctggccgccctgctgagcctgagactgggcagcgacgcccacggcaccgagctgcccagcccccccagcgtgtggttcgaggccgagttcttccaccacatcctgcactggacccccatccccaaccagagcgagagcacctgctacgaggtggccctgctgagatacggcatcgagagctggaacagcatcagcaactgcagccagaccctgagctacgacctgaccgccgtgaccctggacctgtaccacagcaacggctacagagccagagtgagagccgtggacggcagcagacacagcaactggaccgtgaccaacaccagattcagcgtggacgaggtgaccctgaccgtgggcagcgtgaacctggagatccacaacggcttcatcctgggcaagatccagctgcccagacccaagatggcccccgccaacgacacctacgagagcatcttcagccacttcagagagtacgagatcgccatcagaaaggtgcccggcaacttcaccttcacccacaagaaggtgaagcacgagaacttcagcctgctgaccagcggcgaggtgggcgagttctgcgtgcaggtgaagcccagcgtggccagcagaagcaacaagggcatgtggagcaaggaggagtgcatcagcctgaccagacagtacttcaccgtgaccaacgtgatcatcttcttcgccttcgtgctgctgctgagcggcgccctggcctactgcctggccctgcagctgtacgtgagaagaagaaagaagctgcccagcgtgctgctgttcaagaagcccagccccttcatcttcatcagccagagacccagccccgagacccaggacaccatccaccccctggacgaggaggccttcctgaaggtgagccccgagctgaagaacctggacctgcacggcagcaccgacagcggcttcggcagcaccaagcccagcctgcagaccgaggagccccagttcctgctgcccgacccccacccccaggccgacagaaccctgggcaacagagagccccccgtgctgggcgacagctgcagcagcggcagcagcaacagcaccgacagcggcatctgcctgcaggagcccagcctgagccccagcaccggccccacctgggagcagcaggtgggcagcaacagcagaggccaggacgacagcggcatcgacctggtgcagaacagcgagggcagagccggcgacacccagggcggcagcgccctgggccaccacagcccccccgagcccgaggtgcccggcgaggaggaccccgccgccgtggccttccagggctacctgagacagaccagatgcgccgaggagaaggccaccaagaccggctgcctggaggaggagagccccctgaccgacggcctgggccccaagttcggcagatgcctggtggacgaggccggcctgcacccccccgccctggccaagggctacctgaagcaggaccccctggagatgaccctggccagcagcggcgcccccaccggccagtggaaccagcccaccgaggagtggagcctgctggccctgagcagctgcagcgacctgggcatcagcgactggagcttcgcccacgacctggcccccctgggctgcgtggccgcccccggcggcctgctgggcagcttcaacagcgacctggtgaccctgcccctgatcagcagcctgcagagcagcgagtag

SEQ ID NO: 23838 - DNA, 1332 bp, Artificial Sequence
  Description of Artificial Sequence: Synthetic coding sequence
atgagaaacgccatcatccagggcctgttctacggcagcctgaccttcggcatctggaccgccctgctgttcatctacctgcaccacaaccacgtgagcagctggcagaagaagagccaggagcccctgagcgcctggagccccggcaagaaggtgcaccagcagatcatctacggcagcgagcagatccccaagccccacgtgatcgtgaagagaaccgacgaggacaaggccaagagcatgctgggcaccgacttcaaccacaccaaccccgagctgcacaaggagctgctgaagtacggcttcaacgtgatcatcagcagaagcctgggcatcgagagagaggtgcccgacaccagaagcaagatgtgcctgcagaagcactaccccgccagactgcccaccgccagcatcgtgatctgcttctacaacgaggagtgcaacgccctgttccagaccatgagcagcgtgaccaacctgaccccccactacttcctggaggagatcatcctggtggacgacatgagcaaggtggacgacctgaaggagaagctggactaccacctggagaccttcagaggcaaggtgaagatcatcagaaacaagaagagagagggcctgatcagagccagactgatcggcgccagccacgccagcggcgacgtgctggtgttcctggacagccactgcgaggtgaacagagtgtggctggagcccctgctgcacgccatcgccaaggaccccaagatggtggtgtgccccctgatcgacgtgatcgacgacagaaccctggagtacaagcccagccccctggtgagaggcaccttcgactggaacctgcagttcaagtgggacaacgtgttcagctacgagatggacggccccgagggcagcaccaagcccatcagaagccccgccatgagcggcggcatcttcgccatcagaagacactacttcaacgagatcggccagtacgacaaggacatggacttctggggcagagagaacctggagctgagcctgagaatctggatgtgcggcggccagctgttcatcatcccctgcagcagagtgggccacatcagcaagaagcagaccggcaagcccagcaccatcatcagcgccatgacccacaactacctgagactggtgcacgtgtggctggacgagtacaaggagcagttcttcctgagaaagcccggcctgaagtacgtgacctacggcaacatcagagagagagtggagctgagaaagagactgggctgcaagagcttccagtggtacctggacaacgtgttccccgagctggaggccagcgtgaacagcctgtag

SEQ ID NO: 23839 - DNA, 1332 bp, Artificial Sequence; identical to SEQ ID NO: 23838
  Description of Artificial Sequence: Synthetic coding sequence

SEQ ID NO: 23840 - DNA, 681 bp, Artificial Sequence
  Description of Artificial Sequence: Synthetic coding sequence
atgaagagaaagcagaagagattcctgcagatgaccctgctgttcaccgtggccctgatcttcctgcccaacgtgggcctgtggagcctgtacaaggacaagcacctggtgaagagcgccgagcccggcgagcagcagaccttccccctgggcctgggcgacggccagttctacagctggaccgacggcctgagaagaaaggactggcacgactacgagagcatccagaaggaggccatgagaagcggcaagggcgagcacggcaagccctaccccctgaccgaggaggaccacgacgacagcgcctacagagagaacggcttcaacatcttcgtgagcaacaacatcgccctggagagaagcctgcccgacatcagacacgccaactgcaagcacaagatgtacctggagagactgcccaacaccagcatcatcatccccttccacaacgagggctggaccagcctgctgagaaccatccacagcatcatcaacagaacccccggcagcctgatcgccgagatcatcctggtggacgacttcagcgagagagagcacctgaaggacaagctggaggagtacatggccagattcagcaaggtgagaatcgtgagaaccaagaagagagagggcagcggccccgtgagctggggccacctgtggcccgaggagaagagctag

SEQ ID NO: 23841 - DNA, 1806 bp, Artificial Sequence
  Description of Artificial Sequence: Synthetic coding sequence
atgaagagaaagcagaagagattcctgcagatgaccctgctgttcaccgtggccctgatcttcctgcccaacgtgggcctgtggagcctgtacaaggacaagcacctggtgaagagcgccgagcccggcgagcagcagaccttccccctgggcctgggcgacggccagttctacagctggaccgacggcctgagaagaaaggactggcacgactacgagagcatccagaaggaggccatgagaagcggcaagggcgagcacggcaagccctaccccctgaccgaggaggaccacgacgacagcgcctacagagagaacggcttcaacatcttcgtgagcaacaacatcgccctggagagaagcctgcccgacatcagacacgccaactgcaagcacaagatgtacctggagagactgcccaacaccagcatcatcatccccttccacaacgagggctggaccagcctgctgagaaccatccacagcatcatcaacagaacccccggcagcctgatcgccgagatcatcctggtggacgacttcagcgagagagagcacctgaaggacaagctggaggagtacatggccagattcagcaaggtgagaatcgtgagaaccaagaagagagagggcctgatcagaaccagactgctgggcgccagcatggccagaggcgaggtgctgaccttcctggacagccactgcgaggtgaacgtgaactggctgccccccctgctgaaccagatcgccctgaaccacaagaccatcgtgtgccccatgatcgacgtgatcgaccacaaccacttcggctacgaggcccaggccggcgacgccatgagaggcgccttcgactgggagatgtactacaagagaatccccatcccccccgagctgcagagagccgaccccagcgaccccttcgagagccccgtgatggccggcggcctgttcgccgtggacagaaagtggttctgggagctgggcggctacgaccccggcctggagatctggggcggcgagcagtacgagatcagcttcaaggtgtggatgtgcggcggcgagatgttcgacgtgccctgcagcagagtgggccacatctacagaaagtacgtgccctacaaggtgcccagcggcaccagcctggccagaaacctgaagagagtggccgagacctggatggacgagttcgccgagtacatctaccagagaagacccgagtacagacacctgagcaccggcgacatcagcgcccagaaggagctgagaaagcagctgaagtgcaaggacttcaagtggttcatggccgccgtggcctgggacgtgcccaagtactacccccccgtggagcccccccccgccgcctggggcgagatcagaaacgtggccgccaacctgtgcgtggacagcaagcacggcgccaccggcaccgagctgagactggacatctgcgtgaaggacggcagcgagagaacctggagccacgagcagctgttcaccttcggctggagagaggacatcagacccggcgagcccctgcacaccagaaagttctgcttcgacgccatcagccacaacagccccgtgaccctgtacgactgccacggcatgaagggcaaccagctgtggggctacagaaaggacagaaccctgttccaccccgtgagcaacagctgcatggactgcaaccccgccgagaagaagatcttcatggccagatgcgaccccctgagcgagacccagcagtggatcttcgagcacatcaacatgaccgtgctggagaagttcaaccaccacgccaacagctag

SEQ ID NO: 23842 - DNA, 1569 bp, Artificial Sequence
  Description of Artificial Sequence: Synthetic coding sequence
atgaacatcaacgacctgaagctgaccctgagcaaggccggccaggagcacctgctgagattctggaacgagctggaggaggcccagcaggtggagctgtacgccgagctgcaggccatgaacttcgaggagctgaacttcttcttccagaaggccatcgagggcttcaaccagagcagccaccagaagaacgtggacgccagaatggagcccgtgcccagagaggtgctgggcagcgccaccagagaccaggaccagctgcaggcctgggagagcgagggcctgttccagatcagccagaacaaggtggccgtgctgctgctggccggcggccagggcaccagactgggcgtggcctaccccaagggcatgtacgacgtgggcctgcccagcagaaagaccctgttccagatccaggccgagagaatcctgaagctgcagcaggtggccgagaagtactacggcaacaagtgcatcatcccctggtacatcatgaccagcggcagaaccatggagagcaccaaggagttcttcaccaagcacaagtacttcggcctgaagaaggagaacgtgatcttcttccagcagggcatgctgcccgccatgagcttcgacggcaagatcatcctggaggagaagaacaaggtgagcatggcccccgacggcaacggcggcctgtacagagccctggccgcccagaacatcgtggaggacatggagcagagaggcatctggagcatccacgtgtactgcgtggacaacatcctggtgaaggtggccgaccccagattcatcggcttctgcatccagaagggcgccgactgcggcgccaaggtggtggagaagaccaaccccaccgagcccgtgggcgtggtgtgcagagtggacggcgtgtaccaggtggtggagtacagcgagatcagcctggccaccgcccagaagagaagcagcgacggcagactgctgttcaacgccggcaacatcgccaaccacttcttcaccgtgcccttcctgagagacgtggtgaacgtgtacgagccccagctgcagcaccacgtggcccagaagaagatcccctacgtggacacccagggccagctgatcaagcccgacaagcccaacggcatcaagatggagaagttcgtgttcgacatcttccagttcgccaagaagttcgtggtgtacgaggtgctgagagaggacgagttcagccccctgaagaacgccgacagccagaacggcaaggacaaccccaccaccgccagacacgccctgatgagcctgcaccactgctgggtgctgaacgccggcggccacttcatcgacgagaacggcagcagactgcccgccatccccagaagcgccaccaacggcaagagcgagaccatcaccgccgacgtgaaccacaacctgaaggacgccaacgacgtgcccatccagtgcgagatcagccccctgatcagctacgccggcgagggcctggagagctacgtggccgacaaggagttccacgcccccctgatcatcgacgagaacggcgtgcacgagctggtgaagaacggcatctag

SEQ ID NO: 23843 - DNA, 1566 bp, Artificial Sequence
  Description of Artificial Sequence: Synthetic coding sequence
atgaacatcaacgacctgaagctgaccctgagcaaggccggccaggagcacctgctgagattctggaacgagctggaggaggcccagcaggtggagctgtacgccgagctgcaggccatgaacttcgaggagctgaacttcttcttccagaaggccatcgagggcttcaaccagagcagccaccagaagaacgtggacgccagaatggagcccgtgcccagagaggtgctgggcagcgccaccagagaccaggaccagctgcaggcctgggagagcgagggcctgttccagatcagccagaacaaggtggccgtgctgctgctggccggcggccagggcaccagactgggcgtggcctaccccaagggcatgtacgacgtgggcctgcccagcagaaagaccctgttccagatccaggccgagagaatcctgaagctgcagcaggtggccgagaagtactacggcaacaagtgcatcatcccctggtacatcatgaccagcggcagaaccatggagagcaccaaggagttcttcaccaagcacaagtacttcggcctgaagaaggagaacgtgatcttcttccagcagggcatgctgcccgccatgagcttcgacggcaagatcatcctggaggagaagaacaaggtgagcatggcccccgacggcaacggcggcctgtacagagccctggccgcccagaacatcgtggaggacatggagcagagaggcatctggagcatccacgtgtactgcgtggacaacatcctggtgaaggtggccgaccccagattcatcggcttctgcatccagaagggcgccgactgcggcgccaaggtggtggagaagaccaaccccaccgagcccgtgggcgtggtgtgcagagtggacggcgtgtaccaggtggtggagtacagcgagatcagcctggccaccgcccagaagagaagcagcgacggcagactgctgttcaacgccggcaacatcgccaaccacttcttcaccgtgcccttcctgagagacgtggtgaacgtgtacgagccccagctgcagcaccacgtggcccagaagaagatcccctacgtggacacccagggccagctgatcaagcccgacaagcccaacggcatcaagatggagaagttcgtgttcgacatcttccagttcgccaagaagttcgtggtgtacgaggtgctgagagaggacgagttcagccccctgaagaacgccgacagccagaacggcaaggacaaccccaccaccgccagacacgccctgatgagcctgcaccactgctgggtgctgaacgccggcggccacttcatcgacgagaacggcagcagactgcccgccatccccagagccaccaacggcaagagcgagaccatcaccgccgacgtgaaccacaacctgaaggacgccaacgacgtgcccatccagtgcgagatcagccccctgatcagctacgccggcgagggcctggagagctacgtggccgacaaggagttccacgcccccctgatcatcgacgagaacggcgtgcacgagctggtgaagaacggcatctag

SEQ ID NO: 23844 - DNA, 1569 bp, Artificial Sequence; identical to SEQ ID NO: 23842
  Description of Artificial Sequence: Synthetic coding sequence

SEQ ID NO: 23845 - DNA, 1518 bp, Artificial Sequence
  Description of Artificial Sequence: Synthetic coding sequence
atgaacatcaacgacctgaagctgaccctgagcaaggccggccaggagcacctgctgagattctggaacgagctggaggaggcccagcaggtggagctgtacgccgagctgcaggccatgaacttcgaggagctgaacttcttcttccagaaggccatcgagggcttcaaccagagcagccaccagaagaacgtggacgccagaatggagcccgtgcccagagaggtgctgggcagcgccaccagagaccaggaccagctgcaggcctgggagagcgagggcctgttccagatcagccagaacaaggtggccgtgctgctgctggccggcggccagggcaccagactgggcgtggcctaccccaagggcatgtacgacgtgggcctgcccagcagaaagaccctgttccagatccaggccgagagaatcctgaagctgcagcaggtggccgagaagtactacggcaacaagtgcatcatcccctggtacatcatgaccagcggcagaaccatggagagcaccaaggagttcttcaccaagcacaagtacttcggcctgaagaaggagaacgtgatcttcttccagcagggcatgctgcccgccatgagcttcgacggcaagatcatcctggaggagaagaacaaggtgagcatggcccccgacggcaacggcggcctgtacagagccctggccgcccagaacatcgtggaggacatggagcagagaggcatctggagcatccacgtgtactgcgtggacaacatcctggtgaaggtggccgaccccagattcatcggcttctgcatccagaagggcgccgactgcggcgccaaggtggtggagaagaccaaccccaccgagcccgtgggcgtggtgtgcagagtggacggcgtgtaccaggtggtggagtacagcgagatcagcctggccaccgcccagaagagaagcagcgacggcagactgctgttcaacgccggcaacatcgccaaccacttcttcaccgtgcccttcctgagagacgtggtgaacgtgtacgagccccagctgcagcaccacgtggcccagaagaagatcccctacgtggacacccagggccagctgatcaagcccgacaagcccaacggcatcaagatggagaagttcgtgttcgacatcttccagttcgccaagaagttcgtggtgtacgaggtgctgagagaggacgagttcagccccctgaagaacgccgacagccagaacggcaaggacaaccccaccaccgccagacacgccctgatgagcctgcaccactgctgggtgctgaacgccggcggccacttcatcgacgagaacggcagcagactgcccgccatccccagactgaaggacgccaacgacgtgcccatccagtgcgagatcagccccctgatcagctacgccggcgagggcctggagagctacgtggccgacaaggagttccacgcccccctgatcatcgacgagaacggcgtgcacgagctggtgaagaacggcatctag

SEQ ID NO: 23846 - DNA, 663 bp, Artificial Sequence
  Description of Artificial Sequence: Synthetic coding sequence
atgaacatcaacgacctgaagctgaccctgagcaaggccggccaggagcacctgctgagattctggaacgagctggaggaggcccagcaggtggagctgtacgccgagctgcaggccatgaacttcgaggagctgaacttcttcttccagaaggccatcgagggcttcaaccagagcagccaccagaagaacgtggacgccagaatggagcccgtgcccagagaggtgctgggcagcgccaccagagaccaggaccagctgcaggcctgggagagcgagggcctgttccagatcagccagaacaaggtggccgtgctgctgctggccggcggccagggcaccagactgggcgtggcctaccccaagggcatgtacgacgtgggcctgcccagcagaaagaccctgttccagatccaggccgagagaatcctgaagctgcagcaggtggccgagaagtactacggcaacaagtgcatcatcccctggtacatcatgaccagcggcagaaccatggagagcaccaaggagttcttcaccaagcacaagtacttcggcctgaagaaggagaacgtgatcttcttccagcagggcatgctgcccgccatgagcttcgacggcaagatcatcctggaggagaagaacaaggtgagcatggccccctag

SEQ ID NO: 23847 - DNA, 4776 bp, Artificial Sequence
  Description of Artificial Sequence: Synthetic coding sequence
atgagcctgctgtgcgtgagagtgaagagagccaagttccagggcagccccgacaagttcaacacctacgtgaccctgaaggtgcagaacgtgaagagcaccaccgtggccgtgagaggcgaccagcccagctgggagcaggacttcatgttcgagatcagcagactggacctgggcctgagcgtggaggtgtggaacaagggcctgatctgggacaccatggtgggcaccgtgtggatcgccctgaagaccatcagacagagcgacgaggagggccccggcgagtggagcaccctggaggccgagaccctgatgaaggacgacgagatctgcggcaccagaaaccccaccccccacaagatcctgctggacaccagattcgagctgcccttcgacatccccgaggaggaggccagatactggacctacaagtgggagcagatcaacgccctgggcgccgacaacgagtacagcagccaggaggagagccagagaaagcccctgcccaccgccgccgcccagtgcagcttcgaggaccccgacagcgccgtggacgacagagacagcgactacagaagcgagaccagcaacagcttcccccccccctaccacaccgccagccagcccaacgccagcgtgcaccagttccccgtgcccgtgagaagcccccagcagctgctgctgcagggcagcagcagagacagctgcaacgacagcatgcagagctacgacctggactaccccgagagaagagccatcagccccaccagcagcagcagatacggcagcagctgcaacgtgagccagggcagcagccagctgagcgagctggaccagtaccacgagcaggacgacgaccacagagagaccgacagcatccacagctgccacagcagccacagcctgagcagagacggccaggccggcttcggcgagcaggagaagcccctggaggtgaccggccaggccgagaaggaggccgcctgcgagcccaaggagatgaaggaggacgccaccacccaccccccccccgacctggtgctgcagaaggaccacttcctgggcccccaggagagcttccccgaggagaacgccagcagccccttcacccaggccagagcccactggatcagagccgtgaccaaggtgagactgcagctgcaggagatccccgacgacggcgaccccagcctgccccagtggctgcccgagggccccgccggcggcctgtacggcatcgacagcatgcccgacctgagaagaaagaagcccctgcccctggtgagcgacctgagcctggtgcagagcagaaaggccggcatcaccagcgccatggccaccagaaccagcctgaaggacgaggagctgaagagccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcagcgagtgcggcgtgaagtgccacgagaagtgccaggacctgctgaacgccgactgcctgcagagagccgccgagaagagctgcaagcacggcgccgaggacagaacccagaacatcatcatggccatgaaggacagaatgaagatcagagagagaaacaagcccgagatcttcgaggtgatcagagacgtgttcaccgtgaacaaggccgcccacgtgcagcagatgaagaccgtgaagcagagcgtgctggacggcaccagcaagtggagcgccaagatcaccatcaccgtggtgtgcgcccagggcctgcaggccaaggacaagaccggcagcagcgacccctacgtgaccgtgcaggtgagcaagaccaagaagagaaccaagaccatcttcggcaacctgaaccccgtgtgggaggagaagttccacttcgagtgccacaacagcagcgacagaatcaaggtgagagtgtgggacgaggacgacgacatcaagagcagagtgaagcagagactgaagagagagagcgacgacttcctgggccagaccatcatcgaggtgagaaccctgagcggcgagatggacgtgtggtacaacctggagaagagaaccgacaagagcgccgtgagcggcgccatcagactgcagatcagcgtggagatcaagggcgaggagaaggtggccccctaccacgtgcagtacacctgcctgcacgagaacctgttccactacctgaccgacatccagggcagcggcggcgtgagaatccccgaggccagaggcgacgacgcctggaaggtgtacttcgacgagaccgcccaggagatcgtggacgagttcgccatgagatacggcatcgagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcacctacagaaacaacttccccgccggcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgacctgtacagcagacagtaccagctgaagcaggagctgccccccgaggagcagggccccagcatcagaaacctggacttctggcccaagctgatcaccctgatcgtgagcatcatcgaggaggacaagaacagctacacccccgtgctgaaccagttcccccaggagctgaacgtgggcaaggtgagcgccgaggtgatgtggcacctgttcgcccaggacatgaagtacgccctggaggagcacgagaaggaccacctgtgcaagagcgccgactacatgaacctgcacttcaaggtgaagtggctgcacaacgagtacgtgagagacctgcccgtgctgcagggccaggtgcccgagtaccccgcctggttcgagcagttcgtgctgcagtggctggacgagaacgaggacgtgagcctggagttcctgagaggcgccctggagagagacaagaaggacggcttccagcagaccagcgagcacgccctgttcagctgcagcgtggtggacgtgttcacccagctgaaccagagcttcgagatcatcagaaagctggagtgccccgaccccagcatcctggcccactacatgagaagattcgccaagaccatcggcaaggtgctgatgcagtacgccgacatcctgagcaaggacttccccgcctactgcaccaaggagaagctgccctgcatcctgatgaacaacgtgcagcagctgagagtgcagctggagaagatgttcgaggccatgggcggcaaggagctggacctggaggccgccgacagcctgaaggagctgcaggtgaagctgaacaccgtgctggacgagctgagcatggtgttcggcaacagcttccaggtgagaatcgacgagtgcgtgagacagatggccgacatcctgggccaggtgagaggcaccggcaacgccagccccgacgccagagccagcgccgcccaggacgccgacagcgtgctgagacccctgatggacttcctggacggcaacctgaccctgttcgccaccgtgtgcgagaagaccgtgctgaagagagtgctgaaggagctgtggagagtggtgatgaacaccatggagagaatgatcgtgctgccccccctgaccgaccagaccggcacccagctgatcttcaccgccgccaaggagctgagccacctgagcaagctgaaggaccacatggtgagagaggagaccagaaacctgacccccaagcagtgcgccgtgctggacctggccctggacaccatcaagcagtacttccacgccggcggcaacggcctgaagaagaccttcctggagaagagccccgacctgcagagcctgagatacgccctgagcctgtacacccagaccaccgacaccctgatcaagaccttcgtgagaagccagaccacccagggcagcggcgtggacgaccccgtgggcgaggtgagcatccaggtggacctgttcacccaccccggcaccggcgagcacaaggtgaccgtgaaggtggtggccgccaacgacctgaagtggcagaccgccggcatgttcagacccttcgtggaggtgaccatggtgggcccccaccagagcgacaagaagagaaagttcaccaccaagagcaagagcaacaactgggcccccaagtacaacgagaccttccacttcctgctgggcaacgaggagggccccgagagctacgagctgcagatctgcgtgaaggactactgcttcgccagagaggacagagtgctgggcctggccgtgatgcccctgagagacgtgaccgccaagggcagctgcgcctgctggtgccccctgggcagaaagatccacatggacgagaccggcctgaccatcctgagaatcctgagccagagaagcaacgacgaggtggccagagagttcgtgaagctgaagagcgagagcagaagcaccgaggagggcagctag

SEQ ID NO: 23848 - DNA, 4833 bp, Artificial Sequence
  Description of Artificial Sequence: Synthetic coding sequence
atgagcctgctgtgcgtgagagtgaagagagccaagttccagggcagccccgacaagttcaacacctacgtgaccctgaaggtgcagaacgtgaagagcaccaccgtggccgtgagaggcgaccagcccagctgggagcaggacttcatgttcgagatcagcagactggacctgggcctgagcgtggaggtgtggaacaagggcctgatctgggacaccatggtgggcaccgtgtggatcgccctgaagaccatcagacagagcgacgaggagggccccggcgagtggagcaccctggaggccgagaccctgatgaaggacgacgagatctgcggcaccagaaaccccaccccccacaagatcctgctggacaccagattcgagctgcccttcgacatccccgaggaggaggccagatactggacctacaagtgggagcagatcaacgccctgggcgccgacaacgagtacagcagccaggaggagagccagagaaagcccctgcccaccgccgccgcccagtgcagcttcgaggaccccgacagcgccgtggacgacagagacagcgactacagaagcgagaccagcaacagcttcccccccccctaccacaccgccagccagcccaacgccagcgtgcaccagttccccgtgcccgtgagaagcccccagcagctgctgctgcagggcagcagcagagacagctgcaacgacagcatgcagagctacgacctggactaccccgagagaagagccatcagccccaccagcagcagcagatacggcagcagctgcaacgtgagccagggcagcagccagctgagcgagctggaccagtaccacgagcaggacgacgaccacagagagaccgacagcatccacagctgccacagcagccacagcctgagcagagacggccaggccggcttcggcgagcaggagaagcccctggaggtgaccggccaggccgagaaggaggccgcctgcgagcccaaggagatgaaggaggacgccaccacccaccccccccccgacctggtgctgcagaaggaccacttcctgggcccccaggagagcttccccgaggagaacgccagcagccccttcacccaggccagagcccactggatcagagccgtgaccaaggtgagactgcagctgcaggagatccccgacgacggcgaccccagcctgccccagtggctgcccgagggccccgccggcggcctgtacggcatcgacagcatgcccgacctgagaagaaagaagcccctgcccctggtgagcgacctgagcctggtgcagagcagaaaggccggcatcaccagcgccatggccaccagaaccagcctgaaggacgaggagctgaagagccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcagcgagtgcggcgtgaagtgccacgagaagtgccaggacctgctgaacgccgactgcctgcagagagccgccgagaagagctgcaagcacggcgccgaggacagaacccagaacatcatcatggccatgaaggacagaatgaagatcagagagagaaacaagcccgagatcttcgaggtgatcagagacgtgttcaccgtgaacaaggccgcccacgtgcagcagatgaagaccgtgaagcagagcgtgctggacggcaccagcaagtggagcgccaagatcaccatcaccgtggtgtgcgcccagggcctgcaggccaaggacaagaccggcagcagcgacccctacgtgaccgtgcaggtgagcaagaccaagaagagaaccaagaccatcttcggcaacctgaaccccgtgtgggaggagaagttccacttcgagtgccacaacagcagcgacagaatcaaggtgagagtgtgggacgaggacgacgacatcaagagcagagtgaagcagagactgaagagagagagcgacgacttcctgggccagaccatcatcgaggtgagaaccctgagcggcgagatggacgtgtggtacaacctggagaagagaaccgacaagagcgccgtgagcggcgccatcagactgcagatcagcgtggagatcaagggcgaggagaaggtggccccctaccacgtgcagtacacctgcctgcacgagaacctgttccactacctgaccgacatccagggcagcggcggcgtgagaatccccgaggccagaggcgacgacgcctggaaggtgtacttcgacgagaccgcccaggagatcgtggacgagttcgccatgagatacggcatcgagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcacctacagaaacaacttccccgccggcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgacctgtacagcagacagtaccagctgaagcaggagctgccccccgaggagcagggccccagcatcagaaacctggacttctggcccaagctgatcaccctgatcgtgagcatcatcgaggaggacaagaacagctacacccccgtgctgaaccagttcccccaggagctgaacgtgggcaaggtgagcgccgaggtgatgtggcacctgttcgcccaggacatgaagtacgccctggaggagcacgagaaggaccacctgtgcaagagcgccgactacatgaacctgcacttcaaggtgaagtggctgcacaacgagtacgtgagagacctgcccgtgctgcagggccaggtgcccgagtaccccgcctggttcgagcagttcgtgctgcagtggctggacgagaacgaggacgtgagcctggagttcctgagaggcgccctggagagagacaagaaggacggcttccagcagaccagcgagcacgccctgttcagctgcagcgtggtggacgtgttcacccagctgaaccagagcttcgagatcatcagaaagctggagtgccccgaccccagcatcctggcccactacatgagaagattcgccaagaccatcggcaaggtgctgatgcagtacgccgacatcctgagcaaggacttccccgcctactgcaccaaggagaagctgccctgcatcctgatgaacaacgtgcagcagctgagagtgcagctggagaagatgttcgaggccatgggcggcaaggagctggacctggaggccgccgacagcctgaaggagctgcaggtgaagctgaacaccgtgctggacgagctgagcatggtgttcggcaacagcttccaggtgagaatcgacgagtgcgtgagacagatggccgacatcctgggccaggtgagaggcaccggcaacgccagccccgacgccagagccagcgccgcccaggacgccgacagcgtgctgagacccctgatggacttcctggacggcaacctgaccctgttcgccaccgtgtgcgagaagaccgtgctgaagagagtgctgaaggagctgtggagagtggtgatgaacaccatggagagaatgatcgtgctgccccccctgaccgaccagaccggcacccagctgatcttcaccgccgccaaggagctgagccacctgagcaagctgaaggaccacatggtgagagaggagaccagaaacctgacccccaagcagtgcgccgtgctggacctggccctggacaccatcaagcagtacttccacgccggcggcaacggcctgaagaagaccttcctggagaagagccccgacctgcagagcctgagatacgccctgagcctgtacacccagaccaccgacaccctgatcaagaccttcgtgagaagccagaccacccaggtgcacgacggcaagggcatcagattcaccgccaacgaggacatcagacccgagaagggcagcggcgtggacgaccccgtgggcgaggtgagcatccaggtggacctgttcacccaccccggcaccggcgagcacaaggtgaccgtgaaggtggtggccgccaacgacctgaagtggcagaccgccggcatgttcagacccttcgtggaggtgaccatggtgggcccccaccagagcgacaagaagagaaagttcaccaccaagagcaagagcaacaactgggcccccaagtacaacgagaccttccacttcctgctgggcaacgaggagggccccgagagctacgagctgcagatctgcgtgaaggactactgcttcgccagagaggacagagtgctgggcctggccgtgatgcccctgagagacgtgaccgccaagggcagctgcgcctgctggtgccccctgggcagaaagatccacatggacgagaccggcctgaccatcctgagaatcctgagccagagaagcaacgacgaggtggccagagagttcgtgaagctgaagagcgagagcagaagcaccgaggagggcagctag

SEQ ID NO: 23849 - DNA, 4869 bp, Artificial Sequence
  Description of Artificial Sequence: Synthetic coding sequence
atgagcctgctgtgcgtgagagtgaagagagccaagttccagggcagccccgacaagttcaacacctacgtgaccctgaaggtgcagaacgtgaagagcaccaccgtggccgtgagaggcgaccagcccagctgggagcaggacttcatgttcgagatcagcagactggacctgggcctgagcgtggaggtgtggaacaagggcctgatctgggacaccatggtgggcaccgtgtggatcgccctgaagaccatcagacagagcgacgaggagggccccggcgagtggagcaccctggaggccgagaccctgatgaaggacgacgagatctgcggcaccagaaaccccaccccccacaagatcctgctggacaccagattcgagctgcccttcgacatccccgaggaggaggccagatactggacctacaagtgggagcagatcaacgccctgggcgccgacaacgagtacagcagccaggaggagagccagagaaagcccctgcccaccgccgccgcccagtgctgccactggacctacctgggctggggcgagcagcagaccttcgaggaccccgacagcgccgtggacgacagagacagcgactacagaagcgagaccagcaacagcttcccccccccctaccacaccgccagccagcccaacgccagcgtgcaccagttccccgtgcccgtgagaagcccccagcagctgctgctgcagggcagcagcagagacagctgcaacgacagcatgcagagctacgacctggactaccccgagagaagagccatcagccccaccagcagcagcagatacggcagcagctgcaacgtgagccagggcagcagccagctgagcgagctggaccagtaccacgagcaggacgacgaccacagagagaccgacagcatccacagctgccacagcagccacagcctgagcagagacggccaggccggcttcggcgagcaggagaagcccctggaggtgaccggccaggccgagaaggaggccgcctgcgagcccaaggagatgaaggaggacgccaccacccaccccccccccgacctggtgctgcagaaggaccacttcctgggcccccaggagagcttccccgaggagaacgccagcagccccttcacccaggccagagcccactggatcagagccgtgaccaaggtgagactgcagctgcaggagatccccgacgacggcgaccccagcctgccccagtggctgcccgagggccccgccggcggcctgtacggcatcgacagcatgcccgacctgagaagaaagaagcccctgcccctggtgagcgacctgagcctggtgcagagcagaaaggccggcatcaccagcgccatggccaccagaaccagcctgaaggacgaggagctgaagagccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcagcgagtgcggcgtgaagtgccacgagaagtgccaggacctgctgaacgccgactgcctgcagagagccgccgagaagagctgcaagcacggcgccgaggacagaacccagaacatcatcatggccatgaaggacagaatgaagatcagagagagaaacaagcccgagatcttcgaggtgatcagagacgtgttcaccgtgaacaaggccgcccacgtgcagcagatgaagaccgtgaagcagagcgtgctggacggcaccagcaagtggagcgccaagatcaccatcaccgtggtgtgcgcccagggcctgcaggccaaggacaagaccggcagcagcgacccctacgtgaccgtgcaggtgagcaagaccaagaagagaaccaagaccatcttcggcaacctgaaccccgtgtgggaggagaagttccacttcgagtgccacaacagcagcgacagaatcaaggtgagagtgtgggacgaggacgacgacatcaagagcagagtgaagcagagactgaagagagagagcgacgacttcctgggccagaccatcatcgaggtgagaaccctgagcggcgagatggacgtgtggtacaacctggagaagagaaccgacaagagcgccgtgagcggcgccatcagactgcagatcagcgtggagatcaagggcgaggagaaggtggccccctaccacgtgcagtacacctgcctgcacgagaacctgttccactacctgaccgacatccagggcagcggcggcgtgagaatccccgaggccagaggcgacgacgcctggaaggtgtacttcgacgagaccgcccaggagatcgtggacgagttcgccatgagatacggcatcgagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcacctacagaaacaacttccccgccggcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgacctgtacagcagacagtaccagctgaagcaggagctgccccccgaggagcagggccccagcatcagaaacctggacttctggcccaagctgatcaccctgatcgtgagcatcatcgaggaggacaagaacagctacacccccgtgctgaaccagttcccccaggagctgaacgtgggcaaggtgagcgccgaggtgatgtggcacctgttcgcccaggacatgaagtacgccctggaggagcacgagaaggaccacctgtgcaagagcgccgactacatgaacctgcacttcaaggtgaagtggctgcacaacgagtacgtgagagacctgcccgtgctgcagggccaggtgcccgagtaccccgcctggttcgagcagttcgtgctgcagtggctggacgagaacgaggacgtgagcctggagttcctgagaggcgccctggagagagacaagaaggacggcttccagcagaccagcgagcacgccctgttcagctgcagcgtggtggacgtgttcacccagctgaaccagagcttcgagatcatcagaaagctggagtgccccgaccccagcatcctggcccactacatgagaagattcgccaagaccatcggcaaggtgctgatgcagtacgccgacatcctgagcaaggacttccccgcctactgcaccaaggagaagctgccctgcatcctgatgaacaacgtgcagcagctgagagtgcagctggagaagatgttcgaggccatgggcggcaaggagctggacctggaggccgccgacagcctgaaggagctgcaggtgaagctgaacaccgtgctggacgagctgagcatggtgttcggcaacagcttccaggtgagaatcgacgagtgcgtgagacagatggccgacatcctgggccaggtgagaggcaccggcaacgccagccccgacgccagagccagcgccgcccaggacgccgacagcgtgctgagacccctgatggacttcctggacggcaacctgaccctgttcgccaccgtgtgcgagaagaccgtgctgaagagagtgctgaaggagctgtggagagtggtgatgaacaccatggagagaatgatcgtgctgccccccctgaccgaccagaccggcacccagctgatcttcaccgccgccaaggagctgagccacctgagcaagctgaaggaccacatggtgagagaggagaccagaaacctgacccccaagcagtgcgccgtgctggacctggccctggacaccatcaagcagtacttccacgccggcggcaacggcctgaagaagaccttcctggagaagagccccgacctgcagagcctgagatacgccctgagcctgtacacccagaccaccgacaccctgatcaagaccttcgtgagaagccagaccacccaggtgcacgacggcaagggcatcagattcaccgccaacgaggacatcagacccgagaagggcagcggcgtggacgaccccgtgggcgaggtgagcatccaggtggacctgttcacccaccccggcaccggcgagcacaaggtgaccgtgaaggtggtggccgccaacgacctgaagtggcagaccgccggcatgttcagacccttcgtggaggtgaccatggtgggcccccaccagagcgacaagaagagaaagttcaccaccaagagcaagagcaacaactgggcccccaagtacaacgagaccttccacttcctgctgggcaacgaggagggccccgagagctacgagctgcagatctgcgtgaaggactactgcttcgccagagaggacagagtgctgggcctggccgtgatgcccctgagagacgtgaccgccaagggcagctgcgcctgctggtgccccctgggcagaaagatccacatggacgagaccggcctgaccatcctgagaatcctgagccagagaagcaacgacgaggtggccagagagttcgtgaagctgaagagcgagagcagaagcaccgaggagggcagctag

SEQ ID NO: 23850 - DNA, 3594 bp, Artificial Sequence
  Description of Artificial Sequence: Synthetic coding sequence
atgcccgacctgagaagaaagaagcccctgcccctggtgagcgacctggtgaagagcctggtgcagagcagaaaggccggcatcaccagcgccatggccaccagaaccagcctgaaggacgaggagctgaagagccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcagcgagtgcggcgtgaagtgccacgagaagtgccaggacctgctgaacgccgactgcctgcagagagccgccgagaagagctgcaagcacggcgccgaggacagaacccagaacatcatcatggccatgaaggacagaatgaagatcagagagagaaacaagcccgagatcttcgaggtgatcagagacgtgttcaccgtgaacaaggccgcccacgtgcagcagatgaagaccgtgaagcagagcgtgctggacggcaccagcaagtggagcgccaagatcaccatcaccgtggtgtgcgcccagggcctgcaggccaaggacaagaccggcagcagcgacccctacgtgaccgtgcaggtgagcaagaccaagaagagaaccaagaccatcttcggcaacctgaaccccgtgtgggaggagaagttccacttcgagtgccacaacagcagcgacagaatcaaggtgagagtgtgggacgaggacgacgacatcaagagcagagtgaagcagagactgaagagagagagcgacgacttcctgggccagaccatcatcgaggtgagaaccctgagcggcgagatggacgtgtggtacaacctggagaagagaaccgacaagagcgccgtgagcggcgccatcagactgcagatcagcgtggagatcaagggcgaggagaaggtggccccctaccacgtgcagtacacctgcctgcacgagaacctgttccactacctgaccgacatccagggcagcggcggcgtgagaatccccgaggccagaggcgacgacgcctggaaggtgtacttcgacgagaccgcccaggagatcgtggacgagttcgccatgagatacggcatcgagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcacctacagaaacaacttccccgccggcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgacctgtacagcagacagtaccagctgaagcaggagctgccccccgaggagcagggccccagcatcagaaacctggacttctggcccaagctgatcaccctgatcgtgagcatcatcgaggaggacaagaacagctacacccccgtgctgaaccagttcccccaggagctgaacgtgggcaaggtgagcgccgaggtgatgtggcacctgttcgcccaggacatgaagtacgccctggaggagcacgagaaggaccacctgtgcaagagcgccgactacatgaacctgcacttcaaggtgaagtggctgcacaacgagtacgtgagagacctgcccgtgctgcagggccaggtgcccgagtaccccgcctggttcgagcagttcgtgctgcagtggctggacgagaacgaggacgtgagcctggagttcctgagaggcgccctggagagagacaagaaggacggcttccagcagaccagcgagcacgccctgttcagctgcagcgtggtggacgtgttcacccagctgaaccagagcttcgagatcatcagaaagctggagtgccccgaccccagcatcctggcccactacatgagaagattcgccaagaccatcggcaaggtgctgatgcagtacgccgacatcctgagcaaggacttccccgcctactgcaccaaggagaagctgccctgcatcctgatgaacaacgtgcagcagctgagagtgcagctggagaagatgttcgaggccatgggcggcaaggagctggacctggaggccgccgacagcctgaaggagctgcaggtgaagctgaacaccgtgctggacgagctgagcatggtgttcggcaacagcttccaggtgagaatcgacgagtgcgtgagacagatggccgacatcctgggccaggtgagaggcaccggcaacgccagccccgacgccagagccagcgccgcccaggacgccgacagcgtgctgagacccctgatggacttcctggacggcaacctgaccctgttcgccaccgtgtgcgagaagaccgtgctgaagagagtgctgaaggagctgtggagagtggtgatgaacaccatggagagaatgatcgtgctgccccccctgaccgaccagaccggcacccagctgatcttcaccgccgccaaggagctgagccacctgagcaagctgaaggaccacatggtgagagaggagaccagaaacctgacccccaagcagtgcgccgtgctggacctggccctggacaccatcaagcagtacttccacgccggcggcaacggcctgaagaagaccttcctggagaagagccccgacctgcagagcctgagatacgccctgagcctgtacacccagaccaccgacaccctgatcaagaccttcgtgagaagccagaccacccaggtgcacgacggcaagggcatcagattcaccgccaacgaggacatcagacccgagaagggcagcggcgtggacgaccccgtgggcgaggtgagcatccaggtggacctgttcacccaccccggcaccggcgagcacaaggtgaccgtgaaggtggtggccgccaacgacctgaagtggcagaccgccggcatgttcagacccttcgtggaggtgaccatggtgggcccccaccagagcgacaagaagagaaagttcaccaccaagagcaagagcaacaactgggcccccaagtacaacgagaccttccacttcctgctgggcaacgaggagggccccgagagctacgagctgcagatctgcgtgaaggactactgcttcgccagagaggacagagtgctgggcctggccgtgatgcccctgagagacgtgaccgccaagggcagctgcgcctgctggtgccccctgggcagaaagatccacatggacgagaccggcctgaccatcctgagaatcctgagccagagaagcaacgacgaggtggccagagagttcgtgaagctgaagagcgagagcagaagcaccgaggagggcagctag

SEQ ID NO: 23851 - DNA, 6645 bp, Artificial Sequence
  Description of Artificial Sequence: Synthetic coding sequence
atggtggccaacttcttcaagagcctgatcctgccctacatccacaagctgtgcaagggcatgttcaccaagaagctgggcaacaccaacaagaacaaggagtacagacagcagaagaaggaccaggacttccccaccgccggccagaccaagagccccaagttcagctacaccttcaagagcaccgtgaagaagatcgccaagtgcagcagcacccacaacctgagcaccgaggaggacgaggccagcaaggagttcagcctgagccccaccttcagctacagagtggccatcgccaacggcctgcagaagaacgccaaggtgaccaacagcgacaacgaggacctgctgcaggagctgagcagcatcgagagcagctacagcgagagcctgaacgagctgagaagcagcaccgagaaccaggcccagagcacccacaccatgcccgtgagaagaaacagaaagagcagcagcagcctggcccccagcgagggcagcagcgacggcgagagaaccctgcacggcctgaagctgggcgccctgagaaagctgagaaagtggaagaagagccaggagtgcgtgagcagcgacagcgagctgagcaccatgaagaagagctggggcatcagaagcaagagcctggacagaaccgtgagaaaccccaagaccaacgccctggagcccggcttcagcagcagcggctgcatcagccagacccacgacgtgatggagatgatcttcaaggagctgcagggcatcagccagatcgagaccgagctgagcgagctgagaggccacgtgaacgccctgaagcacagcatcgacgagatcagcagcagcgtggaggtggtgcagagcgagatcgagcagctgagaaccggcttcgtgcagagcagaagagagaccagagacatccacgactacatcaagcacctgggccacatgggcagcaaggccagcctgagattcctgaacgtgaccgaggagagattcgagtacgtggagagcgtggtgtaccagatcctgatcgacaagatgggcttcagcgacgcccccaacgccatcaagatcgagttcgcccagagaatcggccaccagagagactgccccaacgccaagcccagacccatcctggtgtacttcgagaccccccagcagagagacagcgtgctgaagaagagctacaagctgaagggcaccggcatcggcatcagcaccgacatcctgacccacgacatcagagagagaaaggagaagggcatccccagcagccagacctacgagagcatggccatcaagctgagcacccccgagcccaagatcaagaagaacaactggcagagccccgacgacagcgacgaggacctggagagcgacctgaacagaaacagctacgccgtgctgagcaagagcgagctgctgaccaagggcagcaccagcaagcccagcagcaagagccacagcgccagaagcaagaacaagaccgccaacagcagcagaatcagcaacaagagcgactacgacaagatcagcagccagctgcccgagagcgacatcctggagaagcagaccaccacccactacgccgacgccacccccctgtggcacagccagagcgacttcttcaccgccaagctgagcagaagcgagagcgacttcagcaagctgtgccagagctacagcgaggacttcagcgagaaccagttcttcaccagaaccaacggcagcagcctgctgagcagcagcgacagagagctgtggcagagaaagcaggagggcaccgccaccctgtacgacagccccaaggaccagcacctgaacggcggcgtgcagggcatccagggccagaccgagaccgagaacaccgagaccgtggacagcggcatgagcaacggcatggtgtgcgccagcggcgacagaagccactacagcgacagccagctgagcctgcacgaggacctgagcccctggaaggagtggaaccagggcgccgacctgggcctggacagcagcacccaggagggcttcgactacgagaccaacagcctgttcgaccagcagctggacgtgtacaacaaggacctggagtacctgggcaagtgccacagcgacctgcaggacgacagcgagagctacgacctgacccaggacgacaacagcagcccctgccccggcctggacaacgagccccagggccagtgggtgggccagtacgacagctaccagggcgccaacagcaacgagctgtaccagaaccagaaccagctgagcatgatgtacagaagccagagcgagctgcagagcgacgacagcgaggacgccccccccaagagctggcacagcagactgagcatcgacctgagcgacaagaccttcagcttccccaagttcggcagcaccctgcagagagccaagagcgccctggaggtggtgtggaacaagagcacccagagcctgagcggctacgaggacagcggcagcagcctgatgggcagattcagaaccctgagccagagcaccgccaacgagagcagcaccaccctggacagcgacgtgtacaccgagccctactactacaaggccgaggacgaggaggactacaccgagcccgtggccgacaacgagaccgactacgtggaggtgatggagcaggtgctggccaagctggagaacagaaccagcatcaccgagaccgacgagcagatgcaggcctacgaccacctgagctacgagaccccctacgagaccccccaggacgagggctacgacggccccgccgacgacatggtgagcgaggagggcctggagcccctgaacgagaccagcgccgagatggagatcagagaggacgagaaccagaacatccccgagcagcccgtggagatcaccaagcccaagagaatcagacccagcttcaaggaggccgccctgagagcctacaagaagcagatggccgagctggaggagaagatcctggccggcgacagcagcagcgtggacgagaaggccagaatcgtgagcggcaacgacctggacgccagcaagttcagcgccctgcaggtgtgcggcggcgccggcggcggcctgtacggcatcgacagcatgcccgacctgagaagaaagaagaccctgcccatcgtgagagacgtggccatgaccctggccgccagaaagagcggcctgagcctggccatggtgatcagaaccagcctgaacaacgaggagctgaagatgcacgtgttcaagaagaccctgcaggccctgatctaccccatgagcagcaccatcccccacaacttcgaggtgtggaccgccaccacccccacctactgctacgagtgcgagggcctgctgtggggcatcgccagacagggcatgaagtgcctggagtgcggcgtgaagtgccacgagaagtgccaggacctgctgaacgccgactgcctgcagagagccgccgagaagagcagcaagcacggcgccgaggacaagacccagaccatcatcaccgccatgaaggagagaatgaagatcagagagaagaacagacccgaggtgttcgaggtgatccaggagatgttccagatcagcaaggaggacttcgtgcagttcaccaaggccgccaagcagagcgtgctggacggcaccagcaagtggagcgccaagatcaccatcaccgtggtgagcgcccagggcctgcaggccaaggacaagaccggcagcagcgacccctacgtgaccgtgcaggtgggcaagaacaagagaagaaccaagaccatcttcggcaacctgaaccccgtgtgggacgagaagttctacttcgagtgccacaacagcaccgacagaatcaaggtgagagtgtgggacgaggacgacgacatcaagagcagagtgaagcagcacttcaagaaggagagcgacgacttcctgggccagaccatcgtggaggtgagaaccctgagcggcgagatggacgtgtggtacaacctggagaagagaaccgacaagagcgccgtgagcggcgccatcagactgaagatcaacgtggagatcaagggcgaggagaaggtggccccctaccacatccagtacacctgcctgcacgagaacctgttccactacctgaccgaggtgaagagcaacggcggcgtgaagatccccgaggtgaagggcgacgaggcctggaaggtgttcttcgacgacgccagccaggagatcgtggacgagttcgccatgagatacggcatcgagagcatctaccaggccatgacccacttcagctgcctgagcagcaagtacatgtgccccggcgtgcccgccgtgatgagcaccctgctggccaacatcaacgccttctacgcccacaccaccgtgagcaccaacatccaggtgagcgccagcgacagattcgccgccaccaacttcggcagagagaagttcatcaagctgctggaccagctgcacaacagcctgagaatcgacctgagcaagtacagagagaacttccccgccagcaacaccgagagactgcaggacctgaagagcaccgtggacctgctgaccagcatcaccttcttcagaatgaaggtgctggagctgcagagcccccccaaggccagcatggtggtgaaggactgcgtgagagcctgcctggacagcacctacaagtacatcttcgacaactgccacgagctgtacagccagctgaccgaccccagcaagaagcaggacatccccagagaggaccagggccccaccaccaagaacctggacttctggccccagctgatcaccctgatggtgaccatcatcgacgaggacaagaccgcctacacccccgtgctgaaccagttcccccaggagctgaacatgggcaagatcagcgccgagatcatgtggaccctgttcgccctggacatgaagtacgccctggaggagcacgagaaccagagactgtgcaagagcaccgactacatgaacctgcacttcaaggtgaagtggttctacaacgagtacgtgagagagctgcccgccttcaaggacgccgtgcccgagtacagcctgtggttcgagcccttcgtgatgcagtggctggacgagaacgaggacgtgagcatggagttcctgcacggcgccctgggcagagacaagaaggacggcttccagcagaccagcgagcacgccctgttcagctgcagcgtggtggacgtgttcgcccagctgaaccagagcttcgagatcatcaagaagctggagtgccccaaccccgaggccctgagccacctgatgagaagattcgccaagaccatcaacaaggtgctgctgcagtacgccgccatcgtgagcagcgacttcagcagccactgcgacaaggagaacgtgccctgcatcctgatgaacaacatccagcagctgagagtgcagctggagaagatgttcgagagcatgggcggcaaggagctggacagcgaggccagcaccatcctgaaggagctgcaggtgaagctgagcggcgtgctggacgagctgagcgtgacctacggcgagagcttccaggtgatcatcgaggagtgcatcaagcagatgagcttcgagctgaaccagatgagagccaacggcaacaccaccagcaacaagaacagcgccgccatggacgccgagatcgtgctgagaagcctgatggacttcctggacaagaccctgagcctgagcgccaagatctgcgagaagaccgtgctgaagagagtgctgaaggagctgtggaagctggtgctgaacaagatcgagaagcagatcgtgctgccccccctgaccgaccagaccggcccccagatgatcttcatcgccgccaaggacctgggccagctgagcaagctgaaggagcacatgatcagagaggacgccagaggcctgacccccagacagtgcgccatcatggaggtggtgctggccaccatcaagcagtacttccacgccggcggcaacggcctgaagaagaacttcctggagaagagccccgacctgcagagcctgagatacgccctgagcctgtacacccagaccaccgacgccctgatcaagaagttcatcgacacccagaccagccagagcagaagcagcaaggacgccgtgggccagatcagcgtgcacgtggacatcaccgccacccccggcaccggcgaccacaaggtgaccgtgaaggtgatcgccatcaacgacctgaactggcagaccaccgccatgttcagacccttcgtggaggtgtgcatcctgggccccaacctgggcgacaagaagagaaagcagggcaccaagaccaagagcaacacctggagccccaagtacaacgagaccttccagttcatcctgggcaaggagaacagacccggcgcctacgagctgcacctgagcgtgaaggactactgcttcgccagagaggacagaatcatcggcatgaccgtgatccagctgcagaacatcgccgagaagggcagctacggcgcctggtaccccctgctgaagaacatcagcatggacgagaccggcctgaccatcctgagaatcctgagccagagaaccagcgacgacgtggccaaggagttcgtgagactgaagagcgagaccagaagcaccgaggagagcgcctag

SEQ ID NO: 23852 - DNA, 6639 bp, Artificial Sequence
  Description of Artificial Sequence: Synthetic coding sequence
atggtggccaacttcttcaagagcctgatcctgccctacatccacaagctgtgcaagggcatgttcaccaagaagctgggcaacaccaacaagaacaaggagtacagacagcagaagaaggaccaggacttccccaccgccggccagaccaagagccccaagttcagctacaccttcaagagcaccgtgaagaagatcgccaagtgcagcagcacccacaacctgagcaccgaggaggacgaggccagcaaggagttcagcctgagccccaccttcagctacagagtggccatcgccaacggcctgcagaagaacgccaaggtgaccaacagcgacaacgaggacctgctgcaggagctgagcagcatcgagagcagctacagcgagagcctgaacgagctgagaagcagcaccgagaaccaggcccagagcacccacaccatgcccgtgagaagaaacagaaagagcagcagcagcctggcccccagcgagggcagcagcgacggcgagagaaccctgcacggcctgaagctgggcgccctgagaaagctgagaaagtggaagaagagccaggagtgcgtgagcagcgacagcgagctgagcaccatgaagaagagctggggcatcagaagcaagagcctggacagaaccgtgagaaaccccaagaccaacgccctggagcccggcttcagcagcagcggctgcatcagccagacccacgacgtgatggagatgatcttcaaggagctgcagggcatcagccagatcgagaccgagctgagcgagctgagaggccacgtgaacgccctgaagcacagcatcgacgagatcagcagcagcgtggaggtggtgcagagcgagatcgagcagctgagaaccggcttcgtgcagagcagaagagagaccagagacatccacgactacatcaagcacctgggccacatgggcagcaaggccagcctgagattcctgaacgtgaccgaggagagattcgagtacgtggagagcgtggtgtaccagatcctgatcgacaagatgggcttcagcgacgcccccaacgccatcaagatcgagttcgcccagagaatcggccaccagagagactgccccaacgccaagcccagacccatcctggtgtacttcgagaccccccagcagagagacagcgtgctgaagaagagctacaagctgaagggcaccggcatcggcatcagcaccgacatcctgacccacgacatcagagagagaaaggagaagggcatccccagcagccagacctacgagagcatggccatcaagctgagcacccccgagcccaagatcaagaagaacaactggcagagccccgacgacagcgacgaggacctggagagcgacctgaacagaaacagctacgccgtgctgagcaagagcgagctgctgaccaagggcagcaccagcaagcccagcagcaagagccacagcgccagaagcaagaacaagaccgccaacagcagcagaatcagcaacaagagcgactacgacaagatcagcagccagctgcccgagagcgacatcctggagaagcagaccaccacccactacgccgacgccacccccctgtggcacagccagagcgacttcttcaccgccaagctgagcagaagcgagagcgacttcagcaagctgtgccagagctacagcgaggacttcagcgagaaccagttcttcaccagaaccaacggcagcagcctgctgagcagcagcgacagagagctgtggcagagaaagcaggagggcaccgccaccctgtacgacagccccaaggaccagcacctgaacggcggcgtgcagggcatccagggccagaccgagaccgagaacaccgagaccgtggacagcggcatgagcaacggcatggtgtgcgccagcggcgacagaagccactacagcgacagccagctgagcctgcacgaggacctgagcccctggaaggagtggaaccagggcgccgacctgggcctggacagcagcacccaggagggcttcgactacgagaccaacagcctgttcgaccagcagctggacgtgtacaacaaggacctggagtacctgggcaagtgccacagcgacctgcaggacgacagcgagagctacgacctgacccaggacgacaacagcagcccctgccccggcctggacaacgagccccagggccagtgggtgggccagtacgacagctaccagggcgccaacagcaacgagctgtaccagaaccagaaccagctgagcatgatgtacagaagccagagcgagctgcagagcgacgacagcgaggacgccccccccaagagctggcacagcagactgagcatcgacctgagcgacaagaccttcagcttccccaagttcggcagcaccctgcagagagccaagagcgccctggaggtggtgtggaacaagagcacccagagcctgagcggctacgaggacagcggcagcagcctgatgggcagattcagaaccctgagccagagcaccgccaacgagagcagcaccaccctggacagcgacgtgtacaccgagccctactactacaaggccgaggacgaggaggactacaccgagcccgtggccgacaacgagaccgactacgtggaggtgatggagcaggtgctggccaagctggagaacagaaccagcatcaccgagaccgacgagcagatgcaggcctacgaccacctgagctacgagaccccctacgagaccccccaggacgagggctacgacggccccgccgacgacatggtgagcgaggagggcctggagcccctgaacgagaccagcgccgagatggagatcagagaggacgagaaccagaacatccccgagcagcccgtggagatcaccaagcccaagagaatcagacccagcttcaaggaggccgccctgagagcctacaagaagcagatggccgagctggaggagaagatcctggccggcgacagcagcagcgtggacgagaaggccagaatcgtgagcggcaacgacctggacgccagcaagttcagcgccctgcaggtgtgcggcggcgccggcggcggcctgtacggcatcgacagcatgcccgacctgagaagaaagaagaccctgcccatcgtgagagacgtgaccctggccgccagaaagagcggcctgagcctggccatggtgatcagaaccagcctgaacaacgaggagctgaagatgcacgtgttcaagaagaccctgcaggccctgatctaccccatgagcagcaccatcccccacaacttcgaggtgtggaccgccaccacccccacctactgctacgagtgcgagggcctgctgtggggcatcgccagacagggcatgaagtgcctggagtgcggcgtgaagtgccacgagaagtgccaggacctgctgaacgccgactgcctgcagagagccgccgagaagagcagcaagcacggcgccgaggacaagacccagaccatcatcaccgccatgaaggagagaatgaagatcagagagaagaacagacccgaggtgttcgaggtgatccaggagatgttccagatcagcaaggaggacttcgtgcagttcaccaaggccgccaagcagagcgtgctggacggcaccagcaagtggagcgccaagatcaccatcaccgtggtgagcgcccagggcctgcaggccaaggacaagaccggcagcagcgacccctacgtgaccgtgcaggtgggcaagaacaagagaagaaccaagaccatcttcggcaacctgaaccccgtgtgggacgagaagttctacttcgagtgccacaacagcaccgacagaatcaaggtgagagtgtgggacgaggacgacgacatcaagagcagagtgaagcagcacttcaagaaggagagcgacgacttcctgggccagaccatcgtggaggtgagaaccctgagcggcgagatggacgtgtggtacaacctggagaagagaaccgacaagagcgccgtgagcggcgccatcagactgaagatcaacgtggagatcaagggcgaggagaaggtggccccctaccacatccagtacacctgcctgcacgagaacctgttccactacctgaccgaggtgaagagcaacggcggcgtgaagatccccgaggtgaagggcgacgaggcctggaaggtgttcttcgacgacgccagccaggagatcgtggacgagttcgccatgagatacggcatcgagagcatctaccaggccatgacccacttcagctgcctgagcagcaagtacatgtgccccggcgtgcccgccgtgatgagcaccctgctggccaacatcaacgccttctacgcccacaccaccgtgagcaccaacatccaggtgagcgccagcgacagattcgccgccaccaacttcggcagagagaagttcatcaagctgctggaccagctgcacaacagcctgagaatcgacctgagcaagtacagagagaacttccccgccagcaacaccgagagactgcaggacctgaagagcaccgtggacctgctgaccagcatcaccttcttcagaatgaaggtgctggagctgcagagcccccccaaggccagcatggtggtgaaggactgcgtgagagcctgcctggacagcacctacaagtacatcttcgacaactgccacgagctgtacagccagctgaccgaccccagcaagaagcaggacatccccagagaggaccagggccccaccaccaagaacctggacttctggccccagctgatcaccctgatggtgaccatcatcgacgaggacaagaccgcctacacccccgtgctgaaccagttcccccaggagctgaacatgggcaagatcagcgccgagatcatgtggaccctgttcgccctggacatgaagtacgccctggaggagcacgagaaccagagactgtgcaagagcaccgactacatgaacctgcacttcaaggtgaagtggttctacaacgagtacgtgagagagctgcccgccttcaaggacgccgtgcccgagtacagcctgtggttcgagcccttcgtgatgcagtggctggacgagaacgaggacgtgagcatggagttcctgcacggcgccctgggcagagacaagaaggacggcttccagcagaccagcgagcacgccctgttcagctgcagcgtggtggacgtgttcgcccagctgaaccagagcttcgagatcatcaagaagctggagtgccccaaccccgaggccctgagccacctgatgagaagattcgccaagaccatcaacaaggtgctgctgcagtacgccgccatcgtgagcagcgacttcagcagccactgcgacaaggagaacgtgccctgcatcctgatgaacaacatccagcagctgagagtgcagctggagaagatgttcgagagcatgggcggcaaggagctggacagcgaggccagcaccatcctgaaggagctgcaggtgaagctgagcggcgtgctggacgagctgagcgtgacctacggcgagagcttccaggtgatcatcgaggagtgcatcaagcagatgagcttcgagctgaaccagatgagagccaacggcaacaccaccagcaacaagaacagcgccgccatggacgccgagatcgtgctgagaagcctgatggacttcctggacaagaccctgagcctgagcgccaagatctgcgagaagaccgtgctgaagagagtgctgaaggagctgtggaagctggtgctgaacaagatcgagaagcagatcgtgctgccccccctgaccgaccagaccggcccccagatgatcttcatcgccgccaaggacctgggccagctgagcaagctgaaggagcacatgatcagagaggacgccagaggcctgacccccagacagtgcgccatcatggaggtggtgctggccaccatcaagcagtacttccacgccggcggcaacggcctgaagaagaacttcctggagaagagccccgacctgcagagcctgagatacgccctgagcctgtacacccagaccaccgacgccctgatcaagaagttcatcgacacccagaccagccagagcagaagcagcaaggacgccgtgggccagatcagcgtgcacgtggacatcaccgccacccccggcaccggcgaccacaaggtgaccgtgaaggtgatcgccatcaacgacctgaactggcagaccaccgccatgttcagacccttcgtggaggtgtgcatcctgggccccaacctgggcgacaagaagagaaagcagggcaccaagaccaagagcaacacctggagccccaagtacaacgagaccttccagttcatcctgggcaaggagaacagacccggcgcctacgagctgcacctgagcgtgaaggactactgcttcgccagagaggacagaatcatcggcatgaccgtgatccagctgcagaacatcgccgagaagggcagctacggcgcctggtaccccctgctgaagaacatcagcatggacgagaccggcctgaccatcctgagaatcctgagccagagaaccagcgacgacgtggccaaggagttcgtgagactgaagagcgagaccagaagcaccgaggagagcgcctag

SEQ ID NO: 23853 - DNA, 6645 bp, Artificial Sequence
  Description of Artificial Sequence: Synthetic coding sequence
atggtggccaacttcttcaagagcctgatcctgccctacatccacaagctgtgcaagggcatgttcaccaagaagctgggcaacaccaacaagaacaaggagtacagacagcagaagaaggaccaggacttccccaccgccggccagaccaagagccccaagttcagctacaccttcaagagcaccgtgaagaagatcgccaagtgcagcagcacccacaacctgagcaccgaggaggacgaggccagcaaggagttcagcctgagccccaccttcagctacagagtggccatcgccaacggcctgcagaagaacgccaaggtgaccaacagcgacaacgaggacctgctgcaggagctgagcagcatcgagagcagctacagcgagagcctgaacgagctgagaagcagcaccgagaaccaggcccagagcacccacaccatgcccgtgagaagaaacagaaagagcagcagcagcctggcccccagcgagggcagcagcgacggcgagagaaccctgcacggcctgaagctgggcgccctgagaaagctgagaaagtggaagaagagccaggagtgcgtgagcagcgacagcgagctgagcaccatgaagaagagctggggcatcagaagcaagagcctggacagaaccgtgagaaaccccaagaccaacgccctggagcccggcttcagcagcagcggctgcatcagccagacccacgacgtgatggagatgatcttcaaggagctgcagggcatcagccagatcgagaccgagctgagcgagctgagaggccacgtgaacgccctgaagcacagcatcgacgagatcagcagcagcgtggaggtggtgcagagcgagatcgagcagctgagaaccggcttcgtgcagagcagaagagagaccagagacatccacgactacatcaagcacctgggccacatgggcagcaaggccagcctgagattcctgaacgtgaccgaggagagattcgagtacgtggagagcgtggtgtaccagatcctgatcgacaagatgggcttcagcgacgcccccaacgccatcaagatcgagttcgcccagagaatcggccaccagagagactgccccaacgccaagcccagacccatcctggtgtacttcgagaccccccagcagagagacagcgtgctgaagaagagctacaagctgaagggcaccggcatcggcatcagcaccgacatcctgacccacgacatcagagagagaaaggagaagggcatccccagcagccagacctacgagagcatggccatcaagctgagcacccccgagcccaagatcaagaagaacaactggcagagccccgacgacagcgacgaggacctggagagcgacctgaacagaaacagctacgccgtgctgagcaagagcgagctgctgaccaagggcagcaccagcaagcccagcagcaagagccacagcgccagaagcaagaacaagaccgccaacagcagcagaatcagcaacaagagcgactacgacaagatcagcagccagctgcccgagagcgacatcctggagaagcagaccaccacccactacgccgacgccacccccctgtggcacagccagagcgacttcttcaccgccaagctgagcagaagcgagagcgacttcagcaagctgtgccagagctacagcgaggacttcagcgagaaccagttcttcaccagaaccaacggcagcagcctgctgagcagcagcgacagagagctgtggcagagaaagcaggagggcaccgccaccctgtacgacagccccaaggaccagcacctgaacggcggcgtgcagggcatccagggccagaccgagaccgagaacaccgagaccgtggacagcggcatgagcaacggcatggtgtgcgccagcggcgacagaagccactacagcgacagccagctgagcctgcacgaggacctgagcccctggaaggagtggaaccagggcgccgacctgggcctggacagcagcacccaggagggcttcgactacgagaccaacagcctgttcgaccagcagctggacgtgtacaacaaggacctggagtacctgggcaagtgccacagcgacctgcaggacgacagcgagagctacgacctgacccaggacgacaacagcagcccctgccccggcctggacaacgagccccagggccagtgggtgggccagtacgacagctaccagggcgccaacagcaacgagctgtaccagaaccagaaccagctgagcatgatgtacagaagccagagcgagctgcagagcgacgacagcgaggacgccccccccaagagctggcacagcagactgagcatcgacctgagcgacaagaccttcagcttccccaagttcggcagcaccctgcagagagccaagagcgccctggaggtggtgtggaacaagagcacccagagcctgagcggctacgaggacagcggcagcagcctgatgggcagattcagaaccctgagccagagcaccgccaacgagagcagcaccaccctggacagcgacgtgtacaccgagccctactactacaaggccgaggacgaggaggactacaccgagcccgtggccgacaacgagaccgactacgtggaggtgatggagcaggtgctggccaagctggagaacagaaccagcatcaccgagaccgacgagcagatgcaggcctacgaccacctgagctacgagaccccctacgagaccccccaggacgagggctacgacggccccgccgacgacatggtgagcgaggagggcctggagcccctgaacgagaccagcgccgagatggagatcagagaggacgagaaccagaacatccccgagcagcccgtggagatcaccaagcccaagagaatcagacccagcttcaaggaggccgccctgagagcctacaagaagcagatggccgagctggaggagaagatcctggccggcgtgagcctggacgtggacctggaggccagaatcgtgagcggcaacgacctggacgccagcaagttcagcgccctgcaggtgtgcggcggcgccggcggcggcctgtacggcatcgacagcatgcccgacctgagaagaaagaagaccctgcccatcgtgagagacgtgctgctgaccctggccgccagaaagagcggcctgagcctggccatggtgatcagaaccagcctgaacaacgaggagctgaagatgcacgtgttcaagaagaccctgcaggccctgatctaccccatgagcagcaccatcccccacaacttcgaggtgtggaccgccaccacccccacctactgctacgagtgcgagggcctgctgtggggcatcgccagacagggcatgaagtgcctggagtgcggcgtgaagtgccacgagaagtgccaggacctgctgaacgccgactgcctgcagagagccgccgagaagagcagcaagcacggcgccgaggacaagacccagaccatcatcaccgccatgaaggagagaatgaagatcagagagaagaacagacccgaggtgttcgaggtgatccaggagatgttccagatcagcaaggaggacttcgtgcagttcaccaaggccgccaagcagagcgtgctggacggcaccagcaagtggagcgccaagatcaccatcaccgtggtgagcgcccagggcctgcaggccaaggacaagaccggcagcagcgacccctacgtgaccgtgcaggtgggcaagaacaagagaagaaccaagaccatcttcggcaacctgaaccccgtgtgggacgagaagttctacttcgagtgccacaacagcaccgacagaatcaaggtgagagtgtgggacgaggacgacgacatcaagagcagagtgaagcagcacttcaagaaggagagcgacgacttcctgggccagaccatcgtggaggtgagaaccctgagcggcgagatggacgtgtggtacaacctggagaagagaaccgacaagagcgccgtgagcggcgccatcagactgaagatcaacgtggagatcaagggcgaggagaaggtggccccctaccacatccagtacacctgcctgcacgagaacctgttccactacctgaccgaggtgaagagcaacggcggcgtgaagatccccgaggtgaagggcgacgaggcctggaaggtgttcttcgacgacgccagccaggagatcgtggacgagttcgccatgagatacggcatcgagagcatctaccaggccatgacccacttcagctgcctgagcagcaagtacatgtgccccggcgtgcccgccgtgatgagcaccctgctggccaacatcaacgccttctacgcccacaccaccgtgagcaccaacatccaggtgagcgccagcgacagattcgccgccaccaacttcggcagagagaagttcatcaagctgctggaccagctgcacaacagcctgagaatcgacctgagcaagtacagagagaacttccccgccagcaacaccgagagactgcaggacctgaagagcaccgtggacctgctgaccagcatcaccttcttcagaatgaaggtgctggagctgcagagcccccccaaggccagcatggtggtgaaggactgcgtgagagcctgcctggacagcacctacaagtacatcttcgacaactgccacgagctgtacagccagctgaccgaccccagcaagaagcaggacatccccagagaggaccagggccccaccaccaagaacctggacttctggccccagctgatcaccctgatggtgaccatcatcgacgaggacaagaccgcctacacccccgtgctgaaccagttcccccaggagctgaacatgggcaagatcagcgccgagatcatgtggaccctgttcgccctggacatgaagtacgccctggaggagcacgagaaccagagactgtgcaagagcaccgactacatgaacctgcacttcaaggtgaagtggttctacaacgagtacgtgagagagctgcccgccttcaaggacgccgtgcccgagtacagcctgtggttcgagcccttcgtgatgcagtggctggacgagaacgaggacgtgagcatggagttcctgcacggcgccctgggcagagacaagaaggacggcttccagcagaccagcgagcacgccctgttcagctgcagcgtggtggacgtgttcgcccagctgaaccagagcttcgagatcatcaagaagctggagtgccccaaccccgaggccctgagccacctgatgagaagattcgccaagaccatcaacaaggtgctgctgcagtacgccgccatcgtgagcagcgacttcagcagccactgcgacaaggagaacgtgccctgcatcctgatgaacaacatccagcagctgagagtgcagctggagaagatgttcgagagcatgggcggcaaggagctggacagcgaggccagcaccatcctgaaggagctgcaggtgaagctgagcggcgtgctggacgagctgagcgtgacctacggcgagagcttccaggtgatcatcgaggagtgcatcaagcagatgagcttcgagctgaaccagatgagagccaacggcaacaccaccagcaacaagaacagcgccgccatggacgccgagatcgtgctgagaagcctgatggacttcctggacaagaccctgagcctgagcgccaagatctgcgagaagaccgtgctgaagagagtgctgaaggagctgtggaagctggtgctgaacaagatcgagaagcagatcgtgctgccccccctgaccgaccagaccggcccccagatgatcttcatcgccgccaaggacctgggccagctgagcaagctgaaggagcacatgatcagagaggacgccagaggcctgacccccagacagtgcgccatcatggaggtggtgctggccaccatcaagcagtacttccacgccggcggcaacggcctgaagaagaacttcctggagaagagccccgacctgcagagcctgagatacgccctgagcctgtacacccagaccaccgacgccctgatcaagaagttcatcgacacccagaccagccagagcagaagcagcaaggacgccgtgggccagatcagcgtgcacgtggacatcaccgccacccccggcaccggcgaccacaaggtgaccgtgaaggtgatcgccatcaacgacctgaactggcagaccaccgccatgttcagacccttcgtggaggtgtgcatcctgggccccaacctgggcgacaagaagagaaagcagggcaccaagaccaagagcaacacctggagccccaagtacaacgagaccttccagttcatcctgggcaaggagaacagacccggcgcctacgagctgcacctgagcgtgaaggactactgcttcgccagagaggacagaatcatcggcatgaccgtgatccagctgcagaacatcgccgagaagggcagctacggcgcctggtaccccctgctgaagaacatcagcatggacgagaccggcctgaccatcctgagaatcctgagccagagaaccagcgacgacgtggccaaggagttcgtgagactgaagagcgagaccagaagcaccgaggagagcgcctag

SEQ ID NO: 23854 - DNA, 1557 bp, Artificial Sequence
  Description of Artificial Sequence: Synthetic coding sequence
atgtgcccccaggagagcagcttccagcccagccagttcctgctgctggtgggcgtgcccgtggccagcgtgctgctgctggcccagtgcctgagatggcactgccccagaagactgctgggcgcctgctggaccctgaacggccaggaggagcccgtgagccagcccaccccccagctggagaacgaggtgagcagacagcacctgcccgccaccctgcccgagatggtggccttctaccaggagctgcacacccccacccagggccagaccatggtgagacagctgatgcacaagctgctggtgttcagcgccagagaggtggaccacagaggcggctgcctgatgctgcaggacaccggcatcagcctgctgatcccccccggcgccgtggccgtgggcagacaggagagagtgagcctgatcctggtgtgggacctgagcgacgcccccagcctgagccaggcccagggcctggtgagccccgtggtggcctgcggcccccacggcgccagcttcctgaagccctgcaccctgaccttcaagcactgcgccgagcagcccagccacgccagaacctacagcagcaacaccaccctgctggacgccaaggtgtggagacccctgggcagacccggcgcccacgccagcagagacgagtgcagaatccacctgagccacttcagcctgtacacctgcgtgctggaggcccccgtgggcagagaggccagaaagtggctgcagctggccgtgttctgcagccccctggtgcccggccagagccacctgcagctgagaatctacttcctgaacaacaccccctgcgccctgcagtgggccctgaccaacgagcagccccacggcggcagactgagaggcccctgccagctgttcgacttcaacggcgccagaggcgaccagtgcctgaagctgacctacatcagcgagggctgggagaacgtggacgacagcagctgccagctggtgccccacctgcacatctggcacggcaagtgccccttcagaagcttctgcttcagaagaaaggccgccgacgagaacgaggactgcagcgccctgaccaacgagatcatcgtgaccatgcacaccttccaggacggcctggagaccaagtacatggagatcctgagattccaggccagcgaggaggagagctgggccgcccccccccccgtgagccagccccccccctgcaacagactgccccccgagctgttcgagcagctgagaatgctgctggagcccaacagcatcaccggcaacgactggagaagactggccagccacctgggcctgtgcggcatgaagatcagattcctgagctgccagagaagccccgccgccgccatcctggagctgttcgaggagcagaacggcagcctgcaggagctgcactacctgatgaccgtgatggagagactggactgcgccagcgccatccagaactacctgagcggcacccacggcggcagccccggccccgagagaggcggcgccagagacaaccagggcctggagctggacgagaagctgtag

SEQ ID NO: 23855 - DNA, 1557 bp, Artificial Sequence; identical to SEQ ID NO: 23854
  Description of Artificial Sequence: Synthetic coding sequence

SEQ ID NO: 23856 - DNA, 2862 bp, Artificial Sequence
  Description of Artificial Sequence: Synthetic coding sequence
atgggcagagccgccgccaccgccggcggcggcggcggcgccagaagatggctgccctggctgggcctgtgcttctgggccgccggcaccgccgccgccagaggcaccgacaacggcgaggccctgcccgagagcatccccagcgcccccggcaccctgccccacttcatcgaggagcccgacgacgcctacatcatcaagagcaaccccatcgccctgagatgcaaggccagacccgccatgcagatcttcttcaagtgcaacggcgagtgggtgcaccagaacgagcacgtgagcgaggagaccctggacgagagcagcggcctgaaggtgagagaggtgttcatcaacgtgaccagacagcaggtggaggacttccacggccccgaggactactggtgccagtgcgtggcctggagccacctgggcaccagcaagagcagaaaggccagcgtgagaatcgcctacctgagaaagaacttcgagcaggacccccagggcagagaggtgcccatcgagggcatgatcgtgctgcactgcagaccccccgagggcgtgcccgccgccgaggtggagtggctgaagaacgaggagcccatcgacagcgagcaggacgagaacatcgacaccagagccgaccacaacctgatcatcagacaggccagactgagcgacagcggcaactacacctgcatggccgccaacatcgtggccaagagaagaagcctgagcgccaccgtggtggtgtacgtgaacggcggctggagcagctggaccgagtggagcgcctgcaacgtgagatgcggcagaggctggcagaagagaagcagaacctgcaccaaccccgcccccctgaacggcggcgccttctgcgagggcatgagcgtgcagaagatcacctgcaccagcctgtgccccgtggacggcagctgggaggtgtggagcgagtggagcgtgtgcagccccgagtgcgagcacctgagaatcagagagtgcaccgcccccccccccagaaacggcggcaagttctgcgagggcctgagccaggagagcgagaactgcaccgacggcctgtgcatcctggacaagaagcccctgcacgagatcaagccccagagcatcgagaacgccagcgacatcgccctgtacagcggcctgggcgccgccgtggtggccgtggccgtgctggtgatcggcgtgaccctgtacagaagaagccagagcgactacggcgtggacgtgatcgacagcagcgccctgaccggcggcttccagaccttcaacttcaagaccgtgagacagggcaacagcctgctgctgaacagcgccatgcagcccgacctgaccgtgagcagaacctacagcggccccatctgcctgcaggaccccctggacaaggagctgatgaccgagagcagcctgttcaaccccctgagcgacatcaaggtgaaggtgcagagcagcttcatggtgagcctgggcgtgagcgagagagccgagtaccacggcaagaaccacagcagaaccttcccccacggcaacaaccacagcttcagcaccatgcaccccagaaacaagatgccctacatccagaacctgagcagcctgcccaccagaaccgagctgagaaccaccggcgtgttcggccacctgggcggcagactggtgatgcccaacaccggcgtgagcctgctgatcccccacggcgccatccccgaggagaacagctgggagatctacatgagcatcaaccagggcgagcccagcctgcagagcgacggcagcgaggtgctgctgagccccgaggtgacctgcggcccccccgacatgatcgtgaccacccccttcgccctgaccatcccccactgcgccgacgtgagcagcgagcactggaacatccacctgaagaagagaacccagcagggcaagtgggaggaggtgatgagcgtggaggacgagagcaccagctgctactgcctgctggaccccttcgcctgccacgtgctgctggacagcttcggcacctacgccctgaccggcgagcccatcaccgactgcgccgtgaagcagctgaaggtggccgtgttcggctgcatgagctgcaacagcctggactacaacctgagagtgtactgcgtggacaacaccccctgcgccttccaggaggtggtgagcgacgagagacaccagggcggccagctgctggaggagcccaagctgctgcacttcaagggcaacaccttcagcctgcagatcagcgtgctggacatcccccccttcctgtggagaatcaagcccttcaccgcctgccaggaggtgcccttcagcagagtgtggtgcagcaacagacagcccctgcactgcgccttcagcctggagagatacacccccaccaccacccagctgagctgcaagatctgcatcagacagctgaagggccacgagcagatcctgcaggtgcagaccagcatcctggagagcgagagagagaccatcaccttcttcgcccaggaggacagcaccttccccgcccagaccggccccaaggccttcaagatcccctacagcatcagacagagaatctgcgccaccttcgacacccccaacgccaagggcaaggactggcagatgctggcccagaagaacagcatcaacagaaacctgagctacttcgccacccagagcagccccagcgccgtgatcctgaacctgtgggaggccagacaccagcacgacggcgacctggacagcctggcctgcgccctggaggagatcggcagaacccacaccaagctgagcaacatcagcgagagccagctggacgaggccgacttcaactacagcagacagaacggcctgtag

SEQ ID NO: 23857 - DNA, 2847 bp, Artificial Sequence
  Description of Artificial Sequence: Synthetic coding sequence
atgatcctggtgctggtgaaggccctgagcgacgtgtgcgccggcaccagcggcttcctgctggacttcagcagccagaccagccccggcaccgacaacggcgaggccctgcccgagagcatccccagcgcccccggcaccctgccccacttcatcgaggagcccgacgacgcctacatcatcaagagcaaccccatcgccctgagatgcaaggccagacccgccatgcagatcttcttcaagtgcaacggcgagtgggtgcaccagaacgagcacgtgagcgaggagaccctggacgagagcagcggcctgaaggtgagagaggtgttcatcaacgtgaccagacagcaggtggaggacttccacggccccgaggactactggtgccagtgcgtggcctggagccacctgggcaccagcaagagcagaaaggccagcgtgagaatcgcctacctgagaaagaacttcgagcaggacccccagggcagagaggtgcccatcgagggcatgatcgtgctgcactgcagaccccccgagggcgtgcccgccgccgaggtggagtggctgaagaacgaggagcccatcgacagcgagcaggacgagaacatcgacaccagagccgaccacaacctgatcatcagacaggccagactgagcgacagcggcaactacacctgcatggccgccaacatcgtggccaagagaagaagcctgagcgccaccgtggtggtgtacgtgaacggcggctggagcagctggaccgagtggagcgcctgcaacgtgagatgcggcagaggctggcagaagagaagcagaacctgcaccaaccccgcccccctgaacggcggcgccttctgcgagggcatgagcgtgcagaagatcacctgcaccagcctgtgccccgtggacggcagctgggaggtgtggagcgagtggagcgtgtgcagccccgagtgcgagcacctgagaatcagagagtgcaccgcccccccccccagaaacggcggcaagttctgcgagggcctgagccaggagagcgagaactgcaccgacggcctgtgcatcctggacaagaagcccctgcacgagatcaagccccagagcatcgagaacgccagcgacatcgccctgtacagcggcctgggcgccgccgtggtggccgtggccgtgctggtgatcggcgtgaccctgtacagaagaagccagagcgactacggcgtggacgtgatcgacagcagcgccctgaccggcggcttccagaccttcaacttcaagaccgtgagacagggcaacagcctgctgctgaacagcgccatgcagcccgacctgaccgtgagcagaacctacagcggccccatctgcctgcaggaccccctggacaaggagctgatgaccgagagcagcctgttcaaccccctgagcgacatcaaggtgaaggtgcagagcagcttcatggtgagcctgggcgtgagcgagagagccgagtaccacggcaagaaccacagcagaaccttcccccacggcaacaaccacagcttcagcaccatgcaccccagaaacaagatgccctacatccagaacctgagcagcctgcccaccagaaccgagctgagaaccaccggcgtgttcggccacctgggcggcagactggtgatgcccaacaccggcgtgagcctgctgatcccccacggcgccatccccgaggagaacagctgggagatctacatgagcatcaaccagggcgagcccagcctgcagagcgacggcagcgaggtgctgctgagccccgaggtgacctgcggcccccccgacatgatcgtgaccacccccttcgccctgaccatcccccactgcgccgacgtgagcagcgagcactggaacatccacctgaagaagagaacccagcagggcaagtgggaggaggtgatgagcgtggaggacgagagcaccagctgctactgcctgctggaccccttcgcctgccacgtgctgctggacagcttcggcacctacgccctgaccggcgagcccatcaccgactgcgccgtgaagcagctgaaggtggccgtgttcggctgcatgagctgcaacagcctggactacaacctgagagtgtactgcgtggacaacaccccctgcgccttccaggaggtggtgagcgacgagagacaccagggcggccagctgctggaggagcccaagctgctgcacttcaagggcaacaccttcagcctgcagatcagcgtgctggacatcccccccttcctgtggagaatcaagcccttcaccgcctgccaggaggtgcccttcagcagagtgtggtgcagcaacagacagcccctgcactgcgccttcagcctggagagatacacccccaccaccacccagctgagctgcaagatctgcatcagacagctgaagggccacgagcagatcctgcaggtgcagaccagcatcctggagagcgagagagagaccatcaccttcttcgcccaggaggacagcaccttccccgcccagaccggccccaaggccttcaagatcccctacagcatcagacagagaatctgcgccaccttcgacacccccaacgccaagggcaaggactggcagatgctggcccagaagaacagcatcaacagaaacctgagctacttcgccacccagagcagccccagcgccgtgatcctgaacctgtgggaggccagacaccagcacgacggcgacctggacagcctggcctgcgccctggaggagatcggcagaacccacaccaagctgagcaacatcagcgagagccagctggacgaggccgacttcaactacagcagacagaacggcctgtag

SEQ ID NO: 23858 - DNA, 780 bp, Artificial Sequence
  Description of Artificial Sequence: Synthetic coding sequence
atgctgcccagcaccagcgtgaacagcctggtgcagggcaacggcgtgctgaacagcagagacgccgccagacacaccgccggcgccaagagatacaagtacctgagaagactgttcagattcagacagatggacttcgagttcgccgcctggcagatgctgtacctgttcaccagcccccagagagtgtacagaaacttccactacagaaagcagaccaaggaccagtgggccagagacgaccccgccttcctggtgctgctgagcatctggctgtgcgtgagcaccatcggcttcggcttcgtgctggacatgggcttcttcgagaccatcaagctgctgctgtgggtggtgctgatcgactgcgtgggcgtgggcctgctgatcgccaccctgatgtggttcatcagcaacaagtacctggtgaagagacagagcagagactacgacgtggagtggggctacgccttcgacgtgcacctgaacgccttctaccccctgctggtgatcctgcacttcatccagctgttcttcatcaaccacgtgatcctgaccgacaccttcatcggctacctggtgggcaacaccctgtggctggtggccgtgggctactacatctacgtgaccttcctgggctacagcgccctgcccttcctgaagaacaccgtgatcctgctgtaccccttcgcccccctgatcctgctgtacggcctgagcctggccctgggctggaacttcacccacaccctgtgcagcttctacaagtacagagtgaagtag

SEQ ID NO: 23859 - DNA, 831 bp, Artificial Sequence
  Description of Artificial Sequence: Synthetic coding sequence
atgttcctgcagaacacctgcaagagaaacgtgttcctgcccagcagaaagatgctgcccagcaccagcgtgaacagcctggtgcagggcaacggcgtgctgaacagcagagacgccgccagacacaccgccggcgccaagagatacaagtacctgagaagactgttcagattcagacagatggacttcgagttcgccgcctggcagatgctgtacctgttcaccagcccccagagagtgtacagaaacttccactacagaaagcagaccaaggaccagtgggccagagacgaccccgccttcctggtgctgctgagcatctggctgtgcgtgagcaccatcggcttcggcttcgtgctggacatgggcttcttcgagaccatcaagctgctgctgtgggtggtgctgatcgactgcgtgggcgtgggcctgctgatcgccaccctgatgtggttcatcagcaacaagtacctggtgaagagacagagcagagactacgacgtggagtggggctacgccttcgacgtgcacctgaacgccttctaccccctgctggtgatcctgcacttcatccagctgttcttcatcaaccacgtgatcctgaccgacaccttcatcggctacctggtgggcaacaccctgtggctggtggccgtgggctactacatctacgtgaccttcctgggctacagcgccctgcccttcctgaagaacaccgtgatcctgctgtaccccttcgcccccctgatcctgctgtacggcctgagcctggccctgggctggaacttcacccacaccctgtgcagcttctacaagtacagagtgaagtag

SEQ ID NO: 23860 - DNA, 831 bp, Artificial Sequence; identical to SEQ ID NO: 23859
  Description of Artificial Sequence: Synthetic coding sequence

SEQ ID NO: 23861 - DNA, 3111 bp, Artificial Sequence
  Description of Artificial Sequence: Synthetic coding sequence
atggaggtggtgggcgacttcgagtacagcaagagagacctggtgggccacggcgccttcgccgtggtgttcagaggcagacacagacagaagaccgactgggaggtggccatcaagagcatcaacaagaagaacctgagcaagagccagatcctgctgggcaaggagatcaagatcctgaaggagctgcagcacgagaacatcgtggccctgtacgacgtgcaggagctgcccaacagcgtgttcctggtgatggagtactgcaacggcggcgacctggccgactacctgcaggccaagggcaccctgagcgaggacaccatcagagtgttcctgcaccagatcgccgccgccatgagaatcctgcacagcaagggcatcatccacagagacctgaagccccagaacatcctgctgagctacgccaacagaagaaagagcagcgtgagcggcatcagaatcaagatcgccgacttcggcttcgccagatacctgcacagcaacatgatggccgccaccctgtgcggcagccccatgtacatggcccccgaggtgatcatgagccagcactacgacgccaaggccgacctgtggagcatcggcaccgtgatctaccagtgcctggtgggcaagccccccttccaggccaacagcccccaggacctgagaatgttctacgagaagaacagaagcctgatgcccagcatccccagagagaccagcccctacctggccaacctgctgctgggcctgctgcagagaaaccagaaggacagaatggacttcgaggccttcttcagccaccccttcctggagcagggccccgtgaagaagagctgccccgtgcccgtgcccatgtacagcggcagcgtgagcggcagcagctgcggcagcagccccagctgcagattcgccagcccccccagcctgcccgacatgcagcacatccaggaggagaacctgagcagcccccccctgggcccccccaactacctgcaggtgagcaaggacagcgccagcaccagcagcaagaacagcagctgcgacaccgacgacttcgtgctggtgccccacaacatcagcagcgaccacagctgcgacatgcccgtgggcaccgccggcagaagagccagcaacgagttcctggtgtgcggcggccagtgccagcccaccgtgagcccccacagcgagaccgcccccatccccgtgcccacccagatcagaaactaccagagaatcgagcagaacctgaccagcaccgccagcagcggcaccaacgtgcacggcagccccagaagcgccgtggtgagaagaagcaacaccagccccatgggcttcctgagacccggcagctgcagccccgtgcccgccgacaccgcccagaccgtgggcagaagactgagcaccggcagcagcagaccctacagccccagccccctggtgggcaccatccccgagcagttcagccagtgctgctgcggccacccccagggccacgacagcagaagcagaaacagcagcggcagccccgtgccccaggcccagagcccccagagcctgctgagcggcgccagactgcagagcgcccccaccctgaccgacatctaccagaacaagcagaagctgagaaagcagcacagcgaccccgtgtgccccagccacaccggcgccggctacagctacagcccccagcccagcagacccggcagcctgggcaccagccccaccaagcacctgggcagcagccccagaagcagcgactggttcttcaagacccccctgcccaccatcatcggcagccccaccaagaccaccgcccccttcaagatccccaagacccaggccagcagcaacctgctggccctggtgaccagacacggccccgccgaggagcagagcaaggacggcaacgagcccagagagtgcgcccactgcctgctggtgcagggcagcgagagacagagagccgagcagcagagcaaggccgtgttcggcagaagcgtgagcaccggcaagctgagcgaccagcagggcaagacccccatctgcagacaccagggcagcaccgacagcctgaacaccgagagacccatggacatcgcccccgccggcgcctgcggcggcgtgctggccccccccgccggcaccgccgccagcagcaaggccgtgctgttcaccgtgggcagccccccccacagcgccgccgcccccacctgcacccacatgttcctgagaaccagaaccaccagcgtgggccccagcaacagcggcggcagcctgtgcgccatgagcggcagagtgtgcgtgggcagcccccccggccccggcttcggcagcagcccccccggcgccgaggccgcccccagcctgagatacgtgccctacggcgccagcccccccagcctggagggcctgatcaccttcgaggcccccgagctgcccgaggagaccctgatggagagagagcacaccgacaccctgagacacctgaacgtgatgctgatgttcaccgagtgcgtgctggacctgaccgccatgagaggcggcaaccccgagctgtgcaccagcgccgtgagcctgtaccagatccaggagagcgtggtggtggaccagatcagccagctgagcaaggactggggcagagtggagcagctggtgctgtacatgaaggccgcccagctgctggccgccagcctgcacctggccaaggcccagatcaagagcggcaagctgagccccagcaccgccgtgaagcaggtggtgaagaacctgaacgagagatacaagttctgcatcaccatgtgcaagaagctgaccgagaagctgaacagattcttcagcgacaagcagagattcatcgacgagatcaacagcgtgaccgccgagaagctgatctacaactgcgccgtggagatggtgcagagcgccgccctggacgagatgttccagcagaccgaggacatcgtgtacagataccacaaggccgccctgctgctggagggcctgagcagaatcctgcaggaccccgccgacatcgagaacgtgcacaagtacaagtgcagcatcgagagaagactgagcgccctgtgccacagcaccgccaccgtgtag

SEQ ID NO: 23862 - DNA, 3111 bp, Artificial Sequence; identical to SEQ ID NO: 23861
  Description of Artificial Sequence: Synthetic coding sequence

SEQ ID NO: 23863 - DNA, 2532 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctggtgagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcgcctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccaacggcttctgggtgggccccctgggcggcggcagcgccagcgagagcgaccccaccggcttcctgcacgacagcagacacagactgagcagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggtgcagcccgaggtgaccgtgtaccccgagagaacccccctgctgcaccagcacaacctgctgcactgcagcgtgaccggcttctaccccggcgacatcaagatcaagtggttcctgaacggccaggaggagagagccggcgtgatgagcaccggccccatcagaaacggcgactggaccttccagaccgtggtgatgctggagatgacccccgagctgggccacgtgtacacctgcctggtggaccacagcagcctgctgagccccgtgagcgtggagtggagagcccagagcgagtacagctggagaaagatgctgagcggcatcgccgccttcctgctgggcctgtag

SEQ ID NO: 23864 - DNA, 2247 bp, Artificial Sequence
  Description of Artificial Sequence: Synthetic coding sequence
atggaccagcaccagcacctgaacaagaccgccgagagcgccagcagcgagaagaagaagaccagaagatgcaacggcttcaagatgttcctggccgccctgagcttcagctacatcgccaaggccctgggcggcatcatcatgaagatcagcatcacccagatcgagagaagattcgacatcagcagcagcctggccggcctgatcgacggcagcttcgagatcggcaacctgctggtgatcgtgttcgtgagctacttcggcagcaagctgcacagacccaagctgatcggcatcggctgcctgctgatgggcaccggcagcatcctgaccagcctgccccacttcttcatgggctactacagatacagcaaggagacccacatcaaccccagcgagaacagcaccagcagcctgagcacctgcctgatcaaccagaccctgagcttcaacggcaccagccccgagatcgtggagaaggactgcgtgaaggagagcggcagccacatgtggatctacgtgttcatgggcaacatgctgagaggcatcggcgagacccccatcgtgcccctgggcatcagctacatcgacgacttcgccaaggagggccacagcagcctgtacctgggcagcctgaacgccatcggcatgatcggccccgtgatcggcttcgccctgggcagcctgttcgccaagatgtacgtggacatcggctacgtggacctgagcaccatcagaatcacccccaaggacagcagatgggtgggcgcctggtggctgggcttcctggtgagcggcctgttcagcatcatcagcagcatccccttcttcttcctgcccaagaaccccaacaagccccagaaggagagaaagatcagcctgagcctgcacgtgctgaagaccaacgacgacagaaaccagaccgccaacctgaccaaccagggcaagaacgtgaccaagaacgtgaccggcttcttccagagcctgaagagcatcctgaccaaccccctgtacgtgatcttcctgctgctgaccctgctgcaggtgagcagcttcatcggcagcttcacctacgtgttcaagtacatggagcagcagtacggccagagcgccagccacgccaacttcctgctgggcatcatcaccatccccaccgtggccaccggcatgttcctgggcggcttcatcatcaagaagttcaagctgagcctggtgggcatcgccaagttcagcttcctgaccagcatgatcagcttcctgttccagctgctgtacttccccctgatctgcgagagcaagagcgtggccggcctgaccctgacctacgacggcaacaacagcgtggccagccacgtggacgtgcccctgagctactgcaacagcgagtgcaactgcgacgagagccagtgggagcccgtgtgcggcaacaacggcatcacctacctgagcccctgcctggccggctgcaagagcagcagcggcatcaagaagcacaccgtgttctacaactgcagctgcgtggaggtgaccggcctgcagaacagaaactacagcgcccacctgggcgagtgccccagagacaacacctgcaccagaaagttcttcatctacgtggccatccaggtgatcaacagcctgttcagcgccaccggcggcaccaccttcatcctgctgaccgtgaagatcgtgcagcccgagctgaaggccctggccatgggcttccagagcatggtgatcagaaccctgggcggcatcctggcccccatctacttcggcgccctgatcgacaagacctgcatgaagtggagcaccaacagctgcggcgcccagggcgcctgcagaatctacaacagcgtgttcttcggcatcgtgcagcccgagctgaaggccctggccatcggcttccacagcatgatcatgagaagcctgggcggcatcctggtgcccatctacttcggcgccctgatcgacaccacctgcatgaagtggagcaccaacagctgcggcgccagaggcgcctgcagaatctacaacagcacctacctgggcagagccttcttcggcctgaaggtggccctgatcttccccgtgctggtgctgctgaccgtgttcatcttcgtggtgagaaagaagagccacggcaaggacaccaaggtgctggagaacgagagacaggtgatggacgaggccaacctggagttcctgaacgacagcgagcacttcgtgcccagcgccgaggagcagtag

SEQ ID NO: 23865 - DNA, 582 bp, Artificial Sequence
  Description of Artificial Sequence: Synthetic coding sequence
atgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactgggtgcacggcttcctgagcttctag

SEQ ID NO: 23866 - DNA, 762 bp, Artificial Sequence
  Description of Artificial Sequence: Synthetic coding sequence
ggctgcctgggcaagagaatgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactggggcaaggacgagttccaccacttcctgatgctgagctgcctgagcagcagcgagctgcccgccttctacagctacatccccaagctggtgttccacaccagctgggtgagcttcttcctgatcttcttcttctag

SEQ ID NO: 23867 - DNA, 441 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatgtgcatcgccatctacagaagcagaagagtggacctgctgcacgacctggccctgttcagcggccccatctaccacatccccttcctgctgcagatgttcctgctgagccccctgctgtgggacctgaactgctacatctgcagcgagctgaccaacgccttcgagctgttcccctag

SEQ ID NO: 23868 - DNA, 765 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactgggagcccgagatccccgcccccatgagcgagctgaccgagaccgtggtgtgcgccctgggcctgagcgtgggcctggtgggcatcgtggtgggcaccgtgttcatcatcagaggcctgagaagcgtgggcgccagcagacaccagggccccctgtag

SEQ ID NO: 23869 - DNA, 498 bp, Artificial Sequence
  Description of Artificial Sequence: Synthetic coding sequence
atgaccagactgtgcctgcccagacccgaggccagagaggaccccatccccgtgccccccagaggcctgggcgccggcgagggcagcggcagccccgtgagaccccccgtgagcacctggggccccagctgggcccagctgctggacagcgtgctgtggctgggcgccctgggcctgaccatccaggccgtgttcagcaccaccggccccgccctgctgctgctgctggtgagcttcctgaccttcgacctgctgcacagacccgccggccacaccctgccccagagaaagctgctgaccagaggccagagccagggcgccggcgagggccccggccagcaggaggccctgctgctgcagatgggcaccgtgagcggccagctgagcctgcaggacgccctgctgctgctgctgatgggcctgggccccctgctgagagcctgcggcatgcccctgaccctgctgggcctggccttctgcctgcacccctgggcctag

SEQ ID NO: 23870 - DNA, 513 bp, Artificial Sequence
  Description of Artificial Sequence: Synthetic coding sequence
atggtgaccgtgctggaccagatgaaggccggcacctacaagctgaccttcgacaccgagggctactggagaaagagaggccaggagagcttctacccccacgtggaggtggtgctgaccatcaccagcaaggcccagaagttccacgtgcccctggtgctgcaccacctgcccagagagctggagagaagactggccgccggcggctgcctgcccgtgcccgccagatggctgcacccccccagcccccagcagagcggcctgtgcgcccaccagggcgccctggcccaccacttcctgggcaagagcagaccccccggcgagagccactgggccgccgtgacccaggtgagcatgaagctggtgcccgcccccgccaagctgagcatcagatgggacaacagcggcgccaagaccggcagcaccgccagacactgccccaacccccaggtgagcgccggccacagcgagaaggtgccccccaccgtggtgggcggcgagaccagagagtag

SEQ ID NO: 23871 - DNA, 780 bp, Artificial Sequence
  Description of Artificial Sequence: Synthetic coding sequence
atggccgccagcagactggagctgaacctggtgagactgctgagcagatgcgaggccatggccgccgagaagagagaccccgacgagtggagactggagaagtacgtgggcgccctggaggacatgctgcaggccctgaaggtgcacgccagcaagcccgccagcgaggtgatcaacgagtacagctggaaggtggacttcctgaagggcatgctgcaggccgagaagctgaccagcagcagcgagaaggccctggccaaccagttcctggcccccggcagagtgcccaccaccgccagagagagagtgcccgccaccaagaccgtgcacctgcagagcagagccagatacaccagcgagatgagaagcgagctgctgggcaccgacagcgccgagcccgagatggacgtgagaaagagaaccggcgtggccggcagccagcccgtgagcgagaagcagctggccgccgagctggacctggtgctgcagagacaccagaacctgcaggagaagctggccgaggagatgctgggcctggccagaagcctgaagaccaacaccctggccgcccagagcgtgatcaagaaggacaaccagaccctgagccacagcctgaagatggccgaccagaacctggagaagctgaagaccgagagcgagagactggagcagcacacccagaagagcgtgaactggctgctgtgggccatgctgatcatcgtgtgcttcatcttcatcagcatgatcctgttcatcagaatcatgcccaagctgaagtag

SEQ ID NO: 23872 - DNA, 177 bp, Artificial Sequence
  Description of Artificial Sequence: Synthetic coding sequence
atggccggccccgagagcgacgcccagtaccagttcaccggcatcaagaagtacttcaacagctacaccctgaccggcagaatgaactgcgtgctggccacctacggcagcatcgccctgatcgtgctgtacttcaagctgagaagcaagaagacccccgccgtgaaggccacctag

SEQ ID NO: 23873 - DNA, 177 bp, Artificial Sequence; identical to SEQ ID NO: 23872
  Description of Artificial Sequence: Synthetic coding sequence

SEQ ID NO: 23874 - DNA, 177 bp, Artificial Sequence; identical to SEQ ID NO: 23872
  Description of Artificial Sequence: Synthetic coding sequence

SEQ ID NO: 23875 - DNA, 177 bp, Artificial Sequence; identical to SEQ ID NO: 23872
  Description of Artificial Sequence: Synthetic coding sequence

SEQ ID NO: 23876 - DNA, 177 bp, Artificial Sequence; identical to SEQ ID NO: 23872
  Description of Artificial Sequence: Synthetic coding sequence

SEQ ID NO: 23877 - DNA, 792 bp, Artificial Sequence; identical to SEQ ID NO: 20935
  Description of Artificial Sequence: Synthetic coding sequence

SEQ ID NO: 23878 - DNA, 1170 bp, Artificial Sequence
  Description of Artificial Sequence: Synthetic coding sequence
atggccctgacccccgagagccccagcagcttccccggcctggccgccaccggcagcagcgtgcccgagccccccggcggccccaacgccaccctgaacagcagctgggccagccccaccgagcccagcagcctggaggacctggtggccaccggcaccatcggcaccctgctgagcgccatgggcgtggtgggcgtggtgggcaacgcctacaccctggtggtgacctgcagaagcctgagagccgtggccagcatgtacgtgtacgtggtgaacctggccctggccgacctgctgtacctgctgagcatccccttcatcgtggccacctacgtgaccaaggagtggcacttcggcgacgtgggctgcagagtgctgttcggcctggacttcctgaccatgcacgccagcatcttcaccctgaccgtgatgagcagcgagagatacgccgccgtgctgagacccctggacaccgtgcagagacccaagggctacagaaagctgctggccctgggcacctggctgctggccctgctgctgaccctgcccgtgatgctggccatgagactggtgagaagaggccccaagagcctgtgcctgcccgcctggggccccagagcccacagagcctacctgaccctgctgttcgccaccagcatcgccggccccggcctgctgatcggcctgctgtacgccagactggccagagcctacagaagaagccagagagccagcttcaagagagccagaagacccggcgccagagccctgagactggtgctgggcatcgtgctgctgttctgggcctgcttcctgcccttctggctgtggcagctgctggcccagtaccaccaggcccccctggcccccagaaccgccagaatcgtgaactacctgaccacctgcctgacctacggcaacagctgcgccaaccccttcctgtacaccctgctgaccagaaactacagagaccacctgagaggcagagtgagaggccccggcagcggcggcggcagaggccccgtgcccagcctgcagcccagagccagattccagagatgcagcggcagaagcctgagcagctgcagcccccagcccaccgacagcctggtgctggcccccgccgcccccgccagacccgcccccgagggccccagagcccccgcctag

SEQ ID NO: 23879 - DNA, 1578 bp, Artificial Sequence
  Description of Artificial Sequence: Synthetic coding sequence
atgatgccctggctgtggaccgccccccaccagaaggagagccagaaggccgacgagtacctgagagagatccaggagctgggccagctgacccaggccgtgcagcagtgcatcgaggccgccggccacgagcaccagcccgacatgcagaagagcctgctgagagtgggcctggacggcagagccggcgagggcggcgccggcagaggctgggacggccagcagggcagcagcctgctgagccccagcggcagcagccaggccgccagcttcggcaagtgcttcctggacagattcccccccgacagcttcgtgcacatgtgccaggacctgagagtgctgaacgccgtgagagactaccacatcggcatccccctgacctacagccagtacaagcagctgaccatccaggtgctgctggacagactggtgctgagaagactgtaccccctggccatccagatctgcgagtacctgagactgcccgaggtgcagggcgtgagcagaatcctggcccactgggcctgctacaaggtgcagcagaaggacgtgagcgacgaggacgtggccagagccatcaaccagaagctgggcgacacccccggcgtgagctacagcgacatcgccgccagagcctacggctgcggcagaaccgagctggccatcaagctgctggagtacgagcccagaagcggcgagcaggtgcccctgctgctgaagatgaagagaagcaagctggccctgagcaaggccatcgagagcggcgacaccgacctggtgttcaccgtgctgctgcacctgaagaacgagctgaacagaggcgacttcttcatgaccctgagaaaccagcccatggccctgagcctgtacagacagttctgcaagcaccaggagctggagaccctgaaggacctgtacaaccaggacgacaaccaccaggagctgggcagcttccacatcagagccagctacgccgccgaggagagaatcgagggcagagtggccgccctgcagaccgccgccgacgccttctacaaggccaagaacgagttcgccgccaaggccaccgaggaccagatgagactgctgagactgcagagaagactggaggacgagctgggcggccagttcctggacctgagcctgcacgacaccgtgaccaccctgatcctgggcggccacaacaagagagccgagcagctggccagagacttcagaatccccgacaagagactgtggtggctgaagctgaccgccctggccgacctggaggactgggaggagctggagaagttcagcaagagcaagaagagccccatcggctacctgcccttcgtggagatctgcatgaagcagcacaacaagtacgaggccaagaagtacgccagcagagtgggccccgagcagaaggtgaaggccctgctgctggtgggcgacgtggcccaggccgccgacgtggccatcgagcacagaaacgaggccgagctgagcctggtgctgagccactgcaccggcgccaccgacggcgccaccgccgacaagatccagagagccagagcccaggcccagaagaagtag

SEQ ID NO: 23880 - DNA, 2520 bp, Artificial Sequence
  Description of Artificial Sequence: Synthetic coding sequence
atggactgctacaccgccaactggaaccccctgggcgacagcgccttctacagaaagtacgagctgtacagcatggactgggacctgaaggaggagctgagagactgcctggtggccgccgccccctacggcggccccatcgccctgctgagaaacccctggagaaaggagaaggccgccagcgtgagacccgtgctggacatctacagcgccagcggcatgcccctggccagcctgctgtggaagagcggccccgtggtgagcctgggctggagcgccgaggaggagctgctgtgcgtgcaggaggacggcgccgtgctggtgtacggcctgcacggcgacttcagaagacacttcagcatgggcaacgaggtgctgcagaacagagtgctggacgccagaatcttccacaccgagttcggcagcggcgtggccatcctgaccggcgcccacagattcaccctgagcgccaacgtgggcgacctgaagctgagaagaatgcccgaggtgcccggcctgcagagcgcccccagctgctggaccgtgctgtgccaggacagagtggcccacatcctgctggccgtgggccccgacctgtacctgctggaccacgccgcctgcagcgccgtgaccccccccggcctggcccccggcgtgagcagcttcctgcagatggccgtgagcttcacctacagacacctggccctgttcaccgacaccggctacatctggatgggcaccgccagcctgaaggagaagctgtgcgagttcaactgcaacatcagagccccccccaagcagatggtgtggtgcagcagacccagaagcaaggagagagccgtggtggtggcctgggagagaagactgatggtggtgggcgacgcccccgagagcatccagttcgtgctggacgaggacagctacctggtgcccgagctggacggcgtgagaatcttcagcagaagcacccacgagttcctgcacgaggtgcccgccgccagcgaggagatcttcaagatcgccagcatggcccccggcgccctgctgctggaggcccagaaggagtacgagaaggagagccagaaggccgacgagtacctgagagagatccaggagctgggccagctgacccaggccgtgcagcagtgcatcgaggccgccggccacgagcaccagcccgacatgcagaagagcctgctgagagccgccagcttcggcaagtgcttcctggacagattcccccccgacagcttcgtgcacatgtgccaggacctgagagtgctgaacgccgtgagagactaccacatcggcatccccctgacctacagccagtacaagcagctgaccatccaggtgctgctggacagactggtgctgagaagactgtaccccctggccatccagatctgcgagtacctgagactgcccgaggtgcagggcgtgagcagaatcctggcccactgggcctgctacaaggtgcagcagaaggacgtgagcgacgaggacgtggccagagccatcaaccagaagctgggcgacacccccggcgtgagctacagcgacatcgccgccagagcctacggctgcggcagaaccgagctggccatcaagctgctggagtacgagcccagaagcggcgagcaggtgcccctgctgctgaagatgaagagaagcaagctggccctgagcaaggccatcgagagcggcgacaccgacctggtgttcaccgtgctgctgcacctgaagaacgagctgaacagaggcgacttcttcatgaccctgagaaaccagcccatggccctgagcctgtacagacagttctgcaagcaccaggagctggagaccctgaaggacctgtacaaccaggacgacaaccaccaggagctgggcagcttccacatcagagccagctacgccgccgaggagagaatcgagggcagagtggccgccctgcagaccgccgccgacgccttctacaaggccaagaacgagttcgccgccaaggccaccgaggaccagatgagactgctgagactgcagagaagactggaggacgagctgggcggccagttcctggacctgagcctgcacgacaccgtgaccaccctgatcctgggcggccacaacaagagagccgagcagctggccagagacttcagaatccccgacaagagactgtggtggctgaagctgaccgccctggccgacctggaggactgggaggagctggagaagttcagcaagagcaagaagagccccatcggctacctgcccttcgtggagatctgcatgaagcagcacaacaagtacgaggccaagaagtacgccagcagagtgggccccgagcagaaggtgaaggccctgctgctggtgggcgacgtggcccaggccgccgacgtggccatcgagcacagaaacgaggccgagctgagcctggtgctgagccactgcaccggcgccaccgacggcgccaccgccgacaagatccagagagccagagcccaggcccagaagaagtag

SEQ ID NO: 23881 - DNA, 2088 bp, Artificial Sequence
  Description of Artificial Sequence: Synthetic coding sequence
atggactgctacaccgccaactggaaccccctgggcgacagcgccttctacagaaagtacgagctgtacagcatggactgggacctgaaggaggagctgagagactgcctggtggccgccgccccctacggcggccccatcgccctgctgagaaacccctggagaaaggagaaggccgccagcgtgagacccgtgctggacatctacagcgccagcggcatgcccctggccagcctgctgtggaagagcggccccgtggtgagcctgggctggagcgccgaggaggagctgctgtgcgtgcaggaggacggcgccgtgctggtgtacggcctgcacggcgacttcagaagacacttcagcatgggcaacgaggtgctgcagaacagagtgctggacgccagaatcttccacaccgagttcggcagcggcgtggccatcctgaccggcgcccacagattcaccctgagcgccaacgtgggcgacctgaagctgagaagaatgcccgaggtgcccggcctgcagagcgcccccagctgctggaccgtgctgtgccaggacagagtggcccacatcctgctggccgtgggccccgacctgtacctgctggaccacgccgcctgcagcgccgtgaccccccccggcctggcccccggcgtgagcagcttcctgcagatggccgtgagcttcacctacagacacctggccctgttcaccgacaccggctacatctggatgggcaccgccagcctgaaggagaagctgtgcgagttcaactgcaacatcagagccccccccaagcagatggtgtggtgcagcagacccagaagcaaggagagagccgtggtggtggcctgggagagaagactgatggtggtgggcgacgcccccgagagcatccagtacaagcagctgaccatccaggtgctgctggacagactggtgctgagaagactgtaccccctggccatccagatctgcgagtacctgagactgcccgaggtgcagggcgtgagcagaatcctggcccactgggcctgctacaaggtgcagcagaaggacgtgagcgacgaggacgtggccagagccatcaaccagaagctgggcgacacccccggcgtgagctacagcgacatcgccgccagagcctacggctgcggcagaaccgagctggccatcaagctgctggagtacgagcccagaagcggcgagcaggtgcccctgctgctgaagatgaagagaagcaagctggccctgagcaaggccatcgagagcggcgacaccgacctggtgttcaccgtgctgctgcacctgaagaacgagctgaacagaggcgacttcttcatgaccctgagaaaccagcccatggccctgagcctgtacagacagttctgcaagcaccaggagctggagaccctgaaggacctgtacaaccaggacgacaaccaccaggagctgggcagcttccacatcagagccagctacgccgccgaggagagaatcgagggcagagtggccgccctgcagaccgccgccgacgccttctacaaggccaagaacgagttcgccgccaaggccaccgaggaccagatgagactgctgagactgcagagaagactggaggacgagctgggcggccagttcctggacctgagcctgcacgacaccgtgaccaccctgatcctgggcggccacaacaagagagccgagcagctggccagagacttcagaatccccgacaagagactgtggtggctgaagctgaccgccctggccgacctggaggactgggaggagctggagaagttcagcaagagcaagaagagccccatcggctacctgcccttcgtggagatctgcatgaagcagcacaacaagtacgaggccaagaagtacgccagcagagtgggccccgagcagaaggtgaaggccctgctgctggtgggcgacgtggcccaggccgccgacgtggccatcgagcacagaaacgaggccgagctgagcctggtgctgagccactgcaccggcgccaccgacggcgccaccgccgacaagatccagagagccagagcccaggcccagaagaagtag

SEQ ID NO: 23882 - DNA, 684 bp, Artificial Sequence
  Description of Artificial Sequence: Synthetic coding sequence
atgggcgcccccctggaggtgctgcagaacagagtgctggacgccagaatcttccacaccgagttcggcagcggcgtggccatcctgaccggcgcccacagattcaccctgagcgccaacgtgggcgacctgaagctgagaagaatgcccgaggtgcccggcctgcagagcgcccccagctgctggaccgtgctgtgccaggacagagtggcccacatcctgctggccgtgggccccgacctgtacctgctggaccacgccgcctgcagcgccgtgaccccccccggcctggcccccggcgtgagcagcttcctgcagatggccgtgagcttcacctacagacacctggccctgttcaccgacaccggctacatctggatgggcaccgccagcctgaaggagaagctgtgcgagttcaactgcaacatcagagccccccccaagcagatggtgtggtgcagcagacccagaagcaaggagagagccgtggtggtggcctgggagagaagactgatggtggtgggcgacgcccccgagagcatccagttcgtgctggacgaggacagctacctggtgcccgagctggacggcgtgagaatcttcagcagaagcacccacgagttcctgcacgaggtgcccgccgccagcgaggagatcttcaagatcgccagcatggccccctag

SEQ ID NO: 23883 - DNA, 825 bp, Artificial Sequence
  Description of Artificial Sequence: Synthetic coding sequence
atgggcgcccccctggaggtgctgcagaacagagtgctggacgccagaatcttccacaccgagttcggcagcggcgtggccatcctgaccggcgcccacagattcaccctgagcgccaacgtgggcgacctgaagctgagaagaatgcccgaggtgcccggcctgcagagcgcccccagctgctggaccgtgctgtgccaggacagagtggcccacatcctgctggccgtgggccccgacctgtacctgctggaccacgccgcctgcagcgccgtgaccccccccggcctggcccccggcgtgagcagcttcctgcagatggccgtgagcttcacctacagacacctggccctgttcaccgacaccggctacatctggatgggcaccgccagcctgaaggagaagctgtgcgagttcaactgcaacatcagagccccccccaagcagatggtgtggtgcagcagacccagaagcaaggagagagccgtggtggtggcctgggagagaagactgatggtggtgggcgacgcccccgagagcatccagtacaagcagctgaccatccaggtgctgctggacagactggtgctgagaagactgtaccccctggccatccagatctgcgagtacctgagactgcccgaggtgcagggcgtgagcagaatcctggcccactgggcctgctacaaggtgcagcagaaggacgtgagcgacgaggacgtggccagagccatcaaccagaagctgggcgacacccccggcgtgagctacagcgacatcgccgccagagcctacggctgcggcagaaccgagctggccatctag

SEQ ID NO: 23884 - DNA, 711 bp, Artificial Sequence
  Description of Artificial Sequence: Synthetic coding sequence
atgccccccagagagctgagcgaggccgagcccccccccctgagagcccccacccccccccccagaagaagaagcgccccccccgagctgggcatcaagtgcgtgctggtgggcgacggcgccgtgggcaagagcagcctgatcgtgagctacacctgcaacggctaccccgccagatacagacccaccgccctggacaccttcagcgtgcaggtgctggtggacggcgcccccgtgagaatcgagctgtgggacaccgccggccaggaggacttcgacagactgagaagcctgtgctaccccgacaccgacgtgttcctggcctgcttcagcgtggtgcagcccagcagcttccagaacatcaccgagaagtggctgcccgagatcagaacccacaacccccaggcccccgtgctgctggtgggcacccaggccgacctgagagacgacgtgaacgtgctgatccagctggaccagggcggcagagagggccccgtgccccagccccaggcccagggcctggccgagaagatcagagcctgctgctacctggagtgcagcgccctgacccagaagaacctgaaggaggtgttcgacagcgccatcctgagcgccatcgagcacaaggccagactggagaagaagctgaacgccaagggcgtgagaaccctgagcagatgcagatggaagaagttcttctgcttcgtgtag

SEQ ID NO: 23885 - DNA, 561 bp, Artificial Sequence
  Description of Artificial Sequence: Synthetic coding sequence
atggccggccacagactggtgctggtgctgggcgacctgcacatcccccacagatgcaacagcctgcccgccaagttcaagaagctgctggtgcccggcaagatccagcacatcctgtgcaccggcaacctgtgcaccaaggagagctacgactacctgaagaccctggccggcgacgtgcacatcgtgagaggcgacttcgacgagaacctgaactaccccgagcagaaggtggtgaccgtgggccagttcaagatcggcctgatccacggccaccaggtgatcccctggggcgacatggccagcctggccctgctgcagagacagttcgacgtggacatcctgatcagcggccacacccacaagttcgaggccttcgagcacgagaacaagttctacatcaaccccggcagcgccaccggcgcctacaacgccctggagaccaacatcatccccagcttcgtgctgatggacatccaggccagcaccgtggtgacctacgtgtaccagctgatcggcgacgacgtgaaggtggagagaatcgagtacaagaagccctag

SEQ ID NO: 23886 - DNA, 264 bp, Artificial Sequence
  Description of Artificial Sequence: Synthetic coding sequence
atggccagcctggccctgctgcagagacagttcgacgtggacatcctgatcagcggccacacccacaagttcgaggccttcgagcacgagaacaagttctacatcaaccccggcagcgccaccggcgcctacaacgccctggagaccaacatcatccccagcttcgtgctgatggacatccaggccagcaccgtggtgacctacgtgtaccagctgatcggcgacgacgtgaaggtggagagaatcgagtacaagaagccctag

SEQ ID NO: 23887 - DNA, 549 bp, Artificial Sequence
  Description of Artificial Sequence: Synthetic coding sequence
atgctggtgctggtgctgggcgacctgcacatcccccacagatgcaacagcctgcccgccaagttcaagaagctgctggtgcccggcaagatccagcacatcctgtgcaccggcaacctgtgcaccaaggagagctacgactacctgaagaccctggccggcgacgtgcacatcgtgagaggcgacttcgacgagaacctgaactaccccgagcagaaggtggtgaccgtgggccagttcaagatcggcctgatccacggccaccaggtgatcccctggggcgacatggccagcctggccctgctgcagagacagttcgacgtggacatcctgatcagcggccacacccacaagttcgaggccttcgagcacgagaacaagttctacatcaaccccggcagcgccaccggcgcctacaacgccctggagaccaacatcatccccagcttcgtgctgatggacatccaggccagcaccgtggtgacctacgtgtaccagctgatcggcgacgacgtgaaggtggagagaatcgagtacaagaagccctag

SEQ ID NO: 23888 - DNA, 2172 bp, Artificial Sequence
  Description of Artificial Sequence: Synthetic coding sequence
atggccgccgccgccaccatggccgccgccgccagagagctggtgctgagagccggcaccagcgacatggaggaggaggagggccccctggccggcggccccggcctgcaggagcccctgcagctgggcgagctggacatcaccagcgacgagttcatcctggacgaggtggacgtgcacatccaggccaacctggaggacgagctggtgaaggaggccctgaagaccggcgtggacctgagacactacagcaagcaggtggagctggagctgcagcagatcgagcagaagagcatcagagactacatccaggagagcgagaacatcgccagcctgcacaaccagatcaccgcctgcgacgccgtgctggagagaatggagcagatgctgggcgccttccagagcgacctgagcagcatcagcagcgagatcagaaccctgcaggagcagagcggcgccatgaacatcagactgagaaacagacaggccgtgagaggcaagctgggcgagctggtggacggcctggtggtgcccagcgccctggtgaccgccatcctggaggcccccgtgaccgagcccagattcctggagcagctgcaggagctggacgccaaggccgccgccgtgagagagcaggaggccagaggcaccgccgcctgcgccgacgtgagaggcgtgctggacagactgagagtgaaggccgtgaccaagatcagagagttcatcctgcagaagatctacagcttcagaaagcccatgaccaactaccagatcccccagaccgccctgctgaagtacagattcttctaccagttcctgctgggcaacgagagagccaccgccaaggagatcagagacgagtacgtggagaccctgagcaagatctacctgagctactacagaagctacctgggcagactgatgaaggtgcagtacgaggaggtggccgagaaggacgacctgatgggcgtggaggacaccgccaagaagggcttcttcagcaagcccagcctgagaagcagaaacaccatcttcaccctgggcaccagaggcagcgtgatcagccccaccgagctggaggcccccatcctggtgccccacaccgcccagagaggcgagcagagataccccttcgaggccctgttcagaagccagcactacgccctgctggacaacagctgcagagagtacctgttcatctgcgagttcttcgtggtgagcggccccgccgcccacgacctgttccacgccgtgatgggcagaaccctgagcatgaccctgaagcacctggacagctacctggccgactgctacgacgccatcgccgtgttcctgtgcatccacatcgtgctgagattcagaaacatcgccgccaagagagacgtgcccgccctggacagatactgggagcaggtgctggccctgctgtggcccagattcgagctgatcctggagatgaacgtgcagagcgtgagaagcaccgacccccagagactgggcggcctggacaccagaccccactacatcaccagaagatacgccgagttcagcagcgccctggtgagcatcaaccagaccatccccaacgagagaaccatgcagctgctgggccagctgcaggtggaggtggagaacttcgtgctgagagtggccgccgagttcagcagcagaaaggagcagctggtgttcctgatcaacaactacgacatgatgctgggcgtgctgatggagagagccgccgacgacagcaaggaggtggagagcttccagcagctgctgaacgccagaacccaggagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 23889 - DNA, 2106 bp, Artificial Sequence
  Description of Artificial Sequence: Synthetic coding sequence
atggaggaggaggagggccccctggccggcggccccggcctgcaggagcccctgcagctgggcgagctggacatcaccagcgacgagttcatcctggacgaggtggacgtgcacatccaggccaacctggaggacgagctggtgaaggaggccctgaagaccggcgtggacctgagacactacagcaagcaggtggagctggagctgcagcagatcgagcagaagagcatcagagactacatccaggagagcgagaacatcgccagcctgcacaaccagatcaccgcctgcgacgccgtgctggagagaatggagcagatgctgggcgccttccagagcgacctgagcagcatcagcagcgagatcagaaccctgcaggagcagagcggcgccatgaacatcagactgagaaacagacaggccgtgagaggcaagctgggcgagctggtggacggcctggtggtgcccagcgccctggtgaccgccatcctggaggcccccgtgaccgagcccagattcctggagcagctgcaggagctggacgccaaggccgccgccgtgagagagcaggaggccagaggcaccgccgcctgcgccgacgtgagaggcgtgctggacagactgagagtgaaggccgtgaccaagatcagagagttcatcctgcagaagatctacagcttcagaaagcccatgaccaactaccagatcccccagaccgccctgctgaagtacagattcttctaccagttcctgctgggcaacgagagagccaccgccaaggagatcagagacgagtacgtggagaccctgagcaagatctacctgagctactacagaagctacctgggcagactgatgaaggtgcagtacgaggaggtggccgagaaggacgacctgatgggcgtggaggacaccgccaagaagggcttcttcagcaagcccagcctgagaagcagaaacaccatcttcaccctgggcaccagaggcagcgtgatcagccccaccgagctggaggcccccatcctggtgccccacaccgcccagagaggcgagcagagataccccttcgaggccctgttcagaagccagcactacgccctgctggacaacagctgcagagagtacctgttcatctgcgagttcttcgtggtgagcggccccgccgcccacgacctgttccacgccgtgatgggcagaaccctgagcatgaccctgaagcacctggacagctacctggccgactgctacgacgccatcgccgtgttcctgtgcatccacatcgtgctgagattcagaaacatcgccgccaagagagacgtgcccgccctggacagatactgggagcaggtgctggccctgctgtggcccagattcgagctgatcctggagatgaacgtgcagagcgtgagaagcaccgacccccagagactgggcggcctggacaccagaccccactacatcaccagaagatacgccgagttcagcagcgccctggtgagcatcaaccagaccatccccaacgagagaaccatgcagctgctgggccagctgcaggtggaggtggagaacttcgtgctgagagtggccgccgagttcagcagcagaaaggagcagctggtgttcctgatcaacaactacgacatgatgctgggcgtgctgatggagagagccgccgacgacagcaaggaggtggagagcttccagcagctgctgaacgccagaacccaggagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 23890 - DNA, 2172 bp, Artificial Sequence; identical to SEQ ID NO: 23888
  Description of Artificial Sequence: Synthetic coding sequence

SEQ ID NO: 23891 - DNA, 1797 bp, Artificial Sequence
  Description of Artificial Sequence: Synthetic coding sequence
atggagcagatgctgggcgccttccagagcgacctgagcagcatcagcagcgagatcagaaccctgcaggagcagagcggcgccatgaacatcagactgagaaacagacaggccgtgagaggcaagctgggcgagctggtggacggcctggtggtgcccagcgccctggtgaccgccatcctggaggcccccgtgaccgagcccagattcctggagcagctgcaggagctggacgccaaggccgccgccgtgagagagcaggaggccagaggcaccgccgcctgcgccgacgtgagaggcgtgctggacagactgagagtgaaggccgtgaccaagatcagagagttcatcctgcagaagatctacagcttcagaaagcccatgaccaactaccagatcccccagaccgccctgctgaagtacagattcttctaccagttcctgctgggcaacgagagagccaccgccaaggagatcagagacgagtacgtggagaccctgagcaagatctacctgagctactacagaagctacctgggcagactgatgaaggtgcagtacgaggaggtggccgagaaggacgacctgatgggcgtggaggacaccgccaagaagggcttcttcagcaagcccagcctgagaagcagaaacaccatcttcaccctgggcaccagaggcagcgtgatcagccccaccgagctggaggcccccatcctggtgccccacaccgcccagagaggcgagcagagataccccttcgaggccctgttcagaagccagcactacgccctgctggacaacagctgcagagagtacctgttcatctgcgagttcttcgtggtgagcggccccgccgcccacgacctgttccacgccgtgatgggcagaaccctgagcatgaccctgaagcacctggacagctacctggccgactgctacgacgccatcgccgtgttcctgtgcatccacatcgtgctgagattcagaaacatcgccgccaagagagacgtgcccgccctggacagatactgggagcaggtgctggccctgctgtggcccagattcgagctgatcctggagatgaacgtgcagagcgtgagaagcaccgacccccagagactgggcggcctggacaccagaccccactacatcaccagaagatacgccgagttcagcagcgccctggtgagcatcaaccagaccatccccaacgagagaaccatgcagctgctgggccagctgcaggtggaggtggagaacttcgtgctgagagtggccgccgagttcagcagcagaaaggagcagctggtgttcctgatcaacaactacgacatgatgctgggcgtgctgatggagagagccgccgacgacagcaaggaggtggagagcttccagcagctgctgaacgccagaacccaggagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 23892 - DNA, 2172 bp, Artificial Sequence; identical to SEQ ID NO: 23888
  Description of Artificial Sequence: Synthetic coding sequence

SEQ ID NO: 23893 - DNA, 2172 bp, Artificial Sequence; identical to SEQ ID NO: 23888
  Description of Artificial Sequence: Synthetic coding sequence

SEQ ID NO: 23894 - DNA, 2172 bp, Artificial Sequence; identical to SEQ ID NO: 23888
  Description of Artificial Sequence: Synthetic coding sequence

SEQ ID NO: 23895 - DNA, 2172 bp, Artificial Sequence; identical to SEQ ID NO: 23888
  Description of Artificial Sequence: Synthetic coding sequence

SEQ ID NO: 23896 - DNA, 2106 bp, Artificial Sequence; identical to SEQ ID NO: 23889
  Description of Artificial Sequence: Synthetic coding sequence

SEQ ID NO: 23897 - DNA, 2106 bp, Artificial Sequence; identical to SEQ ID NO: 23889
  Description of Artificial Sequence: Synthetic coding sequence

SEQ ID NO: 23898 - DNA, 1797 bp, Artificial Sequence; identical to SEQ ID NO: 23891
  Description of Artificial Sequence: Synthetic coding sequence

SEQ ID NO: 23899 - DNA, 1797 bp, Artificial Sequence; identical to SEQ ID NO: 23891
  Description of Artificial Sequence: Synthetic coding sequence

SEQ ID NO: 23900 - DNA, 1443 bp, Artificial Sequence
  Description of Artificial Sequence: Synthetic coding sequence
atgagcgacgtggccatcgtgaaggagggctggctgcacaagagaggcgagtacatcaagacctggagacccagatacttcctgctgaagaacgacggcaccttcatcggctacaaggagagaccccaggacgtggaccagagagaggcccccctgaacaacttcagcgtggcccagtgccagctgatgaagaccgagagacccagacccaacaccttcatcatcagatgcctgcagtggaccaccgtgatcgagagaaccttccacgtggagacccccgaggagagagaggagtggaccaccgccatccagaccgtggccgacggcctgaagaagcaggaggaggaggagatggacttcagaagcggcagccccagcgacaacagcggcgccgaggagatggaggtgagcctggccaagcccaagcacagagtgaccatgaacgagttcgagtacctgaagctgctgggcaagggcaccttcggcaaggtgatcctggtgaaggagaaggccaccggcagatactacgccatgaagatcctgaagaaggaggtgatcgtggccaaggacgaggtggcccacaccctgaccgagaacagagtgctgcagaacagcagacaccccttcctgaccgccctgaagtacagcttccagacccacgacagactgtgcttcgtgatggagtacgccaacggcggcgagctgttcttccacctgagcagagagagagtgttcagcgaggacagagccagattctacggcgccgagatcgtgagcgccctggactacctgcacagcgagaagaacgtggtgtacagagacctgaagctggagaacctgatgctggacaaggacggccacatcaagatcaccgacttcggcctgtgcaaggagggcatcaaggacggcgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagaagctgttcgagctgatcctgatggaggagatcagattccccagaaccctgggccccgaggccaagagcctgctgagcggcctgctgaagaaggaccccaagcagagactgggcggcggcagcgaggacgccaaggagatcatgcagcacagattcttcgccggcatcgtgtggcagcacgtgtacgagaagaagctgagcccccccttcaagccccaggtgaccagcgagaccgacaccagatacttcgacgaggagttcaccgcccagatgatcaccatcaccccccccgaccaggacgacagcatggagtgcgtggacagcgagagaagaccccacttcccccagttcagctacagcgccagcggcaccgcctag

SEQ ID NO: 23901 - DNA, 3192 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgcagcagctgatggacgagccccccgcccccggcagccccgagctgtag

SEQ ID NO: 23902 - DNA, 348 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctag

SEQ ID NO: 23903 - DNA, 981 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggctag

SEQ ID NO: 23904 - DNA, 774 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagtgttctaccacggctgctggctgctgagcggctgcgactag

SEQ ID NO: 23905 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgcagcagctgatggacgagccccccgcccccggcagccccgagctgtag

SEQ ID NO: 23906 - DNA, 3282 bp, Artificial Sequence
  Description of Artificial Sequence: Synthetic coding sequence
atgggcggcaaggcctggcccagaagagccgtgggcaccgccggcggcccctgcgccgagcagatcagcgcccccttccagaccctgctgatgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgcagcagctgatggacgagccccccgcccccggcagccccgagctgtag

SEQ ID NO: 23907 - DNA, 699 bp, Artificial Sequence
  Description of Artificial Sequence: Synthetic coding sequence
atggccagcagcgccgccagcagcgagcacttcgagaagctgcacgagatcttcagaggcctgcacgaggacctgcagggcgtgcccgagagactgctgggcaccgccggcaccgaggagaagaagaagctgatcagagacttcgacgagaagcagcaggaggccaacgagaccctggccgagatggaggaggagctgagatacgcccccctgagcttcagaaaccccatgatgagcaagctgagaaactacagaaaggacctggccaagctgcacagagaggtgagaagcacccccctgaccgccacccccggcggcagaggcgacatgaagtacggcatctacgccgtggagaacgagcacatgaacagactgcagagccagagagccatgctgctgcagggcaccgagagcctgaacagagccacccagagcatcgagagaagccacagaatcgccaccgagaccgaccagatcggcagcgagatcatcgaggagctgggcgagcagagagaccagctggagagaaccaagagcagactggtgaacaccagcgagaacctgagcaagagcagaaagatcctgagaagcatgagcagaaaggtgaccaccaacaagctgctgctgagcatcatcatcctgctggagctggccatcctgggcggcctggtgtactacaagttcttcagaagccactag

SEQ ID NO: 23908 - DNA, 426 bp, Artificial Sequence
  Description of Artificial Sequence: Synthetic coding sequence
atgccccccaagttcaagagacacctgaacgacgacgacgtgaccggcagcgtgaagagcgagagaagaaacctgctggaggacgacagcgacgaggaggaggacttcttcctgagaggccccagcggccccagattcggccccagaaacgacaagatcaagcacgtgcagaaccaggtggacgaggtgatcgacgtgatgcaggagaacatcaccaaggtgatcgagagaggcgagagactggacgagctgcaggacaagagcgagagcctgagcgacaacgccaccgccttcagcaacagaagcaagcagctgagaagacagatgtggtggagaggctgcaagatcaaggccatcatggccctggtggccgccatcctgctgctggtgatcatcatcctgatcgtgatgaagtacagaacctag

SEQ ID NO: 23909 - DNA, 423 bp, Artificial Sequence
  Description of Artificial Sequence: Synthetic coding sequence
atgccccccaagttcaagagacacctgaacgacgacgacgtgaccggcagcgtgaagagcgagagaagaaacctgctggaggacgacagcgacgaggaggaggacttcttcctgggccccagcggccccagattcggccccagaaacgacaagatcaagcacgtgcagaaccaggtggacgaggtgatcgacgtgatgcaggagaacatcaccaaggtgatcgagagaggcgagagactggacgagctgcaggacaagagcgagagcctgagcgacaacgccaccgccttcagcaacagaagcaagcagctgagaagacagatgtggtggagaggctgcaagatcaaggccatcatggccctggtggccgccatcctgctgctggtgatcatcatcctgatcgtgatgaagtacagaacctag

SEQ ID NO: 23910 - DNA, 423 bp, Artificial Sequence; identical to SEQ ID NO: 23909
  Description of Artificial Sequence: Synthetic coding sequence

SEQ ID NO: 23911 - DNA, 426 bp, Artificial Sequence; identical to SEQ ID NO: 23908
  Description of Artificial Sequence: Synthetic coding sequence

SEQ ID NO: 23912 - DNA, 519 bp, Artificial Sequence
  Description of Artificial Sequence: Synthetic coding sequence
atgagaagacagcccgccaaggtggccgccctgctgctgggcctgctgctggagtgcaccgaggccaagaagcactgctggtacttcgagggcctgtaccccacctactacatctgcagaagctacgaggactgctgcggcagcagatgctgcgtgagagccctgagcatccagagactgtggtacttctggttcctgctgatgatgggcgtgctgttctgctgcggcgccggcttcttcatcagaagaagaatgtaccccccccccctgatcgaggagcccgccttcaacgtgagctacaccagacagccccccaaccccggccccggcgcccagcagcccggccccccctactacaccgaccccggcggccccggcatgaaccccgtgggcaacagcatggccatggccttccaggtgccccccaacagcccccagggcagcgtggcctgcccccccccccccgcctactgcaacacccccccccccccctacgagcaggtggtgaaggccaagtag

SEQ ID NO: 23913 - DNA, 510 bp, Artificial Sequence
  Description of Artificial Sequence: Synthetic coding sequence
atgctgagcgagaccctgggctacctgagcagcgtgctgctgcagtgcaccgaggccaagaagcactgctggtacttcgagggcctgtaccccacctactacatctgcagaagctacgaggactgctgcggcagcagatgctgcgtgagagccctgagcatccagagactgtggtacttctggttcctgctgatgatgggcgtgctgttctgctgcggcgccggcttcttcatcagaagaagaatgtaccccccccccctgatcgaggagcccgccttcaacgtgagctacaccagacagccccccaaccccggccccggcgcccagcagcccggccccccctactacaccgaccccggcggccccggcatgaaccccgtgggcaacagcatggccatggccttccaggtgccccccaacagcccccagggcagcgtggcctgcccccccccccccgcctactgcaacacccccccccccccctacgagcaggtggtgaaggccaagtag

SEQ ID NO: 23914 - DNA, 2196 bp, Artificial Sequence
  Description of Artificial Sequence: Synthetic coding sequence
atgctgaaggagtgggccatcaagcagggcatcctgctgaaggtggccgagaccatcaagagctggatcttcttcagccagtgcaacaagaaggacgacctgctgcacaagctggacatcggcttcagactggacagcctgcacaccatcctgcagcaggaggtgctgctgcaggaggacgtggagctgatcgagctgctggaccccagcatcctgagcgccggccagagccagcagcaggagaacggccacctgcccaccctgtgcagcctggccacccccaacatctgggacctgagcatgctgttcgccttcatcagcctgctggtgatgctgcccacctggtggatcgtgagcagctggctggtgtggggcgtgatcctgttcgtgtacctggtgatcagagccctgagactgtggagaaccgccaagctgcaggtgaccctgaagaagtacagcgtgcacctggaggacatggccaccaacagcagagccttcaccaacctggtgagaaaggccctgagactgatccaggagaccgaggtgatcagcagaggcttcaccctggtgagcgccgcctgccccttcaacaaggccggccagcaccccagccagcacctgatcggcctgagaaaggccgtgtacagaaccctgagagccaacttccaggccgccagactggccaccctgtacatgctgaagaactaccccctgaacagcgagagcgacaacgtgaccaactacatctgcgtggtgcccttcaaggagctgggcctgggcctgagcgaggagcagatcagcgaggaggaggcccacaacttcaccgacggcttcagcctgcccgccctgaaggtgctgttccagctgtgggtggcccagagcagcgagttcttcagaagactggccctgctgctgagcaccgccaacagcccccccggccccctgctgacccccgccctgctgccccacagaatcctgagcgacgtgacccagggcctgccccacgcccacagcgcctgcctggaggagctgaagagaagctacgagttctacagatacttcgagacccagcaccagagcgtgccccagtgcctgagcaagacccagcagaagagcagagagctgaacaacgtgcacaccgccgtgagaagcctgcagctgcacctgaaggccctgctgaacgaggtgatcatcctggaggacgagctggagaagctggtgtgcaccaaggagacccaggagctggtgagcgaggcctaccccatcctggagcagaagctgaagctgatccagccccacgtgcaggccagcaacaactgctgggaggaggccatcagccaggtggacaagctgctgagaagaaacaccgacaagaagggcaagcccgagatcgcctgcgagaacccccactgcaccgtggtgcccctgaagcagcccaccctgcacatcgccgacaaggaccccatccccgaggagcaggagctggaggcctacgtggacgacatcgacatcgacagcgacttcagaaaggacgacttctactacctgagccaggaggacaaggagagacagaagagagagcacgaggagagcaagagagtgctgcaggagctgaagagcgtgctgggcttcaaggccagcgaggccgagagacagaagtggaagcagctgctgttcagcgaccacgccgtgctgaagagcctgagccccgtggaccccgtggagcccatcagcaacagcgagcccagcatgaacagcgacatgggcaaggtgagcaagaacgacaccgaggaggagagcaacaagagcgccaccaccgacaacgagatcagcagaaccgagtacctgtgcgagaacagcctggagggcaagaacaaggacaacagcagcaacgaggtgttcccccagggcgccgaggagagaatgtgctaccagtgcgagagcgaggacgagccccaggccgacggcagcggcctgaccaccgccccccccacccccagagacagcctgcagcccagcatcaagcagagactggccagactgcagctgagccccgacttcaccttcaccgccggcctggccgccgaggtggccgccagaagcctgagcttcaccaccatgcaggagcagaccttcggcggcgaggaggaggagcagatcatcgaggagaacaagaacgagatcgaggagaagtag

SEQ ID NO: 23915 - DNA, 2340 bp, Artificial Sequence
  Description of Artificial Sequence: Synthetic coding sequence
atgctgcccgacatggaggacgtgcacctgttccagaacagccccctgtaccagtacctgcaggacctgggccacaccgacttcgagatctgcagcagcctgagccccaagaccgagaagtgcaccaccgagggccagcagaagccccccaccagagtgctgcccaagcagggcatcctgctgaaggtggccgagaccatcaagagctggatcttcttcagccagtgcaacaagaaggacgacctgctgcacaagctggacatcggcttcagactggacagcctgcacaccatcctgcagcaggaggtgctgctgcaggaggacgtggagctgatcgagctgctggaccccagcatcctgagcgccggccagagccagcagcaggagaacggccacctgcccaccctgtgcagcctggccacccccaacatctgggacctgagcatgctgttcgccttcatcagcctgctggtgatgctgcccacctggtggatcgtgagcagctggctggtgtggggcgtgatcctgttcgtgtacctggtgatcagagccctgagactgtggagaaccgccaagctgcaggtgaccctgaagaagtacagcgtgcacctggaggacatggccaccaacagcagagccttcaccaacctggtgagaaaggccctgagactgatccaggagaccgaggtgatcagcagaggcttcaccctggtgagcgccgcctgccccttcaacaaggccggccagcaccccagccagcacctgatcggcctgagaaaggccgtgtacagaaccctgagagccaacttccaggccgccagactggccaccctgtacatgctgaagaactaccccctgaacagcgagagcgacaacgtgaccaactacatctgcgtggtgcccttcaaggagctgggcctgggcctgagcgaggagcagatcagcgaggaggaggcccacaacttcaccgacggcttcagcctgcccgccctgaaggtgctgttccagctgtgggtggcccagagcagcgagttcttcagaagactggccctgctgctgagcaccgccaacagcccccccggccccctgctgacccccgccctgctgccccacagaatcctgagcgacgtgacccagggcctgccccacgcccacagcgcctgcctggaggagctgaagagaagctacgagttctacagatacttcgagacccagcaccagagcgtgccccagtgcctgagcaagacccagcagaagagcagagagctgaacaacgtgcacaccgccgtgagaagcctgcagctgcacctgaaggccctgctgaacgaggtgatcatcctggaggacgagctggagaagctggtgtgcaccaaggagacccaggagctggtgagcgaggcctaccccatcctggagcagaagctgaagctgatccagccccacgtgcaggccagcaacaactgctgggaggaggccatcagccaggtggacaagctgctgagaagaaacaccgacaagaagggcaagcccgagatcgcctgcgagaacccccactgcaccgtggtgcccctgaagcagcccaccctgcacatcgccgacaaggaccccatccccgaggagcaggagctggaggcctacgtggacgacatcgacatcgacagcgacttcagaaaggacgacttctactacctgagccaggaggacaaggagagacagaagagagagcacgaggagagcaagagagtgctgcaggagctgaagagcgtgctgggcttcaaggccagcgaggccgagagacagaagtggaagcagctgctgttcagcgaccacgccgtgctgaagagcctgagccccgtggaccccgtggagcccatcagcaacagcgagcccagcatgaacagcgacatgggcaaggtgagcaagaacgacaccgaggaggagagcaacaagagcgccaccaccgacaacgagatcagcagaaccgagtacctgtgcgagaacagcctggagggcaagaacaaggacaacagcagcaacgaggtgttcccccagggcgccgaggagagaatgtgctaccagtgcgagagcgaggacgagccccaggccgacggcagcggcctgaccaccgccccccccacccccagagacagcctgcagcccagcatcaagcagagactggccagactgcagctgagccccgacttcaccttcaccgccggcctggccgccgaggtggccgccagaagcctgagcttcaccaccatgcaggagcagaccttcggcggcgaggaggaggagcagatcatcgaggagaacaagaacgagatcgaggagaagtag

SEQ ID NO: 23916 - DNA, 2340 bp, Artificial Sequence
  Description of Artificial Sequence: Synthetic coding sequence
atgacccccgagttcgacgaggaggtggtgttcgagaacagccccctgtaccagtacctgcaggacctgggccacaccgacttcgagatctgcagcagcctgagccccaagaccgagaagtgcaccaccgagggccagcagaagccccccaccagagtgctgcccaagcagggcatcctgctgaaggtggccgagaccatcaagagctggatcttcttcagccagtgcaacaagaaggacgacctgctgcacaagctggacatcggcttcagactggacagcctgcacaccatcctgcagcaggaggtgctgctgcaggaggacgtggagctgatcgagctgctggaccccagcatcctgagcgccggccagagccagcagcaggagaacggccacctgcccaccctgtgcagcctggccacccccaacatctgggacctgagcatgctgttcgccttcatcagcctgctggtgatgctgcccacctggtggatcgtgagcagctggctggtgtggggcgtgatcctgttcgtgtacctggtgatcagagccctgagactgtggagaaccgccaagctgcaggtgaccctgaagaagtacagcgtgcacctggaggacatggccaccaacagcagagccttcaccaacctggtgagaaaggccctgagactgatccaggagaccgaggtgatcagcagaggcttcaccctggtgagcgccgcctgccccttcaacaaggccggccagcaccccagccagcacctgatcggcctgagaaaggccgtgtacagaaccctgagagccaacttccaggccgccagactggccaccctgtacatgctgaagaactaccccctgaacagcgagagcgacaacgtgaccaactacatctgcgtggtgcccttcaaggagctgggcctgggcctgagcgaggagcagatcagcgaggaggaggcccacaacttcaccgacggcttcagcctgcccgccctgaaggtgctgttccagctgtgggtggcccagagcagcgagttcttcagaagactggccctgctgctgagcaccgccaacagcccccccggccccctgctgacccccgccctgctgccccacagaatcctgagcgacgtgacccagggcctgccccacgcccacagcgcctgcctggaggagctgaagagaagctacgagttctacagatacttcgagacccagcaccagagcgtgccccagtgcctgagcaagacccagcagaagagcagagagctgaacaacgtgcacaccgccgtgagaagcctgcagctgcacctgaaggccctgctgaacgaggtgatcatcctggaggacgagctggagaagctggtgtgcaccaaggagacccaggagctggtgagcgaggcctaccccatcctggagcagaagctgaagctgatccagccccacgtgcaggccagcaacaactgctgggaggaggccatcagccaggtggacaagctgctgagaagaaacaccgacaagaagggcaagcccgagatcgcctgcgagaacccccactgcaccgtggtgcccctgaagcagcccaccctgcacatcgccgacaaggaccccatccccgaggagcaggagctggaggcctacgtggacgacatcgacatcgacagcgacttcagaaaggacgacttctactacctgagccaggaggacaaggagagacagaagagagagcacgaggagagcaagagagtgctgcaggagctgaagagcgtgctgggcttcaaggccagcgaggccgagagacagaagtggaagcagctgctgttcagcgaccacgccgtgctgaagagcctgagccccgtggaccccgtggagcccatcagcaacagcgagcccagcatgaacagcgacatgggcaaggtgagcaagaacgacaccgaggaggagagcaacaagagcgccaccaccgacaacgagatcagcagaaccgagtacctgtgcgagaacagcctggagggcaagaacaaggacaacagcagcaacgaggtgttcccccagggcgccgaggagagaatgtgctaccagtgcgagagcgaggacgagccccaggccgacggcagcggcctgaccaccgccccccccacccccagagacagcctgcagcccagcatcaagcagagactggccagactgcagctgagccccgacttcaccttcaccgccggcctggccgccgaggtggccgccagaagcctgagcttcaccaccatgcaggagcagaccttcggcggcgaggaggaggagcagatcatcgaggagaacaagaacgagatcgaggagaagtag

SEQ ID NO: 23917 - DNA, 531 bp, Artificial Sequence
  Description of Artificial Sequence: Synthetic coding sequence
atggccgcccccgtgctgctgagagtgagcgtgcccagatgggagagagtggccagatacgccgtgtgcgccgccggcatcctgctgagcatctacgcctaccacgtggagagagagaaggagagagaccccgagcacagagccctgtgcgacctgggcccctgggtgaagtgcagcgccgccctggccagcagatggggcagaggcttcggcctgctgggcagcatcttcggcaaggacggcgtgctgaaccagcccaacagcgtgttcggcctgatcttctacatcctgcagctgctgctgggcatgaccgccagcgccgtggccgccctgatcctgatgaccagcagcatcatgagcgtggtgggcagcctgtacctggcctacatcctgtacttcgtgctgaaggagttctgcatcatctgcatcgtgacctacgtgctgaacttcctgctgctgatcatcaactacaagagactggtgtacctgaacgaggcctggaagagacagctgcagcccaagcaggactag

SEQ ID NO: 23918 - DNA, 306 bp, Artificial Sequence
  Description of Artificial Sequence: Synthetic coding sequence
atggagagacccgacaaggccgccctgaacgccctgcagccccccgagttcagaaacgagagcagcctggccagcaccctgaagaccctgctgttcttcaccgccctgatgatcaccgtgcccatcggcctgtacttcaccaccaagagctacatcttcgagggcgccctgggcatgagcaacagagacagctacttctacgccgccatcgtggccgtggtggccgtgcacgtggtgctggccctgttcgtgtacgtggcctggaacgagggcagcagacagtggagagagggcaagcaggactag

SEQ ID NO: 23919 - DNA, 471 bp, Artificial Sequence
  Description of Artificial Sequence: Synthetic coding sequence
atgctgggcagcccctgcggcccccagctgagcgacagagacgccgacgaggaccagtgcagcagagagttcagaggcagaagaagcagaagaccccccagaagaaccatgctgagaggcaagagcagactgaacgtggagtggctgggctacagccccggcctgctgctggagcacagacccctgctggccggcagaacccccagaagccacagaagaaacgagagcagcctggccagcaccctgaagaccctgctgttcttcaccgccctgatgatcaccgtgcccatcggcctgtacttcaccaccaagagctacatcttcgagggcgccctgggcatgagcaacagagacagctacttctacgccgccatcgtggccgtggtggccgtgcacgtggtgctggccctgttcgtgtacgtggcctggaacgagggcagcagacagtggagagagggcaagcaggactag

SEQ ID NO: 23920 - DNA, 1188 bp, Artificial Sequence
  Description of Artificial Sequence: Synthetic coding sequence
atgacccacaccctgtaccccacccccttcgccctgtaccccatcaacatcagcgccgcctggcacctgggccccctgcccgtgagctgcttcgtgagcaacaagtaccagtgcagcctggccttcggcgccaccaccggcctgagagtgctggtggtggtggtgccccagacccagctgagcttcctgagcagcctgtgcctggtgagcctgttcctgcacagcctggtgagcgcccacggcgagaagcccaccaagcccgtgggcctggaccccaccctgttccaggtggtggtgggcatcctgggcaacttcagcctgctgtactactacatgttcctgtacttcagaggctacaagcccagaagcaccgacctgatcctgagacacctgaccgtggccgacagcctggtgatcctgagcaagagaatccccgagaccatggccaccttcggcctgaagcacttcgacaactacttcggctgcaagttcctgctgtacgcccacagagtgggcagaggcgtgagcatcggcagcacctgcctgctgagcgtgttccaggtgatcaccatcaaccccagaaacagcagatgggccgagatgaaggtgaaggcccccacctacatcggcctgagcaacatcctgtgctgggccttccacatgctggtgaacgccatcttccccatctacaccaccggcaagtggagcaacaacaacatcaccaagaagggcgacctgggctactgcagcgcccccctgagcgacgaggtgaccaagagcgtgtacgccgccctgaccagcttccacgacgtgctgtgcctgggcctgatgctgtgggccagcagcagcatcgtgctggtgctgtacagacacaagcagcaggtgcagcacatctgcagaaacaacctgtaccccaacagcagccccggcaacagagccatccagagcatcctggccctggtgagcaccttcgccctgtgctacgccctgagcttcatcacctacgtgtacctggccctgttcgacaacagcagctggtggctggtgaacaccgccgccctgatcatcgcctgcttccccaccatcagccccttcgtgctgatgtgcagagaccccagcagaagcagactgtgcagcatctgctgcagaagaaacagaagattcttccacgacttcagaaagatgtag

SEQ ID NO: 23921 - DNA, 8487 bp, Artificial Sequence
  Description of Artificial Sequence: Synthetic coding sequence
atgcccaagagagcccactggggcgccctgagcgtggtgctgatcctgctgtggggccaccccagagtggccctggcctgcccccacccctgcgcctgctacgtgcccagcgaggtgcactgcaccttcagaagcctggccagcgtgcccgccggcatcgccaagcacgtggagagaatcaacctgggcttcaacagcatccaggccctgagcgagaccagcttcgccggcctgaccaagctggagctgctgatgatccacggcaacgagatccccagcatccccgacggcgccctgagagacctgagcagcctgcaggtgttcaagttcagctacaacaagctgagagtgatcaccggccagaccctgcagggcctgagcaacctgatgagactgcacatcgaccacaacaagatcgagttcatccacccccaggccttcaacggcctgaccagcctgagactgctgcacctggagggcaacctgctgcaccagctgcaccccagcaccttcagcaccttcaccttcctggactacttcagactgagcaccatcagacacctgtacctggccgagaacatggtgagaaccctgcccgccagcatgctgagaaacatgcccctgctggagaacctgtacctgcagggcaacccctggacctgcgactgcgagatgagatggttcctggagtgggacgccaagagcagaggcatcctgaagtgcaagaaggacaaggcctacgagggcggccagctgtgcgccatgtgcttcagccccaagaagctgtacaagcacgagatccacaagctgaaggacatgacctgcctgaagcccagcatcgagagccccctgagacagaacagaagcagaagcatcgaggaggagcaggagcaggaggaggacggcggcagccagctgatcctggagaagttccagctgccccagtggagcatcagcctgaacatgaccgacgagcacggcaacatggtgaacctggtgtgcgacatcaagaagcccatggacgtgtacaagatccacctgaaccagaccgacccccccgacatcgacatcaacgccaccgtggccctggacttcgagtgccccatgaccagagagaactacgagaagctgtggaagctgatcgcctactacagcgaggtgcccgtgaagctgcacagagagctgatgctgagcaaggaccccagagtgagctaccagtacagacaggacgccgacgaggaggccctgtactacaccggcgtgagagcccagatcctggccgagcccgagtgggtgatgcagcccagcatcgacatccagctgaacagaagacagagcaccgccaagaaggtgctgctgagctactacacccagtacagccagaccatcagcaccaaggacaccagacaggccagaggcagaagctgggtgatgatcgagcccagcggcgccgtgcagagagaccagaccgtgctggagggcggcccctgccagctgagctgcaacgtgaaggccagcgagagccccagcatcttctgggtgctgcccgacggcagcatcctgaaggcccccatggacgaccccgacagcaagttcagcatcctgagcagcggctggctgagaatcaagagcatggagcccagcgacagcggcctgtaccagtgcatcgcccaggtgagagacgagatggacagaatggtgtacagagtgctggtgcagagccccagcacccagcccgccgagaaggacaccgtgaccatcggcaagaaccccggcgagagcgtgaccctgccctgcaacgccctggccatccccgaggcccacctgagctggatcctgcccaacagaagaatcatcaacgacctggccaacaccagccacgtgtacatgctgcccaacggcaccctgagcatccccaaggtgcaggtgagcgacagcggctactacagatgcgtggccgtgaaccagcagggcgccgaccacttcaccgtgggcatcaccgtgaccaagaagggcagcggcctgcccagcaagagaggcagaagacccggcgccaaggccctgagcagagtgagagaggacatcgtggaggacgagggcggcagcggcatgggcgacgaggagaacaccagcagaagactgctgcaccccaaggaccaggaggtgttcctgaagaccaaggacgacgccatcaacggcgacaagaaggccaagaagggcagaagaaagctgaagctgtggaagcacagcgagaaggagcccgagaccaacgtggccgagggcagaagagtgttcgagagcagaagaagaatcaacatggccaacaagcagatcaaccccgagagatgggccgacatcctggccaaggtgagaggcaagaacctgcccaagggcaccgaggtgccccccctgatcaagaccaccagcccccccagcctgagcctggaggtgaccccccccttccccgccatcagcccccccagcgccagccccgtgcagaccgtgaccagcgccgaggagagcagcgccgacgtgcccctgctgggcgaggaggagcacgtgctgggcaccatcagcagcgccagcatgggcctggagcacaaccacaacggcgtgatcctggtggagcccgaggtgaccagcacccccctggaggaggtggtggacgacctgagcgagaagaccgaggagatcaccagcaccgagggcgacctgaagggcaccgccgcccccaccctgatcagcgagccctacgagcccagccccaccctgcacaccctggacaccgtgtacgagaagcccacccacgaggagaccgccaccgagggctggagcgccgccgacgtgggcagcagccccgagcccaccagcagcgagtacgagccccccctggacgccgtgagcctggccgagagcgagcccatgcagtacttcgaccccgacctggagaccaagagccagcccgacgaggacaagatgaaggaggacaccttcgcccacctgacccccacccccaccatctgggtgaacgacagcagcaccagccagctgttcgaggacagcaccatcggcgagcccggcgtgcccggccagagccacctgcagggcctgaccgacaacatccacctggtgaagagcagcctgagcacccaggacaccctgctgatcaagaagggcatgaaggagatgagccagaccctgcagggcggcaacatgctggagggcgaccccacccacagcagaagcagcgagagcgagggccaggagagcaagagcatcaccctgcccgacagcaccctgggcatcatgagcagcatgagccccgtgaagaagcccgccgagaccaccgtgggcaccctgctggacaaggacaccaccaccgccaccaccacccccagacagaaggtggcccccagcagcaccatgagcacccaccccagcagaagaagacccaacggcagaagaagactgagacccaacaagttcagacacagacacaagcagaccccccccaccaccttcgcccccagcgagaccttcagcacccagcccacccaggcccccgacatcaagatcagcagccaggtggagagcagcctggtgcccaccgcctgggtggacaacaccgtgaacacccccaagcagctggagatggagaagaacgccgagcccaccagcaagggcacccccagaagaaagcacggcaagagacccaacaagcacagatacacccccagcaccgtgagcagcagagccagcggcagcaagcccagccccagccccgagaacaagcacagaaacatcgtgacccccagcagcgagaccatcctgctgcccagaaccgtgagcctgaagaccgagggcccctacgacagcctggactacatgaccaccaccagaaagatctacagcagctaccccaaggtgcaggagaccctgcccgtgacctacaagcccaccagcgacggcaaggagatcaaggacgacgtggccaccaacgtggacaagcacaagagcgacatcctggtgaccggcgagagcatcaccaacgccatccccaccagcagaagcctggtgagcaccatgggcgagttcaaggaggagagcagccccgtgggcttccccggcacccccacctggaaccccagcagaaccgcccagcccggcagactgcagaccggcatccccgtgaccaccagcggcgagaacctgaccgacccccccctgctgaaggagctggaggacgtggacttcaccagcgagttcctgagcagcctgaccgtgagcacccccttccaccaggaggaggccggcagcagcaccaccctgagcagcatcaaggtggaggtggccagcagccaggccgagaccaccaccctggaccaggaccacctggagaccaccgtggccatcctgctgagcgagaccagaccccagaaccacacccccaccgccgccagaatgaaggagcccgccagcagcagccccagcaccatcctgatgagcctgggccagaccaccaccaccaagcccgccctgcccagccccagaatcagccaggccagcagagacagcaaggagaacgtgttcctgaactacgtgggcaaccccgagaccgaggccacccccgtgaacaacgagggcacccagcacatgagcggccccaacgagctgagcacccccagcagcgaccaggacgccttcaacctgagcaccaagctggagctggagaagcaggtgttcggcagcagaagcctgcccagaggccccgacagccagagacaggacggcagagtgcacgccagccaccagctgaccagagtgcccgccaagcccatcctgcccaccgccaccgtgagactgcccgagatgagcacccagagcgccagcagatacttcgtgaccagccagagccccagacactggaccaacaagcccgagatcaccacctaccccagcggcgccctgcccgagaacaagcagttcaccacccccagactgagcagcaccaccatccccctgcccctgcacatgagcaagcccagcatccccagcaagttcaccgacagaagaaccgaccagttcaacggctacagcaaggtgttcggcaacaacaacatccccgaggccagaaaccccgtgggcaagccccccagccccagaatcccccactacagcaacggcagactgcccttcttcaccaacaagaccctgagcttcccccagctgggcgtgaccagaagaccccagatccccaccagccccgcccccgtgatgagagagagaaaggtgatccccggcagctacaacagaatccacagccacagcaccttccacctggacttcggcccccccgccccccccctgctgcacaccccccagaccaccggcagccccagcaccaacctgcagaacatccccatggtgagcagcacccagagcagcatcagcttcatcaccagcagcgtgcagagcagcggcagcttccaccagagcagcagcaagttcttcgccggcggcccccccgccagcaagttctggagcctgggcgagaagccccagatcctgaccaagagcccccagaccgtgagcgtgaccgccgagaccgacaccgtgttcccctgcgaggccaccggcaagcccaagcccttcgtgacctggaccaaggtgagcaccggcgccctgatgacccccaacaccagaatccagagattcgaggtgctgaagaacggcaccctggtgatcagaaaggtgcaggtgcaggacagaggccagtacatgtgcaccgccagcaacctgcacggcctggacagaatggtggtgctgctgagcgtgaccgtgcagcagccccagatcctggccagccactaccaggacgtgaccgtgtacctgggcgacaccatcgccatggagtgcctggccaagggcacccccgccccccagatcagctggatcttccccgacagaagagtgtggcagaccgtgagccccgtggagggcagaatcaccctgcacgagaacagaaccctgagcatcaaggaggccagcttcagcgacagaggcgtgtacaagtgcgtggccagcaacgccgccggcgccgacagcctggccatcagactgcacgtggccgccctgccccccgtgatccaccaggagaagctggagaacatcagcctgccccccggcctgagcatccacatccactgcaccgccaaggccgcccccctgcccagcgtgagatgggtgctgggcgacggcacccagatcagacccagccagttcctgcacggcaacctgttcgtgttccccaacggcaccctgtacatcagaaacctggcccccaaggacagcggcagatacgagtgcgtggccgccaacctggtgggcagcgccagaagaaccgtgcagctgaacgtgcagagagccgccgccaacgccagaatcaccggcaccagccccagaagaaccgacgtgagatacggcggcaccctgaagctggactgcagcgccagcggcgacccctggcccagaatcctgtggagactgcccagcaagagaatgatcgacgccctgttcagcttcgacagcagaatcaaggtgttcgccaacggcaccctggtggtgaagagcgtgaccgacaaggacgccggcgactacctgtgcgtggccagaaacaaggtgggcgacgactacgtggtgctgaaggtggacgtggtgatgaagcccgccaagatcgagcacaaggaggagaacgaccacaaggtgttctacggcggcgacctgaaggtggactgcgtggccaccggcctgcccaaccccgagatcagctggagcctgcccgacggcagcctggtgaacagcttcatgcagagcgacgacagcggcggcagaaccaagagatacgtggtgttcaacaacggcaccctgtacttcaacgaggtgggcatgagagaggagggcgactacacctgcttcgccgagaaccaggtgggcaaggacgagatgagagtgagagtgaaggtggtgaccgcccccgccaccatcagaaacaagacctacctggccgtgcaggtgccctacggcgacgtggtgaccgtggcctgcgaggccaagggcgagcccatgcccaaggtgacctggctgagccccaccaacaaggtgatccccaccagcagcgagaagtaccagatctaccaggacggcaccctgctgatccagaaggcccagagaagcgacagcggcaactacacctgcctggtgagaaacagcgccggcgaggacagaaagaccgtgtggatccacgtgaacgtgcagccccccaagatcaacggcaaccccaaccccatcaccaccgtgagagagatcgccgccggcggcagcagaaagctgatcgactgcaaggccgagggcatccccacccccagagtgctgtgggccttccccgagggcgtggtgctgcccgccccctactacggcaacagaatcaccgtgcacggcaacggcagcctggacatcagaagcctgagaaagagcgacagcgtgcagctggtgtgcatggccagaaacgagggcggcgaggccagactgatcctgcagctgaccgtgctggagcccatggagaagcccatcttccacgaccccatcagcgagaagatcaccgccatggccggccacaccatcagcctgaactgcagcgccgccggcacccccacccccagcctggtgtgggtgctgcccaacggcaccgacctgcagagcggccagcagctgcagagattctaccacaaggccgacggcatgctgcacatcagcggcctgagcagcgtggacgccggcgcctacagatgcgtggccagaaacgccgccggccacaccgagagactggtgagcctgaaggtgggcctgaagcccgaggccaacaagcagtaccacaacctggtgagcatcatcaacggcgagaccctgaagctgccctgcaccccccccggcgccggccagggcagattcagctggaccctgcccaacggcatgcacctggagggcccccagaccctgggcagagtgagcctgctggacaacggcaccctgaccgtgagagaggccagcgtgttcgacagaggcacctacgtgtgcagaatggagaccgagtacggccccagcgtgaccagcatccccgtgatcgtgatcgcctacccccccagaatcaccagcgagcccacccccgtgatctacaccagacccggcaacaccgtgaagctgaactgcatggccatgggcatccccaaggccgacatcacctgggagctgcccgacaagagccacctgaaggccggcgtgcaggccagactgtacggcaacagattcctgcacccccagggcagcctgaccatccagcacgccacccagagagacgccggcttctacaagtgcatggccaagaacatcctgggcagcgacagcaagaccacctacatccacgtgttctag

SEQ ID NO: 23922 - DNA, 1272 bp, Artificial Sequence
  Description of Artificial Sequence: Synthetic coding sequence
atggtgttcgccttctggaaggtgttcctgatcctgagctgcctggccggccaggtgagcgtggtgcaggtgaccatccccgacggcttcgtgaacgtgaccgtgggcagcaacgtgaccctgatctgcatctacaccaccaccgtggccagcagagagcagctgagcatccagtggagcttcttccacaagaaggagatggagcccatcagccacagcagctgcctgagcaccgagggcatggaggagaaggccgtgagccagtgcctgaagatgacccacgccagagacgccagaggcagatgcagctggaccagcgagatctacttcagccagggcggccaggccgtggccatcggccagttcaaggacagaatcaccggcagcaacgaccccggcaacgccagcatcaccatcagccacatgcagcccgccgacagcggcatctacatctgcgacgtgaacaacccccccgacttcctgggccagaaccagggcatcctgaacgtgagcgtgctggtgaagcccagcaagcccctgtgcagcgtgcagggcagacccgagaccggccacaccatcagcctgagctgcctgagcgccctgggcacccccagccccgtgtactactggcacaagctggagggcagagacatcgtgcccgtgaaggagaacttcaaccccaccaccggcatcctggtgatcggcaacctgaccaacttcgagcagggctactaccagtgcaccgccatcaacagactgggcaacagcagctgcgagatcgacctgaccagcagccaccccgaggtgggcatcatcgtgggcgccctgatcggcagcctggtgggcgccgccatcatcatcagcgtggtgtgcttcgccagaaacaaggccaaggccaaggccaaggagagaaacagcaagaccatcgccgagctggagcccatgaccaagatcaaccccagaggcgagagcgaggccatgcccagagaggacgccacccagctggaggtgaccctgcccagcagcatccacgagaccggccccgacaccatccaggagcccgactacgagcccaagcccacccaggagcccgcccccgagcccgcccccggcagcgagcccatggccgtgcccgacctggacatcgagctggagctggagcccgagacccagagcgagctggagcccgagcccgagcccgagcccgagagcgagcccggcgtggtggtggagcccctgagcgaggacgagaagggcgtggtgaaggcctag

SEQ ID NO: 23923 - DNA, 1623 bp, Artificial Sequence
  Description of Artificial Sequence: Synthetic coding sequence
atggccgccggcggcagcgcccccgagcccagagtgctggtgtgcctgggcgccctgctggccggctgggtggccgtgggcctggaggccgtggtgatcggcgaggtgcacgagaacgtgaccctgcactgcggcaacatcagcggcctgagaggccaggtgacctggtacagaaacaacagcgagcccgtgttcctgctgagcagcaacagcagcctgagacccgccgagcccagattcagcctggtggacgccaccagcctgcacatcgagagcctgagcctgggcgacgagggcatctacacctgccaggagatcctgaacgtgacccagtggttccaggtgtggctgcaggtggccagcggcccctaccagatcgaggtgcacatcgtggccaccggcaccctgcccaacggcaccctgtacgccgccagaggcagccaggtggacttcagctgcaacagcagcagcagacccccccccgtggtggagtggtggttccaggccctgaacagcagcagcgagagcttcggccacaacctgaccgtgaacttcttcagcctgctgctgatcagccccaacctgcagggcaactacacctgcctggccctgaaccagctgagcaagagacacagaaaggtgaccaccgagctgctggtgtactaccccccccccagcgccccccagtgctgggcccagatggccagcggcagcttcatgctgcagctgacctgcagatgggacggcggctaccccgaccccgacttcctgtggatcgaggagcccggcggcgtgatcgtgggcaagagcaagctgggcgtggagatgctgagcgagagccagctgagcgacggcaagaagttcaagtgcgtgaccagccacatcgtgggccccgagagcggcgccagctgcatggtgcagatcagaggccccagcctgctgagcgagcccatgaagacctgcttcaccggcggcaacgtgaccctgacctgccaggtgagcggcgcctacccccccgccaagatcctgtggctgagaaacctgacccagcccgaggtgatcatccagcccagcagcagacacctgatcacccaggacggccagaacagcaccctgaccatccacaactgcagccaggacctggacgagggctactacatctgcagagccgacagccccgtgggcgtgagagagatggagatctggctgagcgtgaaggagcccctgaacatcggcggcatcgtgggcaccatcgtgagcctgctgctgctgggcctggccatcatcagcggcctgctgctgcactacagccccgtgttctgctggaaggtgggcaacaccagcagaggccagaacatggacgacgtgatggtgctggtggacagcgaggaggaggaggaggaggaggaggaggaggaggaggacgccgccgtgggcgagcaggagggcgccagagagagagaggagctgcccaaggagatccccaagcaggaccacatccacagagtgaccgccctggtgaacggcaacatcgagcagatgggcaacggcttccaggacctgcaggacgacagcagcgaggagcagagcgacatcgtgcaggaggaggacagacccgtgtag

SEQ ID NO: 23924 - DNA, 2604 bp, Artificial Sequence
  Description of Artificial Sequence: Synthetic coding sequence
atggacaacccccaggccctgcccctgttcctgctgctggccagcctggtgggcatcctgaccctgagagccagcagcggcctgcagcagaccaacttcagcagcgccttcagcagcgacagcaagagcagcagccagggcctgggcgtggaggtgcccagcatcaagccccccagctggaaggtgcccgaccagttcctggacagcaaggccagcgccggcatcagcgacagcagctggttccccgaggccctgagcagcaacatgagcggcagcttctggagcaacgtgagcgccgagggccaggacctgagccccgtgagccccttcagcgagacccccggcagcgaggtgttccccgacatcagcgacccccaggtgcccgccaaggaccccaagcccagcttcaccgtgaagacccccgccagcaacatcagcacccaggtgagccacaccaagctgagcgtggaggcccccgacagcaagttcagccccgacgacatggacctgaagctgagcgcccagagccccgagagcaagttcagcgccgagacccacagcgccgccagcttcccccagcaggtgggcggccccctggccgtgctggtgggcaccaccatcagactgcccctggtgcccatccccaaccccggcccccccaccagcctggtggtgtggagaagaggcagcaaggtgctggccgccggcggcctgggccccggcgcccccctgatcagcctggaccccgcccacagagaccacctgagattcgaccaggccagaggcgtgctggagctggccagcgcccagctggacgacgccggcgtgtacaccgccgaggtgatcagagccggcgtgagccagcagacccacgagttcaccgtgggcgtgtacgagcccctgccccagctgagcgtgcagcccaaggcccccgagaccgaggagggcgccgccgagctgagactgagatgcctgggctggggccccggcagaggcgagctgagctggagcagagacggcagagccctggaggccgccgagagcgagggcgccgagacccccagaatgagaagcgagggcgaccagctgctgatcgtgagacccgtgagaagcgaccacgccagatacacctgcagagtgagaagccccttcggccacagagaggccgccgccgacgtgagcgtgttctacggccccgacccccccaccatcaccgtgagcagcgacagagacgccgcccccgccagattcgtgaccgccggcagcaacgtgaccctgagatgcgccgccgccagcagaccccccgccgacatcacctggagcctggccgaccccgccgaggccgccgtgcccgccggcagcagactgctgctgcccgccgtgggccccggccacgccggcacctacgcctgcctggccgccaaccccagaaccggcagaagaagaagaagcctgctgaacctgaccgtggccgacctgccccccggcgccccccagtgcagcgtggagggcggccccggcgacagaagcctgagattcagatgcagctggcccggcggcgcccccgccgccagcctgcagttccagggcctgcccgagggcatcagagccggccccgtgagcagcgtgctgctggccgccgtgcccgcccaccccagactgagcggcgtgcccatcacctgcctggccagacacctggtggccaccagaacctgcaccgtgacccccgaggcccccagagaggtgctgctgcaccccctggtggccgagaccagactgggcgaggccgaggtggccctggaggccagcggctgccccccccccagcagagccagctgggccagagagggcagacccctggcccccggcggcggcagcagactgagactgagccaggacggcagaaagctgcacatcggcaacttcagcctggactgggacctgggcaactacagcgtgctgtgcagcggcgccctgggcgccggcggcgaccagatcaccctgatcggccccagcatcagcagctggagactgcagagagccagagacgccgccgtgctgacctgggacgtggagagaggcgccctgatcagcagcttcgagatccaggcctggcccgacggccccgccctgggcagaaccagcacctacagagactgggtgagcctgctgatcctgggcccccaggagagaagcgccgtggtgcccctgccccccagaaaccccggcacctggaccttcagaatcctgcccatcctgggcggccagcccggcacccccagccagagcagagtgtacagagccggccccaccctgagccacggcgccatcgccggcatcgtgctgggcagcctgctgggcctggccctgctggccgtgctgctgctgctgtgcatctgctgcctgtgcagattcagaggcaagacccccgagaagaagaagcaccccagcaccctggtgcccgtggtgacccccagcgagaagaagatgcacagcgtgacccccgtggagatcagctggcccctggacctgaaggtgcccctggaggaccacagcagcaccagagcctaccaggcccagacccccgtgcagctgagcctgtag

SEQ ID NO: 23925 - DNA, 147 bp, Artificial Sequence
  Description of Artificial Sequence: Synthetic coding sequence
atggacaacccccaggccctgcccctgttcctgctgctggccagcctggtgggcatcctgaccctgagagccagcagcggcctgcagcagaccaacttcagcagcgccctgcacagagccttctgggccagaaccagctacttctag

SEQ ID NO: 23926 - DNA, 1200 bp, Artificial Sequence
  Description of Artificial Sequence: Synthetic coding sequence
atgggcatcctgctgggcctgctgctgctgggccacctgaccgtggacacctacggcagacccatcctggaggtgcccgagagcgtgaccggcccctggaagggcgacgtgaacctgccctgcacctacgaccccctgcagggctacacccaggtgctggtgaagtggctggtgcagagaggcagcgaccccgtgaccatcttcctgagagacagcagcggcgaccacatccagcaggccaagtaccagggcagactgcacgtgagccacaaggtgcccggcgacgtgagcctgcagctgagcaccctggagatggacgacagaagccactacacctgcgaggtgacctggcagacccccgacggcaaccaggtggtgagagacaagatcaccgagctgagagtgcagaagctgagcgtgagcaagcccaccgtgaccaccggcagcggctacggcttcaccgtgccccagggcatgagaatcagcctgcagtgccaggccagaggcagcccccccatcagctacatctggtacaagcagcagaccaacaaccaggagcccatcaaggtggccaccctgagcaccctgctgttcaagcccgccgtgatcgccgacagcggcagctacttctgcaccgccaagggccaggtgggcagcgagcagcacagcgacatcgtgaagttcgtggtgaaggacagcagcaagctgctgaagaccaagaccgaggcccccaccaccatgacctaccccctgaaggccaccagcaccgtgaagcagagctgggactggaccaccgacatggacggctacctgggcgagaccagcgccggccccggcaagagcctgcccgtgttcgccatcatcctgatcatcagcctgtgctgcatggtggtgttcaccatggcctacatcatgctgtgcagaaagaccagccagcaggagcacgtgtacgaggccgccagagcccacgccagagaggccaacgacagcggcgagaccatgagagtggccatcttcgccagcggctgcagcagcgacgagcccaccagccagaacctgggcaacaactacagcgacgagccctgcatcggccaggagtaccagatcatcgcccagatcaacggcaactacgccagactgctggacaccgtgcccctggactacgagttcctggccaccgagggcaagagcgtgtgctag

SEQ ID NO: 23927 - DNA, 918 bp, Artificial Sequence
  Description of Artificial Sequence: Synthetic coding sequence
atgggcatcctgctgggcctgctgctgctgggccacctgaccgtggacacctacggcagacccatcctggaggtgcccgagagcgtgaccggcccctggaagggcgacgtgaacctgccctgcacctacgaccccctgcagggctacacccaggtgctggtgaagtggctggtgcagagaggcagcgaccccgtgaccatcttcctgagagacagcagcggcgaccacatccagcaggccaagtaccagggcagactgcacgtgagccacaaggtgcccggcgacgtgagcctgcagctgagcaccctggagatggacgacagaagccactacacctgcgaggtgacctggcagacccccgacggcaaccaggtggtgagagacaagatcaccgagctgagagtgcagaagcacagcagcaagctgctgaagaccaagaccgaggcccccaccaccatgacctaccccctgaaggccaccagcaccgtgaagcagagctgggactggaccaccgacatggacggctacctgggcgagaccagcgccggccccggcaagagcctgcccgtgttcgccatcatcctgatcatcagcctgtgctgcatggtggtgttcaccatggcctacatcatgctgtgcagaaagaccagccagcaggagcacgtgtacgaggccgccagagcccacgccagagaggccaacgacagcggcgagaccatgagagtggccatcttcgccagcggctgcagcagcgacgagcccaccagccagaacctgggcaacaactacagcgacgagccctgcatcggccaggagtaccagatcatcgcccagatcaacggcaactacgccagactgctggacaccgtgcccctggactacgagttcctggccaccgagggcaagagcgtgtgctag

SEQ ID NO: 23928 - DNA, 606 bp, Artificial Sequence
  Description of Artificial Sequence: Synthetic coding sequence
atgggcatcctgctgggcctgctgctgctgggccacctgaccgtggacacctacggcagacccatcctggaggtgcccgagagcgtgaccggcccctggaagggcgacgtgaacctgccctgcacctacgaccccctgcagggctacacccaggtgctggtgaagtggctggtgcagagaggcagcgaccccgtgaccaccgtgaccaccggcagcggctacggcttcaccgtgccccagggcatgagaatcagcctgcagtgccaggccagaggcagcccccccatcagctacatctggtacaagcagcagaccaacaaccaggagcccatcaaggtggccaccctgagcaccctgctgttcaagcccgccgtgatcgccgacagcggcagctacttctgcaccgccaagggccaggtgggcagcgagcagcacagcgacatcgtgaagttcgtggtgaaggacagcagcaagctgctgaagaccaagaccgaggcccccaccaccatgacctaccccctgaaggccaccagcaccgtgaagcagagctgggactggaccaccgacatggacggctacctgggcgagaccagcgccggcccctag

SEQ ID NO: 23929 - DNA, 825 bp, Artificial Sequence
  Description of Artificial Sequence: Synthetic coding sequence
tgagaccacatccagcaggccaagtaccagggcagactgcacgtgagccacaaggtgcccggcgacgtgagcctgcagctgagcaccctggagatggacgacagaagccactacacctgcgaggtgacctggcagacccccgacggcaaccaggtggtgagagacaagatcaccgagctgagagtgcagaagctgagcgtgagcaagcccaccgtgaccaccggcagcggctacggcttcaccgtgccccagggcatgagaatcagcctgcagtgccaggccagaggcagcccccccatcagctacatctggtacaagcagcagaccaacaaccaggagcccatcaaggtggccaccctgagcaccctgctgttcaagcccgccgtgatcgccgacagcggcagctacttctgcaccgccaagggccaggtgggcagcgagcagcacagcgacatcgtgaagttcgtggtgaaggacagcagcaagctgctgaagaccaagaccgaggcccccaccaccatgacctaccccctgaaggccaccagcaccgtgaagcagagctgggactggaccaccgacatggacggctacctgggcgagaccagcgccggccccggcaagagcctgcccgtgttcgccatcatcctgatcatcagcctgtgctgcatggtggtgttcaccatggcctacatcatgctgtgcagaaagaccagccagcaggagcacgtgtacgaggccgccagccccaagtgcccccccaccaacaccggcgccgccggcagccactggctgtgccccggcatctgccagatgcacctgaagtag

SEQ ID NO: 23930 - DNA, 966 bp, Artificial Sequence
  Description of Artificial Sequence: Synthetic coding sequence
atgggcatcctgctgggcctgctgctgctgggccacctgaccgtggacacctacggcagacccatcctggaggtgcccgagagcgtgaccggcccctggaagggcgacgtgaacctgccctgcacctacgaccccctgcagggctacacccaggtgctggtgaagtggctggtgcagagaggcagcgaccccgtgaccatcttcctgagagacagcagcggcgaccacatccagcaggccaagtaccagggcagactgcacgtgagccacaaggtgcccggcgacgtgagcctgcagctgagcaccctggagatggacgacagaagccactacacctgcgaggtgacctggcagacccccgacggcaaccaggtggtgagagacaagatcaccgagctgagagtgcagaagctgagcgtgagcaagcccaccgtgaccaccggcagcggctacggcttcaccgtgccccagggcatgagaatcagcctgcagtgccaggccagaggcagcccccccatcagctacatctggtacaagcagcagaccaacaaccaggagcccatcaaggtggccaccctgagcaccctgctgttcaagcccgccgtgatcgccgacagcggcagctacttctgcaccgccaagggccaggtgggcagcgagcagcacagcgacatcgtgaagttcgtggtgaaggacagcagcaagctgctgaagaccaagaccgaggcccccaccaccatgacctaccccctgaaggccaccagcaccgtgaagcagagctgggactggaccaccgacatggacggctacctgggcgagaccagcgccggccccggcaagagcctgcccgtgttcgccatcatcctgatcatcagcctgtgctgcatggtggtgttcaccatggcctacatcatgctgtgcagaaagaccagccagcaggagcacgtgtacgaggccgccagatag

SEQ ID NO: 23931 - DNA, 1245 bp, Artificial Sequence
  Description of Artificial Sequence: Synthetic coding sequence
atgagagtgggcggcgccttccacctgctgctggtgtgcctgagccccgccctgctgagcgccgtgagaatcaacggcgacggccaggaggtgctgtacctggccgagggcgacaacgtgagactgggctgcccctacgtgctggaccccgaggactacggccccaacggcctggacatcgagtggatgcaggtgaacagcgaccccgcccaccacagagagaacgtgttcctgagctaccaggacaagagaatcaaccacggcagcctgccccacctgcagcagagagtgagattcgccgccagcgaccccagccagtacgacgccagcatcaacctgatgaacctgcaggtgagcgacaccgccacctacgagtgcagagtgaagaagaccaccatggccaccagaaaggtgatcgtgaccgtgcaggccagacccgccgtgcccatgtgctggaccgagggccacatgacctacggcaacgacgtggtgctgaagtgctacgccagcggcggcagccagcccctgagctacaagtgggccaagatcagcggccaccactacccctacagagccggcagctacaccagccagcacagctaccacagcgagctgagctaccaggagagcttccacagcagcatcaaccagggcctgaacaacggcgacctggtgctgaaggacatcagcagagccgacgacggcctgtaccagtgcaccgtggccaacaacgtgggctacagcgtgtgcgtggtggaggtgaaggtgagcgacagcagaagaatcggcgtgatcatcggcatcgtgctgggcagcctgctggccctgggctgcctggccgtgggcatctggggcctggtgtgctgctgctgcggcggcagcggcgccggcggcgccagaggcgccttcggctacggcaacggcggcggcgtgggcggcggcgcctgcggcgacctggccagcgagatcagagaggacgccgtggcccccggctgcaaggccagcggcagaggcagcagagtgacccacctgctgggctaccccacccagaacgtgagcagaagcctgagaagaaagtacgccccccccccctgcggcggccccgaggacgtggccctggccccctgcaccgccgccgccgcctgcgaggccggccccagccccgtgtacgtgaaggtgaagagcgccgagcccgccgactgcgccgagggccccgtgcagtgcaagaacggcctgctggtgtag

SEQ ID NO: 23932 - DNA, 576 bp, Artificial Sequence
  Description of Artificial Sequence: Synthetic coding sequence
atgagactgctggccctggccgccgccgccctgctggccagagcccccgcccccgaggtgtgcgccgccctgaacgtgaccgtgagccccggccccgtggtggactacctggagggcgagaacgccaccctgctgtgccacgtgagccagaagagaagaaaggacagcctgctggccgtgagatggttcttcgcccacagcttcgacagccaggaggccctgatggtgaagatgaccaagctgagagtggtgcagtactacggcaacttcagcagaagcgccaagagaagaagactgagactgctggaggagcagagaggcgccctgtacagactgagcgtgctgaccctgcagcccagcgaccagggccactacgtgtgcagagtgcaggagatcagcagacacagaaacaagtggaccgcctggagcaacggcagcagcgccaccgagatgagaggcgtgagcagccaccccgtggagagaggcgccttcctgggcatcagcctggtgatcctgccccacagcctgcccttcaccgccgacctgaccatggccagcttcctgcagagcagctag

SEQ ID NO: 23933 - DNA, 963 bp, Artificial Sequence
  Description of Artificial Sequence: Synthetic coding sequence
atgagactgctggccctggccgccgccgccctgctggccagagcccccgcccccgaggtgtgcgccgccctgaacgtgaccgtgagccccggccccgtggtggactacctggagggcgagaacgccaccctgctgtgccacgtgagccagaagagaagaaaggacagcctgctggccgtgagatggttcttcgcccacagcttcgacagccaggaggccctgatggtgaagatgaccaagctgagagtggtgcagtactacggcaacttcagcagaagcgccaagagaagaagactgagactgctggaggagcagagaggcgccctgtacagactgagcgtgctgaccctgcagcccagcgaccagggccactacgtgtgcagagtgcaggagatcagcagacacagaaacaagtggaccgcctggagcaacggcagcagcgccaccgagatgagagtgatcagcctgaaggccagcgaggagagcagcttcgagaagaccaaggagacctgggccttcttcgaggacctgtacgtgtacgccgtgctggtgtgctgcgtgggcatcctgagcatcctgctgttcatgctggtgatcgtgtggcagagcgtgttcaacaagagaaagagcagagtgagacactacctggtgaagtgcccccagaacagcagcggcgagaccgtgaccagcgtgaccagcctggcccccctgcagcccaagaagggcaagagacagaaggagaagcccgacatcccccccgccgtgcccgccaaggcccccatcgcccccaccttccacaagcccaagctgctgaagccccagagaaaggtgaccctgcccaagatcgccgaggagaacctgacctacgccgagctggagctgatcaagccccacagagccgccaagggcgcccccaccagcaccgtgtacgcccagatcctgttcgaggagaacaagctgtag

SEQ ID NO: 23934 - DNA, 603 bp, Artificial Sequence
  Description of Artificial Sequence: Synthetic coding sequence
atgagacccctgcccagcggcagaagaaagaccagaggcatcagcctgggcctgttcgccctgtgcctggccgccgccagatgcctgcagagccagggcgtgagcctgtacatcccccaggccaccatcaacgccaccgtgaaggaggacatcctgctgagcgtggagtacagctgccacggcgtgcccaccatcgagtggacctacagcagcaactggggcacccagaagatcgtggagtggaagcccggcacccaggccaacatcagccagagccacaaggacagagtgtgcaccttcgacaacggcagcatccagctgttcagcgtgggcgtgagagacagcggctactacgtgatcaccgtgaccgagagactgggcagcagccagttcggcaccatcgtgctgcacgtgagcgagatcctgtacgaggacctgcacttcgtggccgtgatcctggccttcctggccgccgtggccgccgtgctgatcagcctgatgtgggtgtgcaacaagtgcgcctacaagttccagagaaagagaagacacaagctgaaggagagcaccaccgaggagatcgagctggaggacgtggagtgctag

SEQ ID NO: 23935 - DNA, 501 bp, Artificial Sequence
  Description of Artificial Sequence: Synthetic coding sequence
atggccagcctgggccagatcctgttctggagcatcatcagcatcatcatcatcctggccggcgccatcgccctgatcatcggcttcggcatcagcgccttcagcatgcccgaggtgaacgtggactacaacgccagcagcgagaccctgagatgcgaggcccccagatggttcccccagcccaccgtggtgtgggccagccaggtggaccagggcgccaacttcagcgaggtgagcaacaccagcttcgagctgaacagcgagaacgtgaccatgaaggtggtgagcgtgctgtacaacgtgaccatcaacaacacctacagctgcatgatcgagaacgacatcgccaaggccaccggcgacatcaaggtgaccgagagcgagatcaagagaagaagccacctgcagctgctgaacagcaaggccagcctgtgcgtgagcagcttcttcgccatcagctgggccctgctgcccctgagcccctacctgatgctgaagtag

SEQ ID NO: 23936 - DNA, 858 bp, Artificial Sequence
  Description of Artificial Sequence: Synthetic coding sequence
atggtgctgctgaccagcagaatgaagcccctgaccagcagaatcatcagcatcatcatcatcctggccggcgccatcgccctgatcatcggcttcggcatcagcggcagacacagcatcaccgtgaccaccgtggccagcgccggcaacatcggcgaggacggcatcctgagctgcaccttcgagcccgacatcaagctgagcgacatcgtgatccagtggctgaaggagggcgtgctgggcctggtgcacgagttcaaggagggcaaggacgagctgagcgagcaggacgagatgttcagaggcagaaccgccgtgttcgccgaccaggtgatcgtgggcaacgccagcctgagactgaagaacgtgcagctgaccgacgccggcacctacaagtgctacatcatcaccagcaagggcaagggcaacgccaacctggagtacaagaccggcgccttcagcatgcccgaggtgaacgtggactacaacgccagcagcgagaccctgagatgcgaggcccccagatggttcccccagcccaccgtggtgtgggccagccaggtggaccagggcgccaacttcagcgaggtgagcaacaccagcttcgagctgaacagcgagaacgtgaccatgaaggtggtgagcgtgctgtacaacgtgaccatcaacaacacctacagctgcatgatcgagaacgacatcgccaaggccaccggcgacatcaaggtgaccgagagcgagatcaagagaagaagccacctgcagctgctgaacagcaaggccagcctgtgcgtgagcagcttcttcgccatcagctgggccctgctgcccctgagcccctacctgatgctgaagtag

SEQ ID NO: 23937 - DNA, 258 bp, Artificial Sequence
  Description of Artificial Sequence: Synthetic coding sequence
gccaccctgagaaacaagctgatgtggaacatcatcagcatcatcatcatcctggccggcgccatcgccctgatcatcggcttcggcatcagcgaggtgagcgtgtggctgagcgccatgaagggctgcagaagcagcaaggccagcctgagcatcgacctgtgcttcctgaactgcagagagaccctgcaccacagccactactgcagactgagctgggagcactggggcggctggaaccccgagctgcacttctag

SEQ ID NO: 23938 - DNA, 849 bp, Artificial Sequence
  Description of Artificial Sequence: Synthetic coding sequence
atggccagcctgggccagatcctgttctggagcatcatcagcatcatcatcatcctggccggcgccatcgccctgatcatcggcttcggcatcagcggcagacacagcatcaccgtgaccaccgtggccagcgccggcaacatcggcgaggacggcatcctgagctgcaccttcgagcccgacatcaagctgagcgacatcgtgatccagtggctgaaggagggcgtgctgggcctggtgcacgagttcaaggagggcaaggacgagctgagcgagcaggacgagatgttcagaggcagaaccgccgtgttcgccgaccaggtgatcgtgggcaacgccagcctgagactgaagaacgtgcagctgaccgacgccggcacctacaagtgctacatcatcaccagcaagggcaagggcaacgccaacctggagtacaagaccggcgccttcagcatgcccgaggtgaacgtggactacaacgccagcagcgagaccctgagatgcgaggcccccagatggttcccccagcccaccgtggtgtgggccagccaggtggaccagggcgccaacttcagcgaggtgagcaacaccagcttcgagctgaacagcgagaacgtgaccatgaaggtggtgagcgtgctgtacaacgtgaccatcaacaacacctacagctgcatgatcgagaacgacatcgccaaggccaccggcgacatcaaggtgaccgagagcgagatcaagagaagaagccacctgcagctgctgaacagcaaggccagcctgtgcgtgagcagcttcttcgccatcagctgggccctgctgcccctgagcccctacctgatgctgaagtag

SEQ ID NO: 23939 - DNA, 564 bp, Artificial Sequence
  Description of Artificial Sequence: Synthetic coding sequence
atgttcagaggcagaaccgccgtgttcgccgaccaggtgatcgtgggcaacgccagcctgagactgaagaacgtgcagctgaccgacgccggcacctacaagtgctacatcatcaccagcaagggcaagggcaacgccaacctggagtacaagaccggcgccttcagcatgcccgaggtgaacgtggactacaacgccagcagcgagaccctgagatgcgaggcccccagatggttcccccagcccaccgtggtgtgggccagccaggtggaccagggcgccaacttcagcgaggtgagcaacaccagcttcgagctgaacagcgagaacgtgaccatgaaggtggtgagcgtgctgtacaacgtgaccatcaacaacacctacagctgcatgatcgagaacgacatcgccaaggccaccggcgacatcaaggtgaccgagagcgagatcaagagaagaagccacctgcagctgctgaacagcaaggccagcctgtgcgtgagcagcttcttcgccatcagctgggccctgctgcccctgagcccctacctgatgctgaagtag

SEQ ID NO: 23940 - DNA, 1434 bp, Artificial Sequence
  Description of Artificial Sequence: Synthetic coding sequence
atgagcggcgtgatgtgcctgaaggccagcgacacctgggccagcggcatcagaagccagccccagggctgcctgggcaagtggagaagcatgagatgcaagcacaccagaatgcacctggcccacctgggcaacagcagacagctgatcagcctgggcccccccagaaccagagaggacggcagcagaatcagccagcaggtggagcagagcagaagccaggtgcaggccatcggcgagaaggtgagcctggcccaggccaagatcgagaagatcaagggcagcaagaaggccatcaaggtgttcagcagcgccaagtaccccgcccccgagagactgcaggagtacggcagcatcttcaccgacgcccaggaccccggcctgcagagaagacccagacacagaatccagagcaagcagagacccctggacgagagagccctgcaggagaagctgaaggacttccccgtgtgcgtgagcaccaagcccgagcccgaggacgacgccgaggagggcctgggcggcctgcccagcaacatcagcagcgtgagcagcctgctgctgttcaacaccaccgagaacctgtacaagaagtacgtgttcctggaccccctggccggcgccgtgaccaagacccacgtgatgctgggcgccgagaccgaggagaagctgttcgacgcccccctgagcatcagcaagagagagcagctggagcagcaggtgcccgagaactacttctacgtgcccgacctgggccaggtgcccgagatcgacgtgcccagctacctgcccgacctgcccggcatcgccaacgacctgatgtacatcgccgacctgggccccggcatcgcccccagcgcccccggcaccatccccgagctgcccaccttccacaccgaggtggccgagcccctgaaggtggacctgcaggacggcgtgctgaccccccccccccccccccccccccccccccccgcccccgaggtgctggccagcgccccccccctgccccccagcaccgccgcccccgtgggccagggcgccagacaggacgacagcagcagcagcgccagccccagcgtgcagggcgcccccagagaggtggtggaccccagcggcggctgggccaccctgctggagagcatcagacaggccggcggcatcggcaaggccaagctgagaagcatgaaggagagaaagctggagaagcagcagcagaaggagcaggagcaggtgagagccaccagccagggcggccacctgatgagcgacctgttcaacaagctggtgatgagaagaaagggcatcagcggcaagggccccggcgccggcgacggccccggcggcgccttcgccagagtgagcgacagcatcccccccctgccccccccccagcagccccaggccgaggacgaggacgactgggagagctag

SEQ ID NO: 23941 - DNA, 510 bp, Artificial Sequence
  Description of Artificial Sequence: Synthetic coding sequence
atgagcggcgagatggccttccacgagatgcaggcccacaagaacgccctgggcaccagcggcgagcagcaggccgccgacatcaccggccccaccccccaccagggcggctggaagcaggtggagcagagcagaagccaggtgcaggccatcggcgagaaggtgagcctggcccaggccaagatcgagaagatcaagggcagcaagaaggccatcaaggtgttcagcagcgccaagtaccccgcccccgagagactgcaggagtacggcagcatcttcaccgacgcccaggaccccggcctgcagagaagacccagacacagaatccagagcaagcagagacccctggacgagagagccctgcaggagaagctgaaggacttccccgtgtgcgtgagcaccaagcccgagcccgaggacgacgccgaggagggcctgggcggcctgcccagcaacatcagcagcgtgagcagcctgctgctgttcaacaccaccgagaacctgtactag

SEQ ID NO: 23942 - DNA, 1344 bp, Artificial Sequence
  Description of Artificial Sequence: Synthetic coding sequence
atggccttccacgagatgcaggcccacaagaacgccctgggcaccagcggcgagcagcaggccgccgacatcaccggccccaccccccaccagggcggctggaagcaggtggagcagagcagaagccaggtgcaggccatcggcgagaaggtgagcctggcccaggccaagatcgagaagatcaagggcagcaagaaggccatcaaggtgttcagcagcgccaagtaccccgcccccgagagactgcaggagtacggcagcatcttcaccggcgcccaggaccccggcctgcagagaagacccagacacagaatccagagcaagcacagacccctggacgagagagccctgcaggagaagctgaaggacttccccgtgtgcgtgagcaccaagcccgagcccgaggacgacgccgaggagggcctgggcggcctgcccagcaacatcagcagcgtgagcagcctgctgctgttcaacaccaccgagaacctgtacaagaagtacgtgttcctggaccccctggccggcgccgtgaccaagacccacgtgatgctgggcgccgagaccgaggagaagctgttcgacgcccccctgagcatcagcaagagagagcagctggagcagcaggtgcccgagaactacttctacgtgcccgacctgggccaggtgcccgagatcgacgtgcccagctacctgcccgacctgcccagcatcgccaacgacctgatgtacagcgccgacctgggccccggcatcgcccccagcgcccccggcaccatccccgagctgcccaccttccacaccgaggtggccgagcccctgaaggccgacctgcaggacggcgtgctgaccccccccccccccccccccccccccccccccgcccccgaggtgctggccagcgccccccccctgccccccagcaccgccgcccccgtgggccagggcgccagacaggacgacggcagcagcagcgccagccccagcgtgcagggcgcccccagagaggtggtggaccccagcggcggctgggccaccctgctggagagcatcagacaggccggcggcatcggcaaggccaagctgagaagcatgaaggagagaaagctggagaagaagaagcagaaggagcaggagcaggtgagagccaccagccagggcggccacctgatgagcgacctgttcaacaagctggtgatgagaagaaagggcatcagcggcaagggccccggcgccggcgagggccccggcggcgccttcgccagagtgagcgacagcatcccccccgtgccccccccccagcagccccaggccgaggaggacgaggacgactgggagagctag

SEQ ID NO: 23943 - DNA, 1437 bp, Artificial Sequence
  Description of Artificial Sequence: Synthetic coding sequence
atgagcggcgtgatgtgcctgaaggccagcgacacctgggccagcggcatcagaagccagccccagggctgcctgggcaagtggagaagcatgagatgcaagcacaccagaatgcacctggcccacctgggcaacagcagacagctgatcagcctgggcccccccagaaccagagaggacggcagcagaatcagccagcaggtggagcagagcagaagccaggtgcaggccatcggcgagaaggtgagcctggcccaggccaagatcgagaagatcaagggcagcaagaaggccatcaaggtgttcagcagcgccaagtaccccgcccccgagagactgcaggagtacggcagcatcttcaccggcgcccaggaccccggcctgcagagaagacccagacacagaatccagagcaagcacagacccctggacgagagagccctgcaggagaagctgaaggacttccccgtgtgcgtgagcaccaagcccgagcccgaggacgacgccgaggagggcctgggcggcctgcccagcaacatcagcagcgtgagcagcctgctgctgttcaacaccaccgagaacctgtacaagaagtacgtgttcctggaccccctggccggcgccgtgaccaagacccacgtgatgctgggcgccgagaccgaggagaagctgttcgacgcccccctgagcatcagcaagagagagcagctggagcagcaggtgcccgagaactacttctacgtgcccgacctgggccaggtgcccgagatcgacgtgcccagctacctgcccgacctgcccagcatcgccaacgacctgatgtacagcgccgacctgggccccggcatcgcccccagcgcccccggcaccatccccgagctgcccaccttccacaccgaggtggccgagcccctgaaggccgacctgcaggacggcgtgctgaccccccccccccccccccccccccccccccccgcccccgaggtgctggccagcgccccccccctgccccccagcaccgccgcccccgtgggccagggcgccagacaggacgacggcagcagcagcgccagccccagcgtgcagggcgcccccagagaggtggtggaccccagcggcggctgggccaccctgctggagagcatcagacaggccggcggcatcggcaaggccaagctgagaagcatgaaggagagaaagctggagaagaagaagcagaaggagcaggagcaggtgagagccaccagccagggcggccacctgatgagcgacctgttcaacaagctggtgatgagaagaaagggcatcagcggcaagggccccggcgccggcgagggccccggcggcgccttcgccagagtgagcgacagcatcccccccgtgccccccccccagcagccccaggccgaggaggacgaggacgactgggagagctag

SEQ ID NO: 23944 - DNA, 10581 bp, Artificial Sequence
  Description of Artificial Sequence: Synthetic coding sequence
atgaacatggtgaagagaatcatgggcagacccagacaggaggagtgcagcccccaggacaacgccctgggcctgatgcacctgagaagactgttcaccgagctgtgccacccccccagacacatgacccagaaggagcaggaggagaagctgtacatgatgctgcccgtgttcaacagagtgttcggcaacgccccccccaacaccatgaccgagaagttcagcgacctgctgcagttcaccacccaggtgagcagactgatggtgaccgagatcagaagaagagccagcaacaagagcaccgaggccgccagcagagccatcgtgcagttcctggagatcaaccagagcgaggaggccagcagaggctggatgctgctgaccaccatcaacctgctggccagcagcggccagaagaccgtggactgcatgaccaccatgagcgtgcccagcaccctggtgaagtgcctgtacctgttcttcgacctgccccacgtgcccgaggccgtgggcggcgcccagaacgagctgcccctggccgagagaagaggcctgctgcagaaggtgttcgtgcagatcctggtgaagctgtgcagcttcgtgagccccgccgaggagctggcccagaaggacgacctgcagctgctgttcagcgccatcaccagctggtgccccccctacaacctgccctggagaaagagcgccggcgaggtgctgatgaccatcagcagacacggcctgagcgtgaacgtggtgaagtacatccacgagaaggagtgcctgagcacctgcgtgcagaacatgcagcagagcgacgacctgagccccctggagatcgtggagatgttcgccggcctgagctgcttcctgaaggacagcagcgacgtgagccagaccctgctggacgacttcagaatctggcagggctacaacttcctgtgcgacctgctgctgagactggagcaggccaaggaggccgagagcaaggacgccctgaaggacctggtgaacctgatcaccagcctgaccacctacggcgtgagcgagctgaagcccgccggcatcaccaccggcgcccccttcctgctgcccggcttcgccgtgccccagcccgccggcaagggccacagcgtgagaaacgtgcaggccttcgccgtgctgcagaacgccttcctgaaggccaagaccagcttcctggcccagatcatcctggacgccatcaccaacatctacatggccgacaacgccaactacttcatcctggagagccagcacaccctgagccagttcgccgagaagatcagcaagctgcccgaggtgcagaacaagtacttcgagatgctggagttcgtggtgttcagcctgaactacatcccctgcaaggagctgatcagcgtgagcatcctgctgaagagcagcagcagctaccactgcagcatcatcgccatgaagaccctgctgaagttcaccagacacgactacatcttcaaggacgtgttcagagaggtgggcctgctggaggtgatggtgaacctgctgcacaagtacgccgccctgctgaaggaccccacccaggccctgaacgagcagggcgacagcagaaacaacagcagcgtggaggaccagaagcacctggccctgctggtgatggagaccctgaccgtgctgctgcagggcagcaacaccaacgccggcatcttcagagagttcggcggcgccagatgcgcccacaacatcgtgaagtacccccagtgcagacagcacgccctgatgaccatccagcagctggtgctgagccccaacggcgacgacgacatgggcaccctgctgggcctgatgcacagcgccccccccaccgagctgcagctgaagaccgacatcctgagagccctgctgagcgtgctgagagagagccacagaagcagaaccgtgttcagaaaggtgggcggcttcgtgtacatcaccagcctgctggtggccatggagagaagcctgagctgcccccccaagaacggctgggagaaggtgaaccagaaccaggtgttcgagctgctgcacaccgtgttctgcaccctgaccgccgccatgagatacgagcccgccaacagccacttcttcaagaccgagatccagtacgagaagctggccgacgccgtgagattcctgggctgcttcagcgacctgagaaagatcagcgccatgaacgtgttccccagcaacacccagcccttccagagactgctggaggaggacgtgatcagcatcgagagcgtgagccccaccctgagacactgcagcaagctgttcatctacctgtacaaggtggccaccgacagcttcgacagcagagccgagcagatccccccctgcctgaccagcgagagcagcctgcccagcccctggggcacccccgccctgagcagaaagagacacgcctaccacagcgtgagcaccccccccgtgtacccccccaagaacgtggccgacctgaagctgcacgtgaccaccagcagcctgcagagcagcgacgccgtgatcatccaccccggcgccatgctggccatgctggacctgctggccagcgtgggcagcgtgacccagcccgagcacgccctggacctgcagctggccgtggccaacatcctgcagagcctggtgcacaccgagagaaaccagcaggtgatgtgcgaggccggcctgcacgccagactgctgcagagatgcagcgccgccctggccgacgaggaccacagcctgcacccccccctgcagagaatgttcgagagactggccagccaggccctggagcccatggtgctgagagagttcctgagactggccagccccctgaactgcggcgcctgggacaagaagctgctgaagcagtacagagtgcacaagcccagcagcctgagctacgagcccgagatgagaagcagcatgatcaccagcctggagggcctgggcaccgacaacgtgttcagcctgcacgaggacaaccactacagaatcagcaagagcctggtgaagagcgccgagggcagcaccgtgcccctgaccagagtgaagtgcctggtgagcatgaccaccccccacgacatcagactgcacggcagcagcgtgacccccgccttcgtggagttcgacaccagcctggagggcttcggctgcctgttcctgcccagcctggccccccacaacgcccccaccaacaacaccgtgaccaccggcctgatcgacggcgccgtggtgagcggcatcggcagcggcgagagattcttccccccccccagcggcctgagctacagcagctggttctgcatcgagcacttcagcagcccccccaacaaccaccccgtgagactgctgaccgtggtgagaagagccaacagcagcgagcagcactacgtgtgcctggccatcgtgctgagcgccaaggacagaagcctgatcgtgagcaccaaggaggagctgctgcagaactacgtggacgacttcagcgaggagagcagcttctacgagatcctgccctgctgcgccagattcagatgcggcgagctgatcatcgagggccagtggcaccacctggtgctggtgatgagcaagggcatgctgaagaacagcaccgccgccctgtacatcgacggccagctggtgaacaccgtgaagctgcactacgtgcacagcacccccggcggcagcggcagcgccaacccccccgtggtgagcaccgtgtacgcctacatcggcaccccccccgcccagagacagatcgccagcctggtgtggagactgggccccacccacttcctggaggaggtgctgcccagcagcaacgtgaccaccatctacgagctgggccccaactacgtgggcagcttccaggccgtgtgcatgccctgcaaggacgccaagagcgagggcgtggtgcccagccccgtgagcctggtgcccgaggagaaggtgagcttcggcctgtacgccctgagcgtgagcagcctgaccgtggccagaatcagaaaggtgtacaacaagctggacagcaaggccatcgccaagcagctgggcatcagcagccacgagaacgccacccccgtgaagctgatccacaacagcgccggccacctgaacggcagcgccagaaccatcggcgccgccctgatcggctacctgggcgtgagaaccttcgtgcccaagcccgtggccaccaccctgcagtacgtgggcggcgccgccgccatcctgggcctggtggccatggccagcgacgtggagggcctgtacgccgccgtgaaggccctggtgtgcgtggtgaagagcaaccccctggccagcaaggagatggagagaatcaagggctaccagctgctggccatgctgctgaagaagaagagaagcctgctgaacagccacatcctgcacctgaccttcagcctggtgggcaccgtggacagcggccacgagaccagcatcatccccaacagcaccgccttccaggacctgctgtgcgacttcgaggtgtggctgcacgccccctacgagctgcacctgagcctgttcgagcacttcatcgagctgctgaccgagagcagcgaggccagcaagaacgccaagctgatgagagagttccagctgatccccaagctgctgctgaccctgagagacatgagcctgagccagcccaccatcgccgccatcagcaacgtgctgagcttcctgctgcagggcttccccagcagcaacgacctgctgagattcggccagttcatcagcagcaccctgcccaccttcgccgtgtgcgagaagttcgtggtgatggagatcaacaacgaggagaagctggacaccggcaccgaggaggagttcggcggcctggtgagcgccaacctgatcctgctgagaaacagactgctggacatcctgctgaagctgatctacaccagcaaggagaagaccagcatcaacctgcaggcctgcgaggagctggtgaagaccctgggcttcgactggatcatgatgttcatggaggagcacctgcacagcaccaccgtgaccgccgccatgagaatcctggtggtgctgctgagcaaccagagcatcctgatcaagttcaaggagggcctgagcggcggcggctggctggagcagaccgacagcgtgctgaccaacaagatcggcaccgtgctgggcttcaacgtgggcagaagcgccggcggcagaagcaccgtgagagagatcaacagagacgcctgccacttccccggcttccccgtgctgcagagcttcctgcccaagcacaccaacgtgcccgccctgtacttcctgctgatggccctgttcctgcagcagcccgtgagcgagctgcccgagaacctgcaggtgagcgtgcccgtgatcagctgcagaagcaagcagggctgccagttcgacctggacagcatctggaccttcatcttcggcgtgcccgccagcagcggcaccgtggtgagcagcatccacaacgtgtgcaccgaggccgtgttcctgctgctgggcatgctgagaagcatgctgaccagcccctggcagagcgaggaggagggcagctggctgagagagtaccccgtgaccctgatgcagttcttcagatacctgtaccacaacgtgcccgacctggccagcatgtggatgagccccgacttcctgtgcgccctggccgccaccgtgttccccttcaacatcagaccctacagcgagatggtgaccgacctggacgacgaggtgggcagccccgccgaggagttcaaggccttcgccgccgacaccggcatgaacagaagccagagcgagtactgcaacgtgggcaccaagacctacctgaccaaccaccccgccaagaagttcgtgttcgacttcatgagagtgctgatcatcgacaacctgtgcctgacccccgccagcaagcagacccccctgatcgacctgctgctggaggccagccccgagagaagcaccagaacccagcagaaggagttccagacctacatcctggacagcgtgatggaccacctgctggccgccgacgtgctgctgggcgaggacgccagcctgcccatcaccagcggcggcagctaccaggtgctggtgaacaacgtgttctacttcacccagagagtggtggacaagctgtggcagggcatgttcaacaaggagagcaagctgctgatcgacttcatcatccagctgatcgcccagagcaagagaagaagccagggcctgagcctggacgccgtgtaccactgcctgaacagaaccatcctgtaccagttcagcagagcccacaagaccgtgccccagcaggtggccctgctggacagcctgagagtgctgaccgtgaacagaaacctgatcctgggccccggcaaccacgaccaggagttcatcagctgcctggcccactgcctgatcaacctgcacgtgggcagcaacgtggacggcttcggcctggaggccgaggccagaatgaccacctggcacatcatgatccccagcgacatcgagcccgacggcagctacagccaggacatcagcgagggcagacagctgctgatcaaggccgtgaacagagtgtggaccgagctgatccacagcaagaagcaggtgctggaggagctgttcaaggtgaccctgcccgtgaacgagagaggccacgtggacatcgccaccgccagacccctgatcgaggaggccgccctgaagtgctggcagaaccacctggcccacgagaagaagtgcatcagcagaggcgaggccctggcccccaccacccagagcaagctgagcagagtgagcagcggcttcggcctgagcaagctgaccggcagcagaagaaacagaaaggagagcggcctgaacaagcacagcctgagcacccaggagatcagccagtggatgttcacccacatcgccgtggtgagagacctggtggacacccagtacaaggagtaccaggagagacagcagaacgccctgaagtacgtgaccgaggagtggtgccagatcgagtgcgagctgctgagagagagaggcctgtggggcccccccatcggcagccacctggacaagtggatgctggagatgaccgagggcccctgcagaatgagaaagaagatggtgagaaacgacatgttctacaaccactacccctacgtgcccgagaccgagcaggagaccaacgtggccagcgagatccccagcaagcagcccgagacccccgacgacatcccccagaagaagcccgccagatacagaagagccgtgagctacgacagcaaggagtactacatgagactggccagcggcaaccccgccatcgtgcaggacgccatcgtggagagcagcgagggcgaggccgcccagcaggagcccgagcacggcgaggacaccatcgccaaggtgaagggcctggtgaagccccccctgaagagaagcagaagcgcccccgacggcggcgacgaggagaaccaggagcagctgcaggaccagatcgccgagggcagcagcatcgaggaggaggagaagaccgacaacgccaccctgctgagactgctggaggagggcgagaagatccagcacatgtacagatgcgccagagtgcagggcctggacaccagcgagggcctgctgctgttcggcaaggagcacttctacgtgatcgacggcttcaccatgaccgccaccagagagatcagagacatcgagaccctgccccccaacatgcacgagcccatcatccccagaggcgccagacagggccccagccagctgaagagaacctgcagcatcttcgcctacgaggacatcaaggaggtgcacaagagaagatacctgctgcagcccatcgccgtggaggtgttcagcggcgacggcagaaactacctgctggccttccagaagggcatcagaaacaaggtgtaccagagattcctggccgtggtgcccagcctgaccgacagcagcgagagcgtgagcggccagagacccaacaccagcgtggagcagggcagcggcctgctgagcaccctggtgggcgagaagagcgtgacccagagatgggagagaggcgagatcagcaacttccagtacctgatgcacctgaacaccctggccggcagaagctacaacgacctgatgcagtaccccgtgttcccctggatcctggccgactacgacagcgaggaggtggacctgaccaaccccaagaccttcagaaacctggccaagcccatgggcgcccagaccgacgagagactggcccagtacaagaagagatacaaggactgggaggaccccaacggcgagacccccgcctaccactacggcacccactacagcagcgccatgatcgtggccagctacctggtgagaatggagcccttcacccagatcttcctgagactgcagggcggccacttcgacctggccgacagaatgttccacagcgtgagagaggcctggtacagcgccagcaagcacaacatggccgacgtgaaggagctgatccccgagttcttctacctgcccgagttcctgttcaacagcaacaacttcgacctgggctgcaagcagaacggcaccaagctgggcgacgtgatcctgcccccctgggccaagggcgaccccagagagttcatcagagtgcacagagaggccctggagtgcgactacgtgagcgcccacctgcacgagtggatcgacctgatcttcggctacaagcagcagggccccgccgccgtggaggccgtgaacgtgttccaccacctgttctacgagggccaggtggacatctacaacatcaacgaccccctgaaggagaccgccaccatcggcttcatcaacaacttcggccagatccccaagcagctgttcaagaagccccacccccccaagagagtgagaagcagactgaacggcgacaacgccggcatcagcgtgctgcccggcagcaccagcgacaagatcttcttccaccacctggacaacctgagacccagcctgacccccgtgaaggagctgaaggagcccgtgggccagatcgtgtgcaccgacaagggcatcctggccgtggagcagaacaaggtgctgatcccccccacctggaacaagaccttcgcctggggctacgccgacctgagctgcagactgggcacctacgagagcgacaaggccatgaccgtgtacgagtgcctgagcgagtggggccagatcctgtgcgccatctgccccaaccccaagctggtgatcaccggcggcaccagcaccgtggtgtgcgtgtgggagatgggcaccagcaaggagaaggccaagaccgtgaccctgaagcaggccctgctgggccacaccgacaccgtgacctgcgccaccgccagcctggcctaccacatcatcgtgagcggcagcagagacagaacctgcatcatctgggacctgaacaagctgagcttcctgacccagctgagaggccacagagcccccgtgagcgccctgtgcatcaacgagctgaccggcgacatcgtgagctgcgccggcacctacatccacgtgtggagcatcaacggcaaccccatcgtgagcgtgaacaccttcaccggcagaagccagcagatcatctgctgctgcatgagcgagatgaacgagtgggacacccagaacgtgatcgtgaccggccacagcgacggcgtggtgagattctggagaatggagttcctgcaggtgcccgagacccccgcccccgagcccgccgaggtgctggagatgcaggaggactgccccgaggcccagatcggccaggaggcccaggacgaggacagcagcgacagcgaggccgacgagcagagcatcagccaggaccccaaggacacccccagccagcccagcagcaccagccacagacccagagccgccagctgcagagccaccgccgcctggtgcaccgacagcggcagcgacgacagcagaagatggagcgaccagctgagcctggacgagaaggacggcttcatcttcgtgaactacagcgagggccagaccagagcccacctgcagggccccctgagccacccccaccccaaccccatcgaggtgagaaactacagcagactgaagcccggctacagatgggagagacagctggtgttcagaagcaagctgaccatgcacaccgccttcgacagaaaggacaacgcccaccccgccgaggtgaccgccctgggcatcagcaaggaccacagcagaatcctggtgggcgacagcagaggcagagtgttcagctggagcgtgagcgaccagcccggcagaagcgccgccgaccactgggtgaaggacgagggcggcgacagctgcagcggctgcagcgtgagattcagcctgaccgagagaagacaccactgcagaaactgcggccagctgttctgccagaagtgcagcagattccagagcgagatcaagagactgaagatcagcagccccgtgagagtgtgccagaactgctactacaacctgcagcacgagagaggcagcgaggacggccccagaaactgctag

SEQ ID NO: 23945 - DNA, 10530 bp, Artificial Sequence
  Description of Artificial Sequence: Synthetic coding sequence
atgaacatggtgaagagaatcatgggcagacccagacaggaggagtgcagcccccaggacaacgccctgggcctgatgcacctgagaagactgttcaccgagctgtgccacccccccagacacatgacccagaaggagcaggaggagaagctgtacatgatgctgcccgtgttcaacagagtgttcggcaacgccccccccaacaccatgaccgagaagttcagcgacctgctgcagttcaccacccaggtgagcagactgatggtgaccgagatcagaagaagagccagcaacaagagcaccgaggccgccagcagagccatcgtgcagttcctggagatcaaccagagcgaggaggccagcagaggctggatgctgctgaccaccatcaacctgctggccagcagcggccagaagaccgtggactgcatgaccaccatgagcgtgcccagcaccctggtgaagtgcctgtacctgttcttcgacctgccccacgtgcccgaggccgtgggcggcgcccagaacgagctgcccctggccgagagaagaggcctgctgcagaaggtgttcgtgcagatcctggtgaagctgtgcagcttcgtgagccccgccgaggagctggcccagaaggacgacctgcagctgctgttcagcgccatcaccagctggtgccccccctacaacctgccctggagaaagagcgccggcgaggtgctgatgaccatcagcagacacggcctgagcgtgaacgtggtgaagtacatccacgagaaggagtgcctgagcacctgcgtgcagaacatgcagcagagcgacgacctgagccccctggagatcgtggagatgttcgccggcctgagctgcttcctgaaggacagcagcgacgtgagccagaccctgctggacgacttcagaatctggcagggctacaacttcctgtgcgacctgctgctgagactggagcaggccaaggaggccgagagcaaggacgccctgaaggacctggtgaacctgatcaccagcctgaccacctacggcgtgagcgagctgaagcccgccggcatcaccaccggcgcccccttcctgctgcccggcttcgccgtgccccagcccgccggcaagggccacagcgtgagaaacgtgcaggccttcgccgtgctgcagaacgccttcctgaaggccaagaccagcttcctggcccagatcatcctggacgccatcaccaacatctacatggccgacaacgccaactacttcatcctggagagccagcacaccctgagccagttcgccgagaagatcagcaagctgcccgaggtgcagaacaagtacttcgagatgctggagttcgtggtgttcagcctgaactacatcccctgcaaggagctgatcagcgtgagcatcctgctgaagagcagcagcagctaccactgcagcatcatcgccatgaagaccctgctgaagttcaccagacacgactacatcttcaaggacgtgttcagagaggtgggcctgctggaggtgatggtgaacctgctgcacaagtacgccgccctgctgaaggaccccacccaggccctgaacgagcagggcgacagcagaaacaacagcagcgtggaggaccagaagcacctggccctgctggtgatggagaccctgaccgtgctgctgcagggcagcaacaccaacgccggcatcttcagagagttcggcggcgccagatgcgcccacaacatcgtgaagtacccccagtgcagacagcacgccctgatgaccatccagcagctggtgctgagccccaacggcgacgacgacatgggcaccctgctgggcctgatgcacagcgccccccccaccgagctgcagctgaagaccgacatcctgagagccctgctgagcgtgctgagagagagccacagaagcagaaccgtgttcagaaaggtgggcggcttcgtgtacatcaccagcctgctggtggccatggagagaagcctgagctgcccccccaagaacggctgggagaaggtgaaccagaaccaggtgttcgagctgctgcacaccgtgttctgcaccctgaccgccgccatgagatacgagcccgccaacagccacttcttcaagaccgagatccagtacgagaagctggccgacgccgtgagattcctgggctgcttcagcgacctgagaaagatcagcgccatgaacgtgttccccagcaacacccagcccttccagagactgctggaggaggacgtgatcagcatcgagagcgtgagccccaccctgagacactgcagcaagctgttcatctacctgtacaaggtggccaccgacagcttcgacagcagagccgagcagatccccccctgcctgaccagcgagagcagcctgcccagcccctggggcacccccgccctgagcagaaagagacacgcctaccacagcgtgagcaccccccccgtgtacccccccaagaacgtggccgacctgaagctgcacgtgaccaccagcagcctgcagagcagcgacgccgtgatcatccaccccggcgccatgctggccatgctggacctgctggccagcgtgggcagcgtgacccagcccgagcacgccctggacctgcagctggccgtggccaacatcctgcagagcctggtgcacaccgagagaaaccagcaggtgatgtgcgaggccggcctgcacgccagactgctgcagagatgcagcgccgccctggccgacgaggaccacagcctgcacccccccctgcagagaatgttcgagagactggccagccaggccctggagcccatggtgctgagagagttcctgagactggccagccccctgaactgcggcgcctgggacaagaagctgctgaagcagtacagagtgcacaagcccagcagcctgagctacgagcccgagatgagaagcagcatgatcaccagcctggagggcctgggcaccgacaacgtgttcagcctgcacgaggacaaccactacagaatcagcaagagcctggtgaagagcgccgagggcagcaccgtgcccctgaccagagtgaagtgcctggtgagcatgaccaccccccacgacatcagactgcacggcagcagcgtgacccccgccttcgtggagttcgacaccagcctggagggcttcggctgcctgttcctgcccagcctggccccccacaacgcccccaccaacaacaccgtgaccaccggcctgatcgacggcgccgtggtgagcggcatcggcagcggcgagagattcttccccccccccagcggcctgagctacagcagctggttctgcatcgagcacttcagcagcccccccaacaaccaccccgtgagactgctgaccgtggtgagaagagccaacagcagcgagcagcactacgtgtgcctggccatcgtgctgagcgccaaggacagaagcctgatcgtgagcaccaaggaggagctgctgcagaactacgtggacgacttcagcgaggagagcagcttctacgagatcctgccctgctgcgccagattcagatgcggcgagctgatcatcgagggccagtggcaccacctggtgctggtgatgagcaagggcatgctgaagaacagcaccgccgccctgtacatcgacggccagctggtgaacaccgtgaagctgcactacgtgcacagcacccccggcggcagcggcagcgccaacccccccgtggtgagcaccgtgtacgcctacatcggcaccccccccgcccagagacagatcgccagcctggtgtggagactgggccccacccacttcctggaggaggtgctgcccagcagcaacgtgaccaccatctacgagctgggccccaactacgtgggcagcttccaggccgtgtgcatgccctgcaaggacgccaagagcgagggcgtggtgcccagccccgtgagcctggtgcccgaggagaaggtgagcttcggcctgtacgccctgagcgtgagcagcctgaccgtggccagaatcagaaaggtgtacaacaagctggacagcaaggccatcgccaagcagctgggcatcagcagccacgagaacgccacccccgtgaagctgatccacaacagcgccggccacctgaacggcagcgccagaaccatcggcgccgccctgatcggctacctgggcgtgagaaccttcgtgcccaagcccgtggccaccaccctgcagtacgtgggcggcgccgccgccatcctgggcctggtggccatggccagcgacgtggagggcctgtacgccgccgtgaaggccctggtgtgcgtggtgaagagcaaccccctggccagcaaggagatggagagaatcaagggctaccagctgctggccatgctgctgaagaagaagagaagcctgctgaacagccacatcctgcacctgaccttcagcctggtgggcaccgtggacagcggccacgagaccagcatcatccccaacagcaccgccttccaggacctgctgtgcgacttcgaggtgtggctgcacgccccctacgagctgcacctgagcctgttcgagcacttcatcgagctgctgaccgagagcagcgaggccagcaagaacgccaagctgatgagagagttccagctgatccccaagctgctgctgaccctgagagacatgagcctgagccagcccaccatcgccgccatcagcaacgtgctgagcttcctgctgcagggcttccccagcagcaacgacctgctgagattcggccagttcatcagcagcaccctgcccaccttcgccgtgtgcgagaagttcgtggtgatggagatcaacaacgaggagaagctggacaccggcaccgaggaggagttcggcggcctggtgagcgccaacctgatcctgctgagaaacagactgctggacatcctgctgaagctgatctacaccagcaaggagaagaccagcatcaacctgcaggcctgcgaggagctggtgaagaccctgggcttcgactggatcatgatgttcatggaggagcacctgcacagcaccaccgtgaccgccgccatgagaatcctggtggtgctgctgagcaaccagagcatcctgatcaagttcaaggagggcctgagcggcggcggctggctggagcagaccgacagcgtgctgaccaacaagatcggcaccgtgctgggcttcaacgtgggcagaagcgccggcggcagaagcaccgtgagagagatcaacagagacgcctgccacttccccggcttccccgtgctgcagagcttcctgcccaagcacaccaacgtgcccgccctgtacttcctgctgatggccctgttcctgcagcagcccgtgagcgagctgcccgagaacctgcaggtgagcgtgcccgtgatcagctgcagaagcaagcagggctgccagttcgacctggacagcatctggaccttcatcttcggcgtgcccgccagcagcggcaccgtggtgagcagcatccacaacgtgtgcaccgaggccgtgttcctgctgctgggcatgctgagaagcatgctgaccagcccctggcagagcgaggaggagggcagctggctgagagagtaccccgtgaccctgatgcagttcttcagatacctgtaccacaacgtgcccgacctggccagcatgtggatgagccccgacttcctgtgcgccctggccgccaccgtgttccccttcaacatcagaccctacagcgagatggtgaccgacctggacgacgaggtgggcagccccgccgaggagttcaaggccttcgccgccgacaccggcatgaacagaagccagagcgagtactgcaacgtgggcaccaagacctacctgaccaaccaccccgccaagaagttcgtgttcgacttcatgagagtgctgatcatcgacaacctgtgcctgacccccgccagcaagcagacccccctgatcgacctgctgctggaggccagccccgagagaagcaccagaacccagcagaaggagttccagacctacatcctggacagcgtgatggaccacctgctggccgccgacgtgctgctgggcgaggacgccagcctgcccatcaccagcggcggcagctaccaggtgctggtgaacaacgtgttctacttcacccagagagtggtggacaagctgtggcagggcatgttcaacaaggagagcaagctgctgatcgacttcatcatccagctgatcgcccagagcaagagaagaagccagggcctgagcctggacgccgtgtaccactgcctgaacagaaccatcctgtaccagttcagcagagcccacaagaccgtgccccagcaggtggccctgctggacagcctgagagtgctgaccgtgaacagaaacctgatcctgggccccggcaaccacgaccaggagttcatcagctgcctggcccactgcctgatcaacctgcacgtgggcagcaacgtggacggcttcggcctggaggccgaggccagaatgaccacctggcacatcatgatccccagcgacatcgagcccgacggcagctacagccaggacatcagcgagggcagacagctgctgatcaaggccgtgaacagagtgtggaccgagctgatccacagcaagaagcaggtgctggaggagctgttcaaggtgaccctgcccgtgaacgagagaggccacgtggacatcgccaccgccagacccctgatcgaggaggccgccctgaagtgctggcagaaccacctggcccacgagaagaagtgcatcagcagaggcgaggccctggcccccaccacccagagcaagctgagcagagtgagcagcggcttcggcctgagcaagctgaccggcagcagaagaaacagaaaggagagcggcctgaacaagcacagcctgagcacccaggagatcagccagtggatgttcacccacatcgccgtggtgagagacctggtggacacccagtacaaggagtaccaggagagacagcagaacgccctgaagtacgtgaccgaggagtggtgccagatcgagtgcgagctgctgagagagagaggcctgtggggcccccccatcggcagccacctggacaagtggatgctggagatgaccgagggcccctgcagaatgagaaagaagatggtgagaaacgacatgttctacaaccactacccctacgtgcccgagaccgagcaggagaccaacgtggccaagcccgccagatacagaagagccgtgagctacgacagcaaggagtactacatgagactggccagcggcaaccccgccatcgtgcaggacgccatcgtggagagcagcgagggcgaggccgcccagcaggagcccgagcacggcgaggacaccatcgccaaggtgaagggcctggtgaagccccccctgaagagaagcagaagcgcccccgacggcggcgacgaggagaaccaggagcagctgcaggaccagatcgccgagggcagcagcatcgaggaggaggagaagaccgacaacgccaccctgctgagactgctggaggagggcgagaagatccagcacatgtacagatgcgccagagtgcagggcctggacaccagcgagggcctgctgctgttcggcaaggagcacttctacgtgatcgacggcttcaccatgaccgccaccagagagatcagagacatcgagaccctgccccccaacatgcacgagcccatcatccccagaggcgccagacagggccccagccagctgaagagaacctgcagcatcttcgcctacgaggacatcaaggaggtgcacaagagaagatacctgctgcagcccatcgccgtggaggtgttcagcggcgacggcagaaactacctgctggccttccagaagggcatcagaaacaaggtgtaccagagattcctggccgtggtgcccagcctgaccgacagcagcgagagcgtgagcggccagagacccaacaccagcgtggagcagggcagcggcctgctgagcaccctggtgggcgagaagagcgtgacccagagatgggagagaggcgagatcagcaacttccagtacctgatgcacctgaacaccctggccggcagaagctacaacgacctgatgcagtaccccgtgttcccctggatcctggccgactacgacagcgaggaggtggacctgaccaaccccaagaccttcagaaacctggccaagcccatgggcgcccagaccgacgagagactggcccagtacaagaagagatacaaggactgggaggaccccaacggcgagacccccgcctaccactacggcacccactacagcagcgccatgatcgtggccagctacctggtgagaatggagcccttcacccagatcttcctgagactgcagggcggccacttcgacctggccgacagaatgttccacagcgtgagagaggcctggtacagcgccagcaagcacaacatggccgacgtgaaggagctgatccccgagttcttctacctgcccgagttcctgttcaacagcaacaacttcgacctgggctgcaagcagaacggcaccaagctgggcgacgtgatcctgcccccctgggccaagggcgaccccagagagttcatcagagtgcacagagaggccctggagtgcgactacgtgagcgcccacctgcacgagtggatcgacctgatcttcggctacaagcagcagggccccgccgccgtggaggccgtgaacgtgttccaccacctgttctacgagggccaggtggacatctacaacatcaacgaccccctgaaggagaccgccaccatcggcttcatcaacaacttcggccagatccccaagcagctgttcaagaagccccacccccccaagagagtgagaagcagactgaacggcgacaacgccggcatcagcgtgctgcccggcagcaccagcgacaagatcttcttccaccacctggacaacctgagacccagcctgacccccgtgaaggagctgaaggagcccgtgggccagatcgtgtgcaccgacaagggcatcctggccgtggagcagaacaaggtgctgatcccccccacctggaacaagaccttcgcctggggctacgccgacctgagctgcagactgggcacctacgagagcgacaaggccatgaccgtgtacgagtgcctgagcgagtggggccagatcctgtgcgccatctgccccaaccccaagctggtgatcaccggcggcaccagcaccgtggtgtgcgtgtgggagatgggcaccagcaaggagaaggccaagaccgtgaccctgaagcaggccctgctgggccacaccgacaccgtgacctgcgccaccgccagcctggcctaccacatcatcgtgagcggcagcagagacagaacctgcatcatctgggacctgaacaagctgagcttcctgacccagctgagaggccacagagcccccgtgagcgccctgtgcatcaacgagctgaccggcgacatcgtgagctgcgccggcacctacatccacgtgtggagcatcaacggcaaccccatcgtgagcgtgaacaccttcaccggcagaagccagcagatcatctgctgctgcatgagcgagatgaacgagtgggacacccagaacgtgatcgtgaccggccacagcgacggcgtggtgagattctggagaatggagttcctgcaggtgcccgagacccccgcccccgagcccgccgaggtgctggagatgcaggaggactgccccgaggcccagatcggccaggaggcccaggacgaggacagcagcgacagcgaggccgacgagcagagcatcagccaggaccccaaggacacccccagccagcccagcagcaccagccacagacccagagccgccagctgcagagccaccgccgcctggtgcaccgacagcggcagcgacgacagcagaagatggagcgaccagctgagcctggacgagaaggacggcttcatcttcgtgaactacagcgagggccagaccagagcccacctgcagggccccctgagccacccccaccccaaccccatcgaggtgagaaactacagcagactgaagcccggctacagatgggagagacagctggtgttcagaagcaagctgaccatgcacaccgccttcgacagaaaggacaacgcccaccccgccgaggtgaccgccctgggcatcagcaaggaccacagcagaatcctggtgggcgacagcagaggcagagtgttcagctggagcgtgagcgaccagcccggcagaagcgccgccgaccactgggtgaaggacgagggcggcgacagctgcagcggctgcagcgtgagattcagcctgaccgagagaagacaccactgcagaaactgcggccagctgttctgccagaagtgcagcagattccagagcgagatcaagagactgaagatcagcagccccgtgagagtgtgccagaactgctactacaacctgcagcacgagagaggcagcgaggacggccccagaaactgctag

SEQ ID NO: 23946 - DNA, 30 bp, Artificial Sequence
  Description of Artificial Sequence: Synthetic coding sequence
atgaacatggtgaagagaatcatgggctag

SEQ ID NO: 23947 - DNA, 183 bp, Artificial Sequence
  Description of Artificial Sequence: Synthetic coding sequence
atgaacatggtgaagagaatcatgggcagacccagacaggaggagtgcagcccccaggacaacgccctgggcctgatgcacctgagaagactgttcaccgagctgtgccacccccccagacacatgacccagaaggagcaggaggagaagctgtacatgatgctgcccgtgttcaacagatag

SEQ ID NO: 23948 - DNA, 2241 bp, Artificial Sequence
  Description of Artificial Sequence: Synthetic coding sequence
atgagaagagagttctgctgggacgcctacagcaaggccgccggcagcagagccagcagccccctgcccagacaggacagagacagcttctgccaccagatgagcttctgcctgaccgagctgcacctgtggagcctgaagaacaccctgcacatcgccgacagagacatcggcatctaccagtactacgacaagaaggacccccccgccaccgagcacggcaacctggagaagaagcagaagctggccgagagcagagactacccctggaccctgaagaacagaagacccgagaagctgagagacagcctgaaggagctggaggagctgatgcagaacagcagatgcgtgctgagcaagtggaagaacaagtacgtgtgccagctgctgttcggcagcggcgtgctggtgagcctgagcctgagcggcccccagctggagaaggtggtgatcgacagaagcctggtgggcaagctgatcagcgacaccatcagcgacgccctgctgaccgacagcttcatcatcctgagcttcctggcccagaacaagctgtgcttcatccagttcaccaagaagatggagagcagcgacgtgaacaagagactggagaagctgagcgccctggactacaagatcttctactacgagatccccggccccatcaacaagaccaccgagagacacctggccatcaactgcgtgcacgacagagtggtgtgctggtggcccctggtgaacgacgacgcctggccctgggcccccatcagcagcgagaaggacagagccaacctgctgctgctgggctacgcccagggcagactggaggtgctgagcagcgtgagaaccgagtgggaccccctggacgtgagattcggcaccaagcagccctaccaggtgttcaccgtggagcacagcgtgagcgtggacaaggagcccatggccgacagctgcatctacgagtgcatcagaaacaagatccagtgcgtgagcgtgaccagaatccccctgaagagcaaggccatcagctgctgcagaaacgtgaccgaggacaagctgatcctgggctgcgaggacagcagcctgatcctgtacgagacccacagaagagtgaccctgctggcccagaccgagctgctgcccagcctgatcagctgccaccccagcggcgccatcctgctggtgggcagcaaccagggcgagctgcagatcttcgacatggccctgagccccatcaacatccagctgctggccgaggacagactgcccagagagaccctgcagttcagcaagctgttcgacgccagcagcagcctggtgcagatgcagtggatcgccccccaggtggtgagccagaagggcgagggcagcgacatctacgacctgctgttcctgagattcgagagaggccccctgggcgtgctgctgttcaagctgggcgtgttcaccagaggccagctgggcctgatcgacatcatcttccagtacatccactgcgacgagatctacgaggccatcaacatcctgagcagcatgaactgggacaccctgggccaccagtgcttcatcagcatgagcgccatcgtgaaccacctgctgagacagaagctgacccccgagagagaggcccagctggagaccagcctgggcaccttctacgcccccaccagacccctgctggacagcaccatcctggagtacagagaccagatcagcaagtacgccagaagattcttccaccacctgctgagataccagagattcgagaaggccttcctgctggccgtggacgtgggcgccagagacctgttcatggacatccactacctggccctggacaagggcgagctggccctggccgaggtggccagaaagagagccagcgacatcgacgccgagagcatcaccagcggcgtggagctgctgggccccctggacagaggcgacatgctgaacgaggccttcatcggcctgagcctggccccccagggcgaggacagcttccccgacaacctgccccccagctgccccacccacagacacatcctgcagcagagaatcctgaacggcagcagcaacagacagatcatcgacagaagaaacgagctggagaaggacatctgcagcggcttcctgatgaccaacacctgcaacgccgaggacggcgagctgagagaggacggcagagagcaggagatcagagacggcggcagcctgaagatgatccacttcggcctggtgtag

SEQ ID NO: 23949 - DNA, 2742 bp, Artificial Sequence
  Description of Artificial Sequence: Synthetic coding sequence
atggccagcgagagcgacaccgaggagttctacgacgcccccgaggacgtgcacctgggcggcggctaccccgtgggcagccccggcaaggtgggcctgagcaccttcaaggagaccgagaacaccgcctacaaggtgggcaacgagagccccgtgcaggagctgaagcaggacgtgagcaagaagatcatcgagagcatcatcgaggagagccagaaggtgctgcagctggaggacgacagcctggacagcaagggcaaggagctgagcgaccaggccaccgccagccccatcgtggccagaaccgacctgagcaacatccccggcctgctggccatcgaccaggtgctgcccgaggagagccagaaggccgagagccagaacaccttcgaggagaccgagctggagctgaagaagtgcttccccagcgacgagacctgcgagaagcccgtggacgagaccaccaagctgacccagaccagcagcaccgagcagctgaacgtgctggagaccgagaccgaggtgctgaacaaggaggccgtggaggtgaagggcggcggcgacgtgctggagcccgtgagcagcgacagcctgagcaccaaggacttcgccgccgtggaggaggtggcccccgccaagccccccagacacctgacccccgagcccgacatcgtggccagcaccaagaagcccgtgcccgccagaccccccccccccaccaacttccccccccccagaccccccccccccagcagacccgcccccccccccagaaagagaaagagcgagctggagttcgagaccctgaagacccccgacatcgacgtgcccaaggagaacatcaccagcgacagcctgctgaccgccagcatggccagcgagagcaccgtgaaggacagccagcccagcctggacctggccagcgccaccagcggcgacaagatcgtgaccgcccaggagaacggcaaggcccccgacggccagaccgtggccggcgaggtgatgggcccccagagacccagaagcaacagcggcagagagctgaccgacgaggagatcctggccagcgtgatgatcaagaacctggacaccggcgaggagatccccctgagcctggccgaggagaagctgcccaccggcatcaaccccctgaccctgcacatcatgagaagaaccaaggagtacgtgagcaacgacgccgcccagagcgacgacgaggagaagctgcagagccagcccaccgacaccgacggcggcagactgaagcagaagaccacccagctgaagaagttcctgggcaagagcgtgaagagagccaagcacctggccgaggagtacggcgagagagccatcaacaaggtgaagagcgtgagagacgaggtgttccacaccgaccaggacgaccccagcagcagcgacgacgagggcatgccctacaccagacccgtgaagttcaaggccgcccacggcttcaagggcccctacgacttcgaccagatcaaggtggtgcaggacctgagcggcgagcacatgggcgccgtgtggaccatgaagttcagccactgcggcagactgctggccagcgccggccaggacaacgtggtgagaatctgggccctgaagaacgccttcgactacttcaacaacatgagaatgaagtacaacaccgagggcagagtgagccccagccccagccaggagagcctgagcagcagcaagagcgacaccgacaccggcgtgtgcagcggcaccgacgaggaccccgacgacaagaacgcccccttcagacagagacccttctgcaagtacaagggccacaccgccgacctgctggacctgagctggagcaagaactacttcctgctgagcagcagcatggacaagaccgtgagactgtggcacatcagcagaagagagtgcctgtgctgcttccagcacatcgacttcgtgaccgccatcgccttccaccccagagacgacagatacttcctgagcggcagcctggacggcaagctgagactgtggaacatccccgacaagaaggtggccctgtggaacgaggtggacggccagaccaagctgatcaccgccgccaacttctgccagaacggcaagtacgccgtgatcggcacctacgacggcagatgcatcttctacgacaccgagcacctgaagtaccacacccagatccacgtgagaagcaccagaggcagaaacaaggtgggcagaaagatcaccggcatcgagcccctgcccggcgagaacaagatcctggtgaccagcaacgacagcagaatcagactgtacgacctgagagacctgagcctgagcatgaagtacaagggctacgtgaacagcagcagccagatcaaggccagcttcagccacgacttcacctacctggtgagcggcagcgaggacaagtacgtgtacatctggagcacctaccacgacctgagcaagttcaccagcgtgagaagagacagaaacgacttctgggagggcatcaaggcccacaacgccgtggtgaccagcgccatcttcgcccccaaccccagcctgatgctgagcctggacgtgcagagcgagaagagcgagggcaacgagaagagcgaggacgccgaggtgctggacgccacccccagcggcatcatgaagaccgacaacaccgaggtgctgctgagcgccgacttcaccggcgccatcaaggtgttcgtgaacaagagaaagaacgtgagctag

SEQ ID NO: 23950 - DNA, 867 bp, Artificial Sequence
  Description of Artificial Sequence: Synthetic coding sequence
tggggcaagaactacttcctgctgagcagcagcatggacaagaccgtgagactgtggcacatcagcagaagagagtgcctgtgctgcttccagcacatcgacttcgtgaccgccatcgccttccaccccagagacgacagatacttcctgagcggcagcctggacggcaagctgagactgtggaacatccccgacaagaaggtggccctgtggaacgaggtggacggccagaccaagctgatcaccgccgccaacttctgccagaacggcaagtacgccgtgatcggcacctacgacggcagatgcatcttctacgacaccgagcacctgaagtaccacacccagatccacgtgagaagcaccagaggcagaaacaaggtgggcagaaagatcaccggcatcgagcccctgcccggcgagaacaagatcctggtgaccagcaacgacagcagaatcagactgtacgacctgagagacctgagcctgagcatgaagtacaagggctacgtgaacagcagcagccagatcaaggccagcttcagccacgacttcacctacctggtgagcggcagcgaggacaagtacgtgtacatctggagcacctaccacgacctgagcaagttcaccagcgtgagaagagacagaaacgacttctgggagggcatcaaggcccacaacgccgtggtgaccagcgccatcttcgcccccaaccccagcctgatgctgagcctggacgtgcagagcgagaagagcgagggcaacgagaagagcgaggacgccgaggtgctggacgccacccccagcggcgccgtggcccacgcctgcaaccccagcaccctgggcggcagaggcagaagaatcacctag

SEQ ID NO: 23951 - DNA, 2475 bp, Artificial Sequence
  Description of Artificial Sequence: Synthetic coding sequence
atggccagcgagagcgacaccgaggagttctacgacgcccccgaggacgtgcacctgggcggcggctaccccgtgggcagccccggcaaggtgggcctgagcaccttcaagatcatcgagagcatcatcgaggagagccagaaggtgctgcagctggaggacgacagcctggacagcaagggcaaggagctgagcgaccaggccaccgccagccccatcgtggccagaaccgacctgagcaacatccccggcctgctggccatcgaccaggtgctgcccgaggagagccagaaggccgagagccagaacaccttcgaggagaccgagctggagctgaagaagtgcttccccagcgacgagacctgcgagaagcccgtggacgagaccaccaagctgacccagaccagcagcaccgagcagctgaacgtgctggagaccgagaccgaggtgctgaacaaggaggccgtggaggtgaagggcggcggcgacgtgctggagcccgtgagcagcgacagcctgagcaccaaggacttcgccgccgtggaggaggtggcccccgccaagccccccagacacctgacccccgagcccgacatcgtggccagcaccaagaagcccgtgcccgccagaccccccccccccaccaacttccccccccccagaccccccccccccagcagacccgcccccccccccagaaagagaaagagcgagctggagttcgagaccctgaagacccccgacatcgacgtgcccaaggagaacatcaccagcgacagcctgctgaccgccagcatggccagcgagagcaccgtgaaggacagccagcccagcctggacctggccagcgccaccagcggcgacaagatcgtgaccgcccaggagaacggcaaggcccccgacggccagaccgtggccggcgaggtgatgggcccccagagacccagaagcaacagcggcagagagctgaccgacgaggagatcctggccagcgtgatgatcaagaacctggacaccggcgaggagatccccctgagcctggccgaggagaagctgcccaccggcatcaaccccctgaccctgcacatcatgagaagaaccaaggagtacgtgagcaacgacgccgcccagagcgacgacgaggagaagctgcagagccagcccaccgacaccgacggcggcagactgaagcagaagaccacccagctgaagaagttcctgggcaagagcgtgaagagagccaagcacctggccgaggagtacggcgagagagccatcaacaaggtgaagagcgtgagagacgaggtgttccacaccgaccaggacgaccccagcagcagcgacgacgagggcatgccctacaccagacccgtgaagttcaaggccgcccacggcttcaagggcccctacgacttcgaccagatcaaggtggtgcaggacctgagcggcgagcacatgggcgccgtgtggaccatgaagttcagccactgcggcagactgctggccagcgccggccaggacaacgtggtgagaatctgggccctgaagaacgccttcgactacttcaacaacatgagaatgaagtacaacaccgagggcagagtgagccccagccccagccaggagagcctgagcagcagcaagagcgacaccgacaccggcgtgtgcagcggcaccgacgaggaccccgacgacaagaacgcccccttcagacagagacccttctgcaagtacaagggccacaccgccgacctgctggacctgagctggagcaagaactacttcctgctgagcagcagcatggacaagaccgtgagactgtggcacatcagcagaagagagtgcctgtgctgcttccagcacatcgacttcgtgaccgccatcgccttccaccccagacacctgaagtaccacacccagatccacgtgagaagcaccagaggcagaaacaaggtgggcagaaagatcaccggcatcgagcccctgcccggcgagaacaagatcctggtgaccagcaacgacagcagaatcagactgtacgacctgagagacctgagcctgagcatgaagtacaagggctacgtgaacagcagcagccagatcaaggccagcttcagccacgacttcacctacctggtgagcggcagcgaggacaagtacgtgtacatctggagcacctaccacgacctgagcaagttcaccagcgtgagaagagacagaaacgacttctgggagggcatcaaggcccacaacgccgtggtgaccagcgccatcttcgcccccaaccccagcctgatgctgagcctggacgtgcagagcgagaagagcgagggcaacgagaagagcgaggacgccgaggtgctggacgccacccccagcggcatcatgaagaccgacaacaccgaggtgctgctgagcgccgacttcaccggcgccatcaaggtgttcgtgaacaagagaaagaacgtgagctag

SEQ ID NO: 23952 - DNA, 2718 bp, Artificial Sequence
  Description of Artificial Sequence: Synthetic coding sequence
atggccagcgagagcgacaccgaggagttctacgacgcccccgaggacgtgcacctgggcggcggctaccccgtgggcagccccggcaaggtgggcctgagcaccttcaaggagaccgagaacaccgcctacaaggtgggcaacgagagccccgtgcaggagctgaagcaggacgtgagcaagaagatcatcgagagcatcatcgaggagagccagaaggtgctgcagctggaggacgacagcctggacagcaagggcaaggagctgagcgaccaggccaccgccagccccatcgtggccagaaccgacctgagcaacatccccggcctgctggccatcgaccaggtgctgcccgaggagagccagaaggccgagagccagaacaccttcgaggagaccgagctggagctgaagaagtgcttccccagcgacgagacctgcgagaagcccgtggacgagaccaccaagctgacccagaccagcagcaccgagcagctgaacgtgctggagaccgagaccgaggtgctgaacaaggaggccgtggaggtgaagggcggcggcgacgtgctggagcccgtgagcagcgacagcctgagcaccaaggacttcgccgccgtggaggaggtggcccccgccaagccccccagacacctgacccccgagcccgacatcgtggccagcaccaagaagcccgtgcccgccagaccccccccccccaccaacttccccccccccagaccccccccccccagcagacccgcccccccccccagaaagagaaagagcgagctggagttcgagaccctgaagacccccgacatcgacgtgcccaaggagaacatcaccagcgacagcctgctgaccgccagcatggccagcgagagcaccgtgaaggacagccagcccagcctggacctggccagcgccaccagcggcgacaagatcgtgaccgcccaggagaacggcaaggcccccgacggccagaccgtggccggcgaggtgatgggcccccagagacccagaagcaacagcggcagagagctgaccgacgaggagatcctggccagcgtgatgatcaagaacctggacaccggcgaggagatccccctgagcctggccgaggagaagctgcccaccggcatcaaccccctgaccctgcacatcatgagaagaaccaaggagtacgtgagcaacgacgccgcccagagcgacgacgaggagaagctgcagagccagcccaccgacaccgacggcggcagactgaagcagaagaccacccagctgaagaagttcctgggcaagagcgtgaagagagccaagcacctggccgaggagtacggcgagagagccatcaacaaggtgaagagcgtgagagacgaggtgttccacaccgaccaggacgaccccagcagcagcgacgacgagggcatgccctacaccagacccgtgaagttcaaggccgcccacggcttcaagggcccctacgacttcgaccagatcaaggtggtgcaggacctgagcggcgagcacatgggcgccgtgtggaccatgaagttcagccactgcggcagactgctggccagcgccggccaggacaacgtggtgagaatctgggccctgaagaacgccttcgactacttcaacaacatgagaatgaagtacaacaccgagggcagagtgagccccagccccagccaggagagcctgagcagcagcaagagcgacaccgacaccggcgtgtgcagcggcaccgacgaggaccccgacgacaagaacgcccccttcagacagagacccttctgcaagtacaagggccacaccgccgacctgctggacctgagctggagcaagaactacttcctgctgagcagcagcatggacaagaccgtgagactgtggcacatcagcagaagagagtgcctgtgctgcttccagcacatcgacttcgtgaccgccatcgccttccaccccagagacgacagatacttcctgagcggcagcctggacggcaagctgagactgtggaacatccccgacaagaaggtggccctgtggaacgaggtggacggccagaccaagctgatcaccgccgccaacttctgccagaacggcaagtacgccgtgatcggcacctacgacggcagatgcatcttctacgacaccgagcacctgaagtaccacacccagatccacgtgagaagcaccagaggcagaaacaaggtgggcagaaagatcaccggcatcgagcccctgcccggcgagaacaagatcctggtgaccagcaacgacagcagaatcagactgtacgacctgagagacctgagcctgagcatgaagtacaagggctacgtgaacagcagcagccagatcaaggccagcttcagcggcagcgaggacaagtacgtgtacatctggagcacctaccacgacctgagcaagttcaccagcgtgagaagagacagaaacgacttctgggagggcatcaaggcccacaacgccgtggtgaccagcgccatcttcgcccccaaccccagcctgatgctgagcctggacgtgcagagcgagaagagcgagggcaacgagaagagcgaggacgccgaggtgctggacgccacccccagcggcatcatgaagaccgacaacaccgaggtgctgctgagcgccgacttcaccggcgccatcaaggtgttcgtgaacaagagaaagaacgtgagctag

SEQ ID NO: 23953 - DNA, 2421 bp, Artificial Sequence
  Description of Artificial Sequence: Synthetic coding sequence
tgaaccgacctgagcaacatccccggcctgctggccatcgaccaggtgctgcccgaggagagccagaaggccgagagccagaacaccttcgaggagaccgagctggagctgaagaagtgcttccccagcgacgagacctgcgagaagcccgtggacgagaccaccaagctgacccagaccagcagcaccgagcagctgaacgtgctggagaccgagaccgaggtgctgaacaaggaggccgtggaggtgaagggcggcggcgacgtgctggagcccgtgagcagcgacagcctgagcaccaaggacttcgccgccgtggaggaggtggcccccgccaagccccccagacacctgacccccgagcccgacatcgtggccagcaccaagaagcccgtgcccgccagaccccccccccccaccaacttccccccccccagaccccccccccccagcagacccgcccccccccccagaaagagaaagagcgagctggagttcgagaccctgaagacccccgacatcgacgtgcccaaggagaacatcaccagcgacagcctgctgaccgccagcatggccagcgagagcaccgtgaaggacagccagcccagcctggacctggccagcgccaccagcggcgacaagatcgtgaccgcccaggagaacggcaaggcccccgacggccagaccgtggccggcgaggtgatgggcccccagagacccagaagcaacagcggcagagagctgaccgacgaggagatcctggccagcgtgatgatcaagaacctggacaccggcgaggagatccccctgagcctggccgaggagaagctgcccaccggcatcaaccccctgaccctgcacatcatgagaagaaccaaggagtacgtgagcaacgacgccgcccagagcgacgacgaggagaagctgcagagccagcccaccgacaccgacggcggcagactgaagcagaagaccacccagctgaagaagttcctgggcaagagcgtgaagagagccaagcacctggccgaggagtacggcgagagagccatcaacaaggtgaagagcgtgagagacgaggtgttccacaccgaccaggacgaccccagcagcagcgacgacgagggcatgccctacaccagacccgtgaagttcaaggccgcccacggcttcaagggcccctacgacttcgaccagatcaaggtggtgcaggacctgagcggcgagcacatgggcgccgtgtggaccatgaagttcagccactgcggcagactgctggccagcgccggccaggacaacgtggtgagaatctgggccctgaagaacgccttcgactacttcaacaacatgagaatgaagtacaacaccgagggcagagtgagccccagccccagccaggagagcctgagcagcagcaagagcgacaccgacaccggcgtgtgcagcggcaccgacgaggaccccgacgacaagaacgcccccttcagacagagacccttctgcaagtacaagggccacaccgccgacctgctggacctgagctggagcaagaactacttcctgctgagcagcagcatggacaagaccgtgagactgtggcacatcagcagaagagagtgcctgtgctgcttccagcacatcgacttcgtgaccgccatcgccttccaccccagagacgacagatacttcctgagcggcagcctggacggcaagctgagactgtggaacatccccgacaagaaggtggccctgtggaacgaggtggacggccagaccaagctgatcaccgccgccaacttctgccagaacggcaagtacgccgtgatcggcacctacgacggcagatgcatcttctacgacaccgagcacctgaagtaccacacccagatccacgtgagaagcaccagaggcagaaacaaggtgggcagaaagatcaccggcatcgagcccctgcccggcgagaacaagatcctggtgaccagcaacgacagcagaatcagactgtacgacctgagagacctgagcctgagcatgaagtacaagggctacgtgaacagcagcagccagatcaaggccagcttcagccacgacttcacctacctggtgagcggcagcgaggacaagtacgtgtacatctggagcacctaccacgacctgagcaagttcaccagcgtgagaagagacagaaacgacttctgggagggcatcaaggcccacaacgccgtggtgaccagcgccatcttcgcccccaaccccagcctgatgctgagcctggacgtgcagagcgagaagagcgagggcaacgagaagagcgaggacgccgaggtgctggacgccacccccagcgccatgagcagcagatacgtggcccaggccggcctggagctgctggccagcaagagatactacgaggacagatag

SEQ ID NO: 23954 - DNA, 1116 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagatgctgcacagaagcaacctgctggccctggtgggcggcggcagcagccccaagttcagcgagatcagcgtgctgatctgggacgacgccagagagggcaaggacagcaaggagaagctggtgctggagttcaccttcaccaagcccgtgctgagcgtgagaatgagacacgacaagatcgtgatcgtgctgaagaacagaatctacgtgtacagcttccccgacaaccccagaaagctgttcgagttcgacaccagagacaaccccaaggccgcccaccccaccccccacctgcacaccctgggcctgtgcgacctgtgccccagcctggagaagcagctgctggtgttccccggccacaagtgcggcagcctgcagctggtggacctggccagcaccaagcccggcaccagcagcgcccccttcaccatcaacgcccaccagagcgacatcgcctgcgtgagcctgaaccagcccggcaccgtggtggccagcgccagccagaagggcaccctgatcagactgttcgacacccagagcaaggagaagctggtggagctgagaagaggcaccgaccccgccaccctgtactgcatcaacttcagccacgacagcagcttcctgtgcgccagcagcgacaagggcaccgtgcacatcttcgccctgaaggacaccagactgaacagaagaagcgccctggccagagtgggcaaggtgggccccatgatcggccagtacgtggacagccagtggagcctggccagcttcaccgtgcccgccgagagcgcctgcatctgcgccttcggcagaaacaccagcaagaacgtgaacagcgtgatcgccatctgcgtggacggcaccttccacaagtacgtgttcacccccgacggcaactgcaacagagaggccttcgacgtgtacctggacatctgcgacgacgacgacttctag

SEQ ID NO: 23955 - DNA, 1086 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagatgctgcacagaagcaacctgctggccctggtgggcggcggcagcagccccaagttcagcgagatcagcgccgtgctgatctgggacgacgccagagagggcaaggacagcaaggagaagctggtgctggagttcaccttcaccaagcccgtgctgagcgtgagaatgagacacgacaagatcgtgatcgtgctgaagaacagaatctacgtgtacagcttccccgacaaccccagaaagctgttcgagttcgacaccagagacaaccccaagggcctgtgcgacctgtgccccagcctggagaagcagctgctggtgttccccggccacaagtgcggcagcctgcagctggtggacctggccagcaccaagcccggcaccagcagcgcccccttcaccatcaacgcccaccagagcgacatcgcctgcgtgagcctgaaccagcccggcaccgtggtggccagcgccagccagaagggcaccctgatcagactgttcgacacccagagcaaggagaagctggtggagctgagaagaggcaccgaccccgccaccctgtactgcatcaacttcagccacgacagcagcttcctgtgcgccagcagcgacaagggcaccgtgcacatcttcgccctgaaggacaccagactgaacagaagaagcgccctggccagagtgggcaaggtgggccccatgatcggccagtacgtggacagccagtggagcctggccagcttcaccgtgcccgccgagagcgcctgcatctgcgccttcggcagaaacaccagcaagaacgtgaacagcgtgatcgccatctgcgtggacggcaccttccacaagtacgtgttcacccccgacggcaactgcaacagagaggccttcgacgtgtacctggacatctgcgacgacgacgacttctag

SEQ ID NO: 23956 - DNA, 1086 bp, Artificial Sequence; identical to SEQ ID NO: 23955
  Description of Artificial Sequence: Synthetic coding sequence

SEQ ID NO: 23957 - DNA, 1083 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagatgctgcacagaagcaacctgctggccctggtgggcggcggcagcagccccaagttcagcgagatcagcgtgctgatctgggacgacgccagagagggcaaggacagcaaggagaagctggtgctggagttcaccttcaccaagcccgtgctgagcgtgagaatgagacacgacaagatcgtgatcgtgctgaagaacagaatctacgtgtacagcttccccgacaaccccagaaagctgttcgagttcgacaccagagacaaccccaagggcctgtgcgacctgtgccccagcctggagaagcagctgctggtgttccccggccacaagtgcggcagcctgcagctggtggacctggccagcaccaagcccggcaccagcagcgcccccttcaccatcaacgcccaccagagcgacatcgcctgcgtgagcctgaaccagcccggcaccgtggtggccagcgccagccagaagggcaccctgatcagactgttcgacacccagagcaaggagaagctggtggagctgagaagaggcaccgaccccgccaccctgtactgcatcaacttcagccacgacagcagcttcctgtgcgccagcagcgacaagggcaccgtgcacatcttcgccctgaaggacaccagactgaacagaagaagcgccctggccagagtgggcaaggtgggccccatgatcggccagtacgtggacagccagtggagcctggccagcttcaccgtgcccgccgagagcgcctgcatctgcgccttcggcagaaacaccagcaagaacgtgaacagcgtgatcgccatctgcgtggacggcaccttccacaagtacgtgttcacccccgacggcaactgcaacagagaggccttcgacgtgtacctggacatctgcgacgacgacgacttctag

SEQ ID NO: 23958 - DNA, 168 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagtag

SEQ ID NO: 23959 - DNA, 477 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagatgctgcacagaagcaacctgctggccctggtgggcggcggcagcagccccaagttcagcgagatcagcgtgctgatctgggacgacgccagagagggcaaggacagcaaggagaagctggtgctggagttcaccttcaccaagcccgtgctgagcgtgagaatgagacacgacaagatcgtgatcgtgctgaagaacagaatctacgtgtacagcttccccgacaaccccagaaagctgttcgagttcgacaccagagacaaccccaaggccgcccaccccaccccccacctgcacaccctgggcctgtag

SEQ ID NO: 23960 - DNA, 879 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctgggcctgtgcgacctgtgccccagcctggagaagcagctgctggtgttccccggccacaagtgcggcagcctgcagctggtggacctggccagcaccaagcccggcaccagcagcgcccccttcaccatcaacgcccaccagagcgacatcgcctgcgtgagcctgaaccagcccggcaccgtggtggccagcgccagccagaagggcaccctgatcagactgttcgacacccagagcaaggagaagctggtggagctgagaagaggcaccgaccccgccaccctgtactgcatcaacttcagccacgacagcagcttcctgtgcgccagcagcgacaagggcaccgtgcacatcttcgccctgaaggacaccagactgaacagaagaagcgcctacgtgagacccctgcacaccctgctgagcgccctggtggtggccgtggccctgggcgtgctggtgtgggccgccgagaccagagccgccgtgagaagatgcagaagaagccaccccgccgcctgcctggccgccgtgctggccgtgggcctgctggtgctgtgggtggccggcggcgcctgcaccttcctgttcagcatcgccggccccgtgctgctgatcctggtgcacgccagcctgagactgagaaacctgaagaacaagatcgagaacaagatcgagagcatcggcctgaagagaacccccatgggcctgctgctggaggccctgggccaggagcaggaggccggcagctag

SEQ ID NO: 23961 - DNA, 630 bp, Artificial Sequence
  Description of Artificial Sequence: Synthetic coding sequence
atggacagcgacgagaccggcttcgagcacagcggcctgtgggtgagcgtgctggccggcctgctgctgggcgcctgccaggcccaccccatccccgacagcagccccctgctgcagttcggcggccaggtgagacagagatacctgtacaccgacgacgcccagcagaccgaggcccacctggagatcagagaggacggcaccgtgggcggcgccgccgaccagagccccgagagcctgctgcagctgaaggccctgaagcccggcgtgatccagatcctgggcgtgaagaccagcagattcctgtgccagagacccgacggcgccctgtacggcagcctgcacttcgaccccgaggcctgcagcttcagagagctgctgctggaggacggctacaacgtgtaccagagcgaggcccacggcctgcccctgcacctgcccggcaacaagagcccccacagagaccccgcccccagaggccccgccagattcctgcccctgcccggcctgccccccgccctgcccgagccccccggcatcctggccccccagccccccgacgtgggcagcagcgaccccctgagcatggtgggccccagccagggcagaagccccagctacgccagctag

SEQ ID NO: 23962 - DNA, 321 bp, Artificial Sequence
  Description of Artificial Sequence: Synthetic coding sequence
atgagcaccaacaacatgagcgaccccagaagacccaacaaggtgctgagatacaagcccccccccagcgagtgcaaccccgccctggacgaccccacccccgactacatgaacctgctgggcatgatcttcagcatgtgcggcctgatgctgaagctgaagtggtgcgcctgggtggccgtgtactgcagcttcatcagcttcgccaacagcagaagcagcgaggacaccaagcagatgatgagcagcttcatgctgagcatcagcgccgtggtgatgagctacctgcagaacccccagcccatgacccccccctggtag

SEQ ID NO: 23963 - DNA, 2061 bp, Artificial Sequence
  Description of Artificial Sequence: Synthetic coding sequence
atgagcttccccagaggcagccagacccagaagatcaagcaccccatcggcaccagaaagggccccctggaggtgcccccccccaccgagaaggactggcccaaggacgacgagcaggaccacgtgctggtggaccccgacgaggagctggacagcctgccccagccctacagaatgatcaacaagctggtgaacctgctgttcgaccagagctgggagatcatcgaggagagaaacgccctgagagaggccgagagcagccagatccagcccaccgtgtacccccccctgggcgagatccagctgaacaagatgcccaactgcatggccgtgagccaggactacgtgttcatcggcggcgccaagggcttcagcatctacaacctgtacagcgccaagcagatctacgcctgggagaagctgaaggtggacgtgaccagcatctgggccaccgacctgggcaacgagatcctgatcgcccccgtggacgagatgggcatcatcagactgttctacttctacaaggagggcctgtacctggtgaaggccatcaacgaggtggacgacaccagcaagcagaccacctgcatcaagatggagatcagccagggcggcgacttcgccgccttcctgctgcagggcgccggcgacatctggctggacgtgtacaagctgcccaaggagacctggctgaagaagctggagcacccccagctgaccagcaaccccaagaagaaggtgagacagccccagctgaacagcctgggccccatcagcgccgaccccctggagatggacgccaacgtgagcttcaagggcgacatcaagctgagcctgcccgtgtacatcatgaagatcaagccccccaagcccgtgaccggcaccaccttcaagagccccctggaggtgttcgccaagatcaaggactgctacggcctgggcagcggccagaaccacttcatcaaggacagccagtgggagcagcaggccgagatcttcaacgccagctacaagaagtacctggacagagagtgggaggaggagcccctgagcaccgccaccttctacttcctgctgcccagctgcctgttcgccatgccccccgaggtgaagggccccagcggcatggcctgcgtgctgggcatccactggaccagaagccacaacttcttcctgtacagcctgaacagaaccctgaaggacaaggccgaccccgagggcgtgtggccctgcgccgcccccatcgccgtgagccagctgagctgcagcagcagctacctggtgctggcctgcgaggacggcgtgctgaccctgtgggacctggccaagggcttccccctgggcgtggccgccctgccccagggctgcttctgccagagcatccacttcctgaagtacttcagcgtgcacaagggccagaacatgtaccccgagggccaggtgaagagccagatgaagtgcgtggtgctgtgcaccgacgccagcctgcacctggtggaggccagcggcacccagggccccaccatcagcgtgctggtggagagacccgtgaagcacctggacaagaccatctgcgccgtggcccccgtgcccgccctgcccggcatggtgctgatcttcagcaagaacggcagcgtgtgcctgatggacgtggccaagagagagatcatctgcgccttcgccccccccggcgccttccccctggaggtgccctggaagcccgtgttcgccgtgagccccgaccacccctgcttcctgctgagaggcgactacagccacgagaccgccagcaccgacgacgccggcatccagtacagcgtgttctacttcaacttcgaggcctgccccctgctggagaacatcagcaagaactgcaccatcccccagagagacctggacaacatggccttcccccaggccctgcccctggagaagagatgcgagagattcctgcagaagagctacagaaagctggagaagaaccccgagaaggaggaggagcactgggccagactgcagagatacagcctgagcctgcagagagagaacttcaagaagtag

SEQ ID NO: 23964 - DNA, 1977 bp, Artificial Sequence
  Description of Artificial Sequence: Synthetic coding sequence
atgagcttccccagaggcagccagacccagaagatcaagcaccccatcggcaccagaaagggccccctggaggtgcccccccccaccgagaaggactggcccaaggacgacgagcaggaccacgtgctggtggaccccgacgaggagctggacagcctgccccagccctacagaatgatcaacaagctggtgaacctgctgttcgaccagagctgggagatcatcgaggagagaaacgccctgagagaggccgagagcagccagatccagcccaccgtgtacccccccctgggcgagatccagctgaacaagatgcccaactgcatggccgtgagccaggactacgtgttcatcggcggcgccaagggcttcagcatctacaacctgtacagcgccaagcagatctacgcctgggagaagctgaaggtggacgtgaccagcatctgggccaccgacctgggcaacgagatcctgatcgcccccgtggacgagatgggcatcatcagactgttctacttctacaaggagggcctgtacctggtgaaggccatcaacgaggtggacgacaccagcaagcagaccacctgcatcaagatggagatcagccagggcggcgacttcgccgccttcctgctgcagggcgccggcgacatctggctggacgtgtacaagctgcccaaggagacctggctgaagaagctggagcacccccagctgaccagcaaccccaagaagaaggtgagacagccccagctgaacagcctgggccccatcagcgccgaccccctggagatggacgccaacgtgagcttcaagggcgacatcaagctgagcctgcccgtgtacatcatgaagatcaagccccccaagcccgtgaccggcaccaccttcaagagccccctggaggtgttcgccaagatcaaggactgctacggcctgggcagcggccagaaccacttcatcaaggacagccagtgggagcagcaggccgagatcttcaacgccagctacaagaagtacctggacagagagtgggaggaggagcccctgagcaccgccaccttctacttcctgctgcccagctgcctgttcgccatgccccccgaggtgaagggccccagcggcatggcctgcgtgctgggcatccactggaccagaagccacaacttcttcctgtacagcctgaacagaaccctgaaggacaaggccgaccccgagggcgtgtggccctgcgccgcccccatcgccgtgagccagctgagctgcagcagcagctacctggtgctggcctgcgaggacggcgtgctgaccctgtgggacctggccaagggccagaacatgtaccccgagggccaggtgaagagccagatgaagtgcgtggtgctgtgcaccgacgccagcctgcacctggtggaggccagcggcacccagggccccaccatcagcgtgctggtggagagacccgtgaagcacctggacaagaccatctgcgccgtggcccccgtgcccgccctgcccggcatggtgctgatcttcagcaagaacggcagcgtgtgcctgatggacgtggccaagagagagatcatctgcgccttcgccccccccggcgccttccccctggaggtgccctggaagcccgtgttcgccgtgagccccgaccacccctgcttcctgctgagaggcgactacagccacgagaccgccagcaccgacgacgccggcatccagtacagcgtgttctacttcaacttcgaggcctgccccctgctggagaacatcagcaagaactgcaccatcccccagagagacctggacaacatggccttcccccaggccctgcccctggagaagagatgcgagagattcctgcagaagagctacagaaagctggagaagaaccccgagaaggaggaggagcactgggccagactgcagagatacagcctgagcctgcagagagagaacttcaagaagtag

SEQ ID NO: 23965 - DNA, 1341 bp, Artificial Sequence
  Description of Artificial Sequence: Synthetic coding sequence
atggaggccgaggccgccgacgccccccccggcggcgtggagagcgccctgagctgcttcagcttcaaccaggactgcaccagcctggccaccggcaccaaggccggctacaagctgttcagcctgagcagcgtggagcagctggaccaggtgcacggcagcaacgagatccccgacgtgtacatcgtggagagactgttcagcagcagcctggtggtggtggtgagccacaccaagcccagacagatgaacgtgtaccacttcaagaagggcaccgagatctgcaactacagctacagcagcaacatcctgagcatcagactgaacagacagagactgctggtgtgcctggaggagagcatctacatccacaacatcaaggacatgaagctgctgaagaccctgctggacatccccgccaaccccaccggcctgtgcgccctgagcatcaaccacagcaacagctacctggcctaccccggcagcctgaccagcggcgagatcgtgctgtacgacggcaacagcctgaagaccgtgtgcaccatcgccgcccacgagggcaccctggccgccatcaccttcaacgccagcggcagcaagctggccagcgccagcgagaagggcaccgtgatcagagtgttcagcgtgcccgacggccagaagctgtacgagttcagaagaggcatgaagagatacgtgaccatcagcagcctggtgttcagcatggacagccagttcctgtgcgccagcagcaacaccgagaccgtgcacatcttcaagctggagcaggtgaccaacagcagacccgaggagcccagcacctggagcggctacatgggcaagatgttcatggccgccaccaactacctgcccacccaggtgagcgacatgatgcaccaggacagagccttcgccaccgccagactgaacttcagcggccagagaaacatctgcaccctgagcaccatccagaagctgcccagactgctggtggccagcagcagcggccacctgtacatgtacaacctggacccccaggacggcggcgagtgcgtgctgatcaagacccacagcctgctgggcagcggcaccaccgaggagaacaaggagaacgacctgagacccagcctgccccagagctacgccgccaccgtggccagacccagcgccagcagcgccagcaccgtgcccggctacagcgaggacggcggcgccctgagaggcgaggtgatccccgagcacgagttcgccaccggccccgtgtgcctggacgacgagaacgagttcccccccatcatcctgtgcagaggcaaccagaagggcaagaccaagcagagctag

SEQ ID NO: 23966 - DNA, 1095 bp, Artificial Sequence
  Description of Artificial Sequence: Synthetic coding sequence
atgaacgtgtaccacttcaagaagggcaccgagatctgcaactacagctacagcagcaacatcctgagcatcagactgaacagacagagactgctggtgtgcctggaggagagcatctacatccacaacatcaaggacatgaagctgctgaagaccctgctggacatccccgccaaccccaccggcctgtgcgccctgagcatcaaccacagcaacagctacctggcctaccccggcagcctgaccagcggcgagatcgtgctgtacgacggcaacagcctgaagaccgtgtgcaccatcgccgcccacgagggcaccctggccgccatcaccttcaacgccagcggcagcaagctggccagcgccagcgagaagggcaccgtgatcagagtgttcagcgtgcccgacggccagaagctgtacgagttcagaagaggcatgaagagatacgtgaccatcagcagcctggtgttcagcatggacagccagttcctgtgcgccagcagcaacaccgagaccgtgcacatcttcaagctggagcaggtgaccaacagcagacccgaggagcccagcacctggagcggctacatgggcaagatgttcatggccgccaccaactacctgcccacccaggtgagcgacatgatgcaccaggacagagccttcgccaccgccagactgaacttcagcggccagagaaacatctgcaccctgagcaccatccagaagctgcccagactgctggtggccagcagcagcggccacctgtacatgtacaacctggacccccaggacggcggcgagtgcgtgctgatcaagacccacagcctgctgggcagcggcaccaccgaggagaacaaggagaacgacctgagacccagcctgccccagagctacgccgccaccgtggccagacccagcgccagcagcgccagcaccgtgcccggctacagcgaggacggcggcgccctgagaggcgaggtgatccccgagcacgagttcgccaccggccccgtgtgcctggacgacgagaacgagttcccccccatcatcctgtgcagaggcaaccagaagggcaagaccaagcagagctag

SEQ ID NO: 23967 - DNA, 1365 bp, Artificial Sequence
  Description of Artificial Sequence: Synthetic coding sequence
atgaacctggccagccagagcggcgaggccggcgccggccagctgctgttcgccaacttcaaccaggacaacaccgaggtgaagggcgccagcagagccgccggcctgggcagaagagccgtggtgtggagcctggccgtgggcagcaagagcggctacaagttcttcagcctgagcagcgtggacaagctggagcagatctacgagtgcaccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaagggcacctacgtgcccagcagccccaccagactggcctacaccgacgacctgggcgccgtgggcggcgcctgcctggaggacgaggccagcgccctgagactggacgaggacagcgagcacccccccatgatcctgagaaccgactag

SEQ ID NO: 23968 - DNA, 1314 bp, Artificial Sequence
  Description of Artificial Sequence: Synthetic coding sequence
atgctgctgagactgcagagaatcaagaccctgagaccccccggctgcccccaccccatgaccacctgcagcgccggcaccctgagcgccgtgccctgcgtgagccccagacaggtgttcgtgttcgagagaagattctgcctgtggagccacgtggagatgttcacccacgtgctgcccttcgtgatcagcgccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaaggcctacaccgacgacctgggcgccgtgggcggcgcctgcctggaggacgaggccagcgccctgagactggacgaggacagcgagcacccccccatgatcctgagaaccgactag

SEQ ID NO: 23969 - DNA, 1278 bp, Artificial Sequence
  Description of Artificial Sequence: Synthetic coding sequence
atgaacctggccagccagagcggcgaggccggcgccggccagctgctgttcgccaacttcaaccaggacaacaccagcctggccgtgggcagcaagagcggctacaagttcttcagcctgagcagcgtggacaagctggagcagatctacgagtgcaccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaaggcctacaccgacgacctgggcgccgtgggcggcgcctgcctggaggacgaggccagcgccctgagactggacgaggacagcgagcacccccccatgatcctgagaaccgactag

SEQ ID NO: 23970 - DNA, 1311 bp, Artificial Sequence
  Description of Artificial Sequence: Synthetic coding sequence
atgaacctggccagccagagcggcgaggccggcgccggccagctgctgttcgccaacttcaaccaggacaacaccagcctggccgtgggcagcaagagcggctacaagttcttcagcctgagcagcgtggacaagctggagcagatctacgagtgcaccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaagggcacctacgtgcccagcagccccaccagactggcctacaccgacgacctgggcgccgtgggcggcgcctgcctggaggacgaggccagcgccctgagactggacgaggacagcgagcacccccccatgatcctgagaaccgactag

SEQ ID NO: 23971 - DNA, 1332 bp, Artificial Sequence
  Description of Artificial Sequence: Synthetic coding sequence
atgaacctggccagccagagcggcgaggccggcgccggccagctgctgttcgccaacttcaaccaggacaacaccgaggtgaagggcgccagcagagccgccggcctgggcagaagagccgtggtgtggagcctggccgtgggcagcaagagcggctacaagttcttcagcctgagcagcgtggacaagctggagcagatctacgagtgcaccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaaggcctacaccgacgacctgggcgccgtgggcggcgcctgcctggaggacgaggccagcgccctgagactggacgaggacagcgagcacccccccatgatcctgagaaccgactag

SEQ ID NO: 23972 - DNA, 1155 bp, Artificial Sequence
  Description of Artificial Sequence: Synthetic coding sequence
atgttcacccacgtgctgcccttcgtgatcagcgccgacaccgaggacgtgtgcatcgtggagagactgttcagcagcagcctggtggccatcgtgagcctgaaggcccccagaaagctgaaggtgtgccacttcaagaagggcaccgagatctgcaactacagctacagcaacaccatcctggccgtgaagctgaacagacagagactgatcgtgtgcctggaggagagcctgtacatccacaacatcagagacatgaaggtgctgcacaccatcagagagaccccccccaaccccgccggcctgtgcgccctgagcatcaacaacgacaactgctacctggcctaccccggcagcgccaccatcggcgaggtgcaggtgttcgacaccatcaacctgagagccgccaacatgatccccgcccacgacagccccctggccgccctggccttcgacgccagcggcaccaagctggccaccgccagcgagaagggcaccgtgatcagagtgttcagcatccccgagggccagaagctgttcgagttcagaagaggcgtgaagagatgcgtgagcatctgcagcctggccttcagcatggacggcatgttcctgagcgccagcagcaacaccgagaccgtgcacatcttcaagctggagaccgtgaaggagaagccccccgaggagcccaccacctggaccggctacttcggcaaggtgctgatggccagcaccagctacctgcccagccaggtgaccgagatgttcaaccagggcagagccttcgccaccgtgagactgcccttctgcggccacaagaacatctgcagcctggccaccatccagaagatccccagactgctggtgggcgccgccgacggctacctgtacatgtacaacctggacccccaggagggcggcgagtgcgccctgatgaagcagcacagactggacggcagcctggagaccaccaacgagatcctggacagcgccagccacgactgccccctggtgacccagacctacggcgccgccgccggcaaggcctacaccgacgacctgggcgccgtgggcggcgcctgcctggaggacgaggccagcgccctgagactggacgaggacagcgagcacccccccatgatcctgagaaccgactag

SEQ ID NO: 23973 - DNA, 1035 bp, Artificial Sequence
  Description of Artificial Sequence: Synthetic coding sequence
atgaacctgctgccctgcaacccccacggcaacggcctgctgtacgccggcttcaaccaggaccacggctgcttcgcctgcggcatggagaacggcttcagagtgtacaacaccgaccccctgaaggagaaggagaagcaggagttcctggagggcggcgtgggccacgtggagatgctgttcagatgcaactacctggccctggtgggcggcggcaagaagcccaagtacccccccaacaaggtgatgatctgggacgacctgaagaagaagaccgtgatcgagatcgagttcagcaccgaggtgaaggccgtgaagctgagaagagacagaatcgtggtggtgctggacagcatgatcaaggtgttcaccttcacccacaacccccaccagctgcacgtgttcgagacctgctacaaccccaagggcctgtgcgtgctgtgccccaacagcaacaacagcctgctggccttccccggcacccacaccggccacgtgcagctggtggacctggccagcaccgagaagccccccgtggacatccccgcccacgagggcgtgctgagctgcatcgccctgaacctgcagggcaccagaatcgccaccgccagcgagaagggcaccctgatcagaatcttcgacaccagcagcggccacctgatccaggagctgagaagaggcagccaggccgccaacatctactgcatcaacttcaaccaggacgccagcctgatctgcgtgagcagcgaccacggcaccgtgcacatcttcgccgccgaggaccccaagagaaacaagcagagcagcctggccagcgccagcttcctgcccaagtacttcagcagcaagtggagcttcagcaagttccaggtgcccagcggcagcccctgcatctgcgccttcggcaccgagcccaacgccgtgatcgccatctgcgccgacggcagctactacaagttcctgttcaaccccaagggcgagtgcatcagagacgtgtacgcccagttcctggagatgaccgacgacaagctgtag

SEQ ID NO: 23974 - DNA, 951 bp, Artificial Sequence
  Description of Artificial Sequence: Synthetic coding sequence
atggagaacggcttcagagtgtacaacaccgaccccctgaaggagaaggagaagcaggagttcctggagggcggcgtgggccacgtggagatgctgttcagatgcaactacctggccctggtgggcggcggcaagaagcccaagtacccccccaacaaggtgatgatctgggacgacctgaagaagaagaccgtgatcgagatcgagttcagcaccgaggtgaaggccgtgaagctgagaagagacagaatcgtggtggtgctggacagcatgatcaaggtgttcaccttcacccacaacccccaccagctgcacgtgttcgagacctgctacaaccccaagggcctgtgcgtgctgtgccccaacagcaacaacagcctgctggccttccccggcacccacaccggccacgtgcagctggtggacctggccagcaccgagaagccccccgtggacatccccgcccacgagggcgtgctgagctgcatcgccctgaacctgcagggcaccagaatcgccaccgccagcgagaagggcaccctgatcagaatcttcgacaccagcagcggccacctgatccaggagctgagaagaggcagccaggccgccaacatctactgcatcaacttcaaccaggacgccagcctgatctgcgtgagcagcgaccacggcaccgtgcacatcttcgccgccgaggaccccaagagaaacaagcagagcagcctggccagcgccagcttcctgcccaagtacttcagcagcaagtggagcttcagcaagttccaggtgcccagcggcagcccctgcatctgcgccttcggcaccgagcccaacgccgtgatcgccatctgcgccgacggcagctactacaagttcctgttcaaccccaagggcgagtgcatcagagacgtgtacgcccagttcctggagatgaccgacgacaagctgtag

SEQ ID NO: 23975 - DNA, 1395 bp, Artificial Sequence
  Description of Artificial Sequence: Synthetic coding sequence
atggccctggtggccctggtggccggcgccagactgggcagaagactgagcggccccggcctgggcagaggccactggaccgccgccagaagaagcagaagcagaagagaggccgccgaggccgaggccgaggtgcccgtggtgcagtacgtgggcgagagagccgccagagccgacagagtgttcgtgtggggcttcagcttcagcggcgccctgggcgtgcccagcttcgtggtgcccagcagcggccccggccccagagccggcgccagacccagaagaagaatccagcccgtgccctacagactggagctggaccagaagatcagcagcgccgcctgcggctacggcttcaccctgctgagcagcaagaccgccgacgtgaccaaggtgtggggcatgggcctgaacaaggacagccagctgggcttccacagaagcagaaaggacaagaccagaggctacgagtacgtgctggagcccagccccgtgagcctgcccctggacagaccccaggagaccagagtgctgcaggtgagctgcggcagagcccacagcctggtgctgaccgacagagagggcgtgttcagcatgggcaacaacagctacggccagtgcggcagaaaggtggtggagaacgagatctacagcgagagccacagagtgcacagaatgcaggacttcgacggccaggtggtgcaggtggcctgcggccaggaccacagcctgttcctgaccgacaagggcgaggtgtacagctgcggctggggcgccgacggccagaccggcctgggccactacaacatcaccagcagccccaccaagctgggcggcgacctggccggcgtgaacgtgatccaggtggccacctacggcgactgctgcctggccgtgagcgccgacggcggcctgttcggctggggcaacagcgagtacctgcagctggccagcgtgaccgacagcacccaggtgaacgtgcccagatgcctgcacttcagcggcgtgggcaaggtgagacaggccgcctgcggcggcaccggctgcgccgtgctgaacggcgagggccacgtgttcgtgtggggctacggcatcctgggcaagggccccaacctggtggagagcgccgtgcccgagatgatcccccccaccctgttcggcctgaccgagttcaaccccgagatccaggtgagcagaatcagatgcggcctgagccacttcgccgccctgaccaacaagggcgagctgttcgtgtggggcaagaacatcagaggctgcctgggcatcggcagactggaggaccagtacttcccctggagagtgaccatgcccggcgagcccgtggacgtggcctgcggcgtggaccacatggtgaccctggccaagagcttcatctag

SEQ ID NO: 23976 - DNA, 1365 bp, Artificial Sequence
  Description of Artificial Sequence: Synthetic coding sequence
atggccctggtggccctggtggccggcgccagactgggcagaagactgagcggccccggcctgggcagaggccactggaccgccgccagaagaagcagaagcagaagagaggccgccgaggccgaggccgaggtgcccgtggtgcagtacgtgggcgagagagccgccagagccgacagagtgttcgtgtggggcttcagcttcagcggcgccctgggcgtgcccagcttcgtggtgcccagcagcggccccggccccagagccggcgccagacccagaagaagaatccagcccgtgccctacagactggagctggaccagaagatcagcagcgccgcctgcggctacggcttcaccctgctgagcagcaagaccgccgacgtgaccaaggtgtggggcatgggcctgaacaaggacagccagctgggcttccacagaagcagaaaggacaagaccagaggctacgagtacgtgctggagcccagccccgtgagcctgcccctggacagaccccaggagaccagagtgctgcaggtgagctgcggcagagcccacagcctggtgctgaccgacagagagggcgtgttcagcatgggcaacaacagctacggccagtgcggcagaaaggtggtggagaacgagatctacagcgagagccacagagtgcacagaatgcaggacttcgacggccaggtggtgcaggtggcctgcggccaggaccacagcctgttcctgaccgacaagggcgaggtgtacagctgcggctggggcgccgacggccagaccggcctgggccactacaacatcaccagcagccccaccaagctgggcggcgacctggccggcgtgaacgtgatccaggtggccacctacggcgactgctgcctggccgtgagcgccgacggcggcctgttcggctggggcaacagcgagtacctgcagctggccagcgtgaccgacagcacccaggtgaacgtgcccagatgcctgcacttcagcggcgtgggcaaggtgagacaggccgcctgcggcggcaccggctgcgccgtgctgaacggcgagggccacgtgttcgtgtggggctacggcatcctgggcaagggccccaacctggtggagagcgccgtgcccgagatgatcccccccaccctgttcggcctgaccgagttcaaccccgagatccaggtgagcagaatcagatgcggcctgagccacttcgccgccctgaccaacaagggcgagctgttcgtgtggggcaagaacatcagaggctgcctgggcatcggcagactggaggaccagtacttcccctggagagcccccgcccccagcgccagcgccaagaccaccggccccctgctgtag

SEQ ID NO: 23977 - DNA, 1077 bp, Artificial Sequence
  Description of Artificial Sequence: Synthetic coding sequence
atggccctggtggccctggtggccggcgccagactgggcagaagactgagcggccccggcctgggcagaggccactggaccgccgccagaagaagcagaagcagaagagaggccgccgaggccgaggccgaggtgcccgtggtgcagtacgtgggcgagagagccgccagagccgacagagtgttcgtgtggggcttcagcttcagcggcgccctgggcgtgcccagcttcgtggtgcccagcagcggccccggccccagagccggcgccagacccagaagaagaatccagcccgtgccctacagactggagctggaccagaagatcagcagcgccgcctgcggctacggcttcaccctgctgagcagcaagaccgccgacgtgaccaaggtgtggggcatgggcctgaacaaggacagccagctgggcttccacagaagcagaaaggacaagaccagaggctacgagtacgtgctggagcccagccccgtgagcctgcccctggacagaccccaggagaccagagtgctgcaggtgagctgcggcagagcccacagcctggtgctgaccgacagagagggcgtgttcagcatgggcaacaacagctacggccagtgcggcagaaaggtggtggagaacgagatctacagcgagagccacagagtgcacagaatgcaggacttcgacggccaggtggtgcaggtggcctgcggccaggaccacagcctgttcctgaccgacaagggcgaggtgtacagctgcggctggggcgccgacggccagaccggcctgggccactacaacatcaccagcagccccaccaagctgggcggcgacctggccggcgtgaacgtgatccaggtggccacctacggcgactgctgcctggccgtgagcgccgacggcggcctgttcggctggggcaacagcgagtacctgcagctggccagcgtgaccgacagcacccaggtgaacgtgcccagatgcctgcacttcagcggcgtgggcaaggtgagacaggccgcctgcggcggcaccggctgcgccgtgctgaacgacacctggccccagagctag

SEQ ID NO: 23978 - DNA, 1797 bp, Artificial Sequence
  Description of Artificial Sequence: Synthetic coding sequence
atggccagcctgagaagagtgaaggtgctgctggtgctgaacctgatcgccgtggccggcttcgtgctgttcctggccaagtgcagacccatcgccgtgagaagcggcgacgccttccacgagatcagacccagagccgaggtggccaacctgagcgcccacagcgccagccccatccaggacgccgtgctgaagagactgagcctgctggaggacatcgtgtacagacagctgaacggcctgagcaagagcctgggcctgatcgagggctacggcggcagaggcaagggcggcctgcccgccaccctgagccccgccgaggaggagaaggccaagggcccccacgagaagtacggctacaacagctacctgagcgagaagatcagcctggacagaagcatccccgactacagacccaccaagtgcaaggagctgaagtacagcaaggacctgccccagatcagcatcatcttcatcttcgtgaacgaggccctgagcgtgatcctgagaagcgtgcacagcgccgtgaaccacacccccacccacctgctgaaggagatcatcctggtggacgacaacagcgacgaggaggagctgaaggtgcccctggaggagtacgtgcacaagagataccccggcctggtgaaggtggtgagaaaccagaagagagagggcctgatcagagccagaatcgagggctggaaggtggccaccggccaggtgaccggcttcttcgacgcccacgtggagttcaccgccggctgggccgagcccgtgctgagcagaatccaggagaacagaaagagagtgatcctgcccagcatcgacaacatcaagcaggacaacttcgaggtgcagagatacgagaacagcgcccacggctacagctgggagctgtggtgcatgtacatcagcccccccaaggactggtgggacgccggcgaccccagcctgcccatcagaacccccgccatgatcggctgcagcttcgtggtgaacagaaagttcttcggcgagatcggcctgctggaccccggcatggacgtgtacggcggcgagaacatcgagctgggcatcaaggtgtggctgtgcggcggcagcatggaggtgctgccctgcagcagagtggcccacatcgagagaaagaagaagccctacaacagcaacatcggcttctacaccaagagaaacgccctgagagtggccgaggtgtggatggacgactacaagagccacgtgtacatcgcctggaacctgcccctggagaaccccggcatcgacatcggcgacgtgagcgagagaagagccctgagaaagagcctgaagtgcaagaacttccagtggtacctggaccacgtgtaccccgagatgagaagatacaacaacaccgtggcctacggcgagctgagaaacaacaaggccaaggacgtgtgcctggaccagggccccctggagaaccacaccgccatcctgtacccctgccacggctggggcccccagctggccagatacaccaaggagggcttcctgcacctgggcgccctgggcaccaccaccctgctgcccgacaccagatgcctggtggacaacagcaagagcagactgccccagctgctggactgcgacaaggtgaagagcagcctgtacaagagatggaacttcatccagaacggcgccatcatgaacaagggcaccggcagatgcctggaggtggagaacagaggcctggccggcatcgacctgatcctgagaagctgcaccggccagagatggaccatcaagaacagcatcaagtag

SEQ ID NO: 23979 - DNA, 1728 bp, Artificial Sequence
  Description of Artificial Sequence: Synthetic coding sequence
atggccaagcccttcttcagactgcagaagttcctgagaagaacccagttcctgctgttcttcctgaccgccgcctacctgatgaccggcagcctgctgctgctgcagagagtgagagtggccctgccccagggccccagagcccccggccccctgcagaccctgcccgtggccgccgtggccctgggcgtgggcctgctggacagcagagccctgcacgaccccagagtgagccccgagctgctgctgggcgtggacatgctgcagagccccctgaccagacccagacccggccccagatggctgagaagcagaaacagcgagctgagacagctgagaagaagatggttccaccacttcatgagcgacagccagggcccccccgccctgggccccgaggccgccagacccgccatccacagcagaggcacctacatcggctgcttcagcgacgacggccacgagagaaccctgaagggcgccgtgttctacgacctgagaaagatgaccgtgagccactgccaggacgcctgcgccgagagaagctacgtgtacgccggcctggaggccggcgccgagtgctactgcggcaacagactgcccgccgtgagcgtgggcctggaggagtgcaaccacgagtgcaagggcgagaagggcagcgtgtgcggcgccgtggacagactgagcgtgtacagagtggacgagctgcagcccggcagcagaaagagaagaaccgccacctacagaggctgcttcagactgcccgagaacatcacccacgccttccccagcagcctgatccaggccaacgtgaccgtgggcacctgcagcggcttctgcagccagaaggagttccccctggccatcctgagaggctgggagtgctactgcgcctaccccacccccagattcaacctgagagacgccatggacagcagcgtgtgcggccaggaccccgaggcccagagactggccgagtactgcgaggtgtaccagacccccgtgcaggacaccagatgcaccgacagaagattcctgcccaacaagagcaaggtgttcgtggccctgagcagcttccccggcgccggcaacacctgggccagacacctgatcgagcacgccaccggcttctacaccggcagctactacttcgacggcaccctgtacaacaagggcttcaagggcgagaaggaccactggagaagcagaagaaccatctgcgtgaagacccacgagagcggcagaagagagatcgagatgttcgacagcgccatcctgctgatcagaaacccctacagaagcctggtggccgagttcaacagaaagtgcgccggccacctgggctacgccgccgacagaaactggaagagcaaggagtggcccgacttcgtgaacagctacgccagctggtggagcagccacgtgctggactggctgaagtacggcaagagactgctggtggtgcactacgaggagctgagaagaagcctggtgcccaccctgagagagatggtggccttcctgaacgtgagcgtgagcgaggagagactgctgtgcgtggagaacaacaaggagggcagcttcagaagaagaggcagaagaagccacgaccccgagcccttcacccccgagatgaaggacctgatcaacggctacatcagaaccgtggaccaggccctgagagaccacaactggaccggcctgcccagagagtacgtgcccagatag

SEQ ID NO: 23980 - DNA, 1728 bp, Artificial Sequence; identical to SEQ ID NO: 23979
  Description of Artificial Sequence: Synthetic coding sequence

SEQ ID NO: 23981 - DNA, 1758 bp, Artificial Sequence
  Description of Artificial Sequence: Synthetic coding sequence
atggccaagctgtggttcaagttccagagatacttcagaagaaagcccgtgagattcttcaccttcctggccctgtacctgaccgccggcagcctggtgttcctgcacagcggcttcgtgggccagcccgccgtgagcggcaaccaggccaaccccgccgccgccggcggccccgccgagggcgccgagctgagcttcctgggcgacatgcacctgggcagaggcttcagagacaccggcgaggccagcagcatcgccagaagatacggcccctggttcaagggcaaggacggcaacgagagagccaagctgggcgactacggcggcgcctggagcagagccctgaagggcagagtggtgagagagaaggaggaggagagagccaagtacatcggctgctacctggacgacacccagagcagagccctgagaggcgtgagcttcttcgactacaagaagatgaccatcttcagatgccaggacaactgcgccgagagaggctacctgtacggcggcctggagttcggcgccgagtgctactgcggccacaagatccaggccaccaacgtgagcgaggccgagtgcgacatggagtgcaagggcgagagaggcagcgtgtgcggcggcgccaacagactgagcgtgtacagactgcagctggcccaggagagcgccagaagatacggcagcgccgtgttcagaggctgcttcagaagacccgacaacctgagcctggccctgcccgtgaccgccgccatgctgaacatgagcgtggacaagtgcgtggacttctgcaccgagaaggagtaccccctggccgccctggccggcaccgcctgccactgcggcttccccaccaccagattccccctgcacgacagagaggacgagcagctgtgcgcccagaagtgcagcgccgaggagttcgagagctgcggcacccccagctacttcatcgtgtaccagacccaggtgcaggacaacagatgcatggacagaagattcctgcccggcaagagcaagcagctgatcgccctggccagcttccccggcgccggcaacacctgggccagacacctgatcgagctggccaccggcttctacaccggcagctactacttcgacggcagcctgtacaacaagggcttcaagggcgagagagaccactggagaagcggcagaaccatctgcatcaagacccacgagagcggccagaaggagatcgaggccttcgacgccgccatcctgctgatcagaaacccctacaaggccctgatggccgagttcaacagaaagtacggcggccacatcggcttcgccgcccacgcccactggaagggcaagggcgccgtgcccggcagcctgcagatcctgttcagaagcatctgcaccgccagcgtgggcgagtggcccgagttcgtgagaaactacgccccctggtgggccacccacaccctggactggctgaagttcggcaagaaggtgctggtggtgcacttcgaggacctgaagcaggacctgttcgtgcagctgggcagaatggtgagcctgctgggcgtggccgtgagagaggacagactgctgtgcgtggagagccagaaggacggcaacttcaagagaagcggcctgagaaagctggagtacgacccctacaccgccgacatgcagaagaccatcagcgcctacatcaagatggtggacgccgccctgaagggcagaaacctgaccggcgtgcccgacgactactaccccagatag

SEQ ID NO: 23982 - DNA, 1698 bp, Artificial Sequence
  Description of Artificial Sequence: Synthetic coding sequence
atggccaagctgtggttcaagttccagagatacttcagaagaaagcccgtgagattcttcaccttcctggccctgtacctgaccgccggcagcctggtgttcctgcacagcggcttcgtgggccagcccgccgtgagcggcaaccaggccaaccccgccgccgccggcggccccgccgagggcgccgagctgagcttcctgggcgacatgcacctgggcagaggcttcagagacaccggcgaggccagcagcatcgccagaagatacggcccctggttcaagggcaaggacggcaacgagagagccaagctgggcgactacggcggcgcctggagcagagccctgaagggcagagtggtgagagagaaggaggaggagagagccaagtacatcggctgctacctggacgacacccagagcagagccctgagaggcgtgagcttcttcgactacaagaagatgaccatcttcagatgccaggacaactgcgccgagagaggctacctgtacggcggcctggagttcggcgccgagtgctactgcggccacaagatccaggccaccaacgtgagcgaggccgagtgcgacatggagtgcaagggcgagagaggcagcgtgtgcggcggcgccaacagactgagcgtgtacagactgcagctggcccaggagagcgccagaagatacggcagcgccgtgttcagaggctgcttcagaagacccgacaacctgagcctggccctgcccgtgaccgccgccatgctgaacatgagcgtggacaagtgcgtggacttctgcaccgagaaggagtaccccctggccgccctggccggcaccgcctgccactgcggcttccccaccaccagattccccctgcacgacagagaggacgagcagctgtgcgcccagaagtgcagcgccgaggagttcgagagctgcggcacccccagctacttcatcgtgtaccagacccaggtgcaggacaacagatgcatggacagaagattcctgcccggcaagagcaagcagctgatcgccctggccagcttccccggcgccggcaacacctgggccagacacctgatcgagctggccaccggcttctacaccggcagctactacttcgacggcagcctgtacaacaagggcttcaagggcgagagagaccactggagaagcggcagaaccatctgcatcaagacccacgagagcggccagaaggagatcgaggccttcgacgccgccatcctgctgatcagaaacccctacaaggccctgatggccgagttcaacagaaagtacggcggccacatcggcttcgccgcccacgcccactggaagggcaaggagtggcccgagttcgtgagaaactacgccccctggtgggccacccacaccctggactggctgaagttcggcaagaaggtgctggtggtgcacttcgaggacctgaagcaggacctgttcgtgcagctgggcagaatggtgagcctgctgggcgtggccgtgagagaggacagactgctgtgcgtggagagccagaaggacggcaacttcaagagaagcggcctgagaaagctggagtacgacccctacaccgccgacatgcagaagaccatcagcgcctacatcaagatggtggacgccgccctgaagggcagaaacctgaccggcgtgcccgacgactactaccccagatag

SEQ ID NO: 23983 - DNA, 1698 bp, Artificial Sequence; identical to SEQ ID NO: 23982
  Description of Artificial Sequence: Synthetic coding sequence

SEQ ID NO: 23984 - DNA, 1758 bp, Artificial Sequence; identical to SEQ ID NO: 23981
  Description of Artificial Sequence: Synthetic coding sequence

SEQ ID NO: 23985 - DNA, 5532 bp, Artificial Sequence
  Description of Artificial Sequence: Synthetic coding sequence
atggccgacacccagacccaggtggcccccacccccaccatgagaatggccaccgccgaggacctgcccctgccccccccccccgccctggaggacctgcccctgcccccccccaaggagagcttcagcaagttccaccagcagagacaggccagcgagctgagaagactgtacagacacatccaccccgagctgagaaagaacctggccgaggccgtggccgaggacctggccgaggtgctgggcagcgaggagcccaccgagggcgacgtgcagtgcatgagatggatcttcgagaactggagactggacgccatcggcgagcacgagagacccgccgccaaggagcccgtgctgtgcggcgacgtgcaggccaccagcagaaagttcgaggagggcagcttcgccaacagcaccgaccaggagcccaccagaccccagcccggcggcggcgacgtgagagccgccagatggctgttcgagaccaagcccctggacgagctgaccggccaggccaaggagctggaggccaccgtgagagagcccgccgccagcggcgacgtgcagggcaccagaatgctgttcgagaccagacccctggacagactgggcagcagacccagcctgcaggagcagagccccctggagctgagaagcgagatccaggagctgaagggcgacgtgaagaagaccgtgaagctgttccagaccgagcccctgtgcgccatccaggacgccgagggcgccatccacgaggtgaaggccgcctgcagagaggagatccagagcaacgccgtgagaagcgccagatggctgttcgagaccagacccctggacgccatcaaccaggaccccagccaggtgagagtgatcagaggcatcagcctggaggagggcgccagacccgacgtgagcgccaccagatggatcttcgagacccagcccctggacgccatcagagagatcctggtggacgagaaggacttccagcccagccccgacctgatcccccccggccccgacgtgcagcagcagcagcacctgttcgagaccagagccctggacaccctgaagggcgacgaggaggccggcgccgaggccccccccaaggaggaggtggtgcccggcgacgtgagaagcaccctgtggctgttcgagaccaagcccctggacgccttcagagacaaggtgcaggtgggccacctgcagagagtggacccccaggacggcgagggccacctgagcagcgacagcagcagcgccctgcccttcagccagagcgccccccagagagacgagctgaagggcgacgtgaagaccttcaagaacctgttcgagaccctgcccctggacagcatcggccagggcgaggtgctggcccacggcagccccagcagagaggagggcaccgacagcgccggccaggcccagggcatcggcagccccgtgtacgccatgcaggacagcaagggcagactgcacgccctgaccagcgtgagcagagagcagatcgtgggcggcgacgtgcagggctacagatggatgttcgagacccagcccctggaccagctgggcagaagccccagcaccatcgacgtggtgagaggcatcaccagacaggaggtggtggccggcgacgtgggcaccgccagatggctgttcgagacccagcccctggagatgatccaccagagagagcagcaggagagacagaaggaggagggcaagagccagggcgacccccagcccgaggccccccccaagggcgacgtgcagaccatcagatggctgttcgagacctgccccatgagcgagctggccgagaagcagggcagcgaggtgaccgaccccaccgccaaggccgaggcccagagctgcacctggatgttcaagccccagcccgtggacagacccgtgggcagcagagagcagcacctgcaggtgagccaggtgcccgccggcgagagacagaccgacagacacgtgttcgagaccgagcccctgcaggccagcggcagaccctgcggcagaagacccgtgagatactgcagcagagtggagatccccagcggccaggtgagcagacagaaggaggtgttccaggccctggaggccggcaagaaggaggagcaggagcccagagtgatcgccggcagcatccccgccggcagcgtgcacaagttcacctggctgttcgagaactgccccatgggcagcctggccgccgagagcatccagggcggcaacctgctggaggagcagcccatgagccccagcggcaacagaatgcaggagagccaggagaccgccgccgagggcaccctgagaaccctgcacgccacccccggcatcctgcaccacggcggcatcctgatggaggccagaggccccggcgagctgtgcctggccaagtacgtgctgagcggcaccggccagggccacccctacatcagaaaggaggagctggtgagcggcgagctgcccagaatcatctgccaggtgctgagaagacccgacgtggaccagcagggcctgctggtgcaggaggaccccaccggccagctgcagctgaagcccctgagactgcccacccccggcagcagcggcaacatcgaggacatggaccccgagctgcagcagctgctggcctgcggcctgggcaccagcgtggccagaaccggcctggtgatgcaggagaccgagcagggcctggtggccctgaccgcctacagcctgcagcccagactgaccagcaaggccagcgagagaagcagcgtgcagctgctggccagctgcatcgacaagggcgacctgagcggcctgcacagcctgagatgggagccccccgccgaccccagccccgtgcccgccagcgagggcgcccagagcctgcaccccaccgagagcatcatccacgtgccccccctggaccccagcatgggcatgggccacctgagagccagcggcgccaccccctgccccccccaggccatcggcaaggccgtgcccctggccggcgaggccgccgcccccgcccagctgcagaacaccgagaagcaggaggacagccacagcggccagaagggcatggccgtgctgggcaagagcgagggcgccaccaccaccccccccggccccggcgcccccgacctgctggccgccatgcagagcctgagaatggccaccgccgaggcccagagcctgcaccagcaggtgctgaacaagcacaagcagggccccacccccaccgccaccagcaaccccatccaggacggcctgagaaaggccggcgccacccagagcaacatcagacccggcggcggcagcgaccccagaatccccgccgcccccagaaaggtgagcagagaggagcaggccctgcccagaggcctgcccggcggctgggtgaccatccaggacggcatctacaccgcccaccccgtgagaaccttcgacccccccggcggcgtgcagctgagccagagagagccccagagcagacacagagagaccgccctgagcgtgcaggcccccagacccctgcagggcggccccggccagagcaccggccccggcagagaggagcccggcggctgcacccagatggcctggggcccccccggcaaggccatggccgaggtgtgccccggcggcctgcaggccgccgagaccaccctgaagaccgcccccctgggcagacacatcctggccagcggcccccaggccgccggcgccagcccccacccccacaacgccttcgtgccccccccccccaccctgcccgccgccgtgaccggccccgacttccccgccggcgcccacagagccgaggacagcatccagcaggccagcgagcccctgaaggaccccctgctgcacagccacagcagccccgccggccagagaacccccggcggcagccagaccaagacccccaagctggaccccaccatgccccccaagaagaagccccagctgccccccaagcccgcccacctgacccagagccaccccccccagagactgcccaagcccctgcccctgagccccagcttcagcagcgaggtgggccagagagagcaccagagaggcgagagagacaccgccatcccccagcccgccaaggtgcccaccaccgtggaccagggccacatccccctggccagatgccccagcggccacagccagcccagcctgcagcacggcctgagcaccaccgcccccagacccaccaagaaccaggccaccggcagcaacgcccagagcagcgagccccccaagctgaacgccctgaaccacgaccccaccagcccccagtggggccccggccccagcggcgagcagcccatggagggcagccaccagggcgcccccgagagccccgacagcctgcagagaaaccagaaggagctgcagggcctgctgaaccaggtgcaggccctggagaaggaggccgccagcagcgtggacgtgcaggccctgagaagactgttcgaggccgtgccccagctgggcggcgccgccccccaggcccccgccgcccaccagaagcccgaggccagcgtggagcaggccttcggcgagctgaccagagtgagcaccgaggtggcccagctgaaggagcagaccctggccagactgctggacatcgaggaggccgtgcacaaggccctgagcagcatgagcagcctgcagcccgaggccagcgccagaggccacttccagggcccccccaaggaccacagcgcccacaagatcagcgtgaccgtgagcagcagcgccagacccagcggcagcggccaggaggtgggcggccagaccgccgtgaagaaccaggccaaggtggagtgccacaccgaggcccagagccaggtgaagatcagaaaccacaccgaggccagaggccacaccgccagcaccgcccccagcaccagaagacaggagaccagcagagagtacctgtgcccccccagagtgctgcccagcagcagagacagccccagcagccccaccttcatcagcatccagagcgccaccagaaagcccctggagacccccagcttcaagggcaaccccgacgtgagcgtgaagagcacccagctggcccaggacatcggccaggccctgctgcaccagaagggcgtgcaggacaagaccggcaagaaggacatcacccagtgcagcgtgcagcccgagcccgccccccccagcgccagccccctgcccagaggctggcagaagagcgtgctggagctgcagaccggccccggcagcagccagcactacggcgccatgagaaccgtgaccgagcagtacgaggaggtggaccagttcggcaacaccgtgctgatgagcagcaccaccgtgaccgagcaggccgagccccccagaaaccccggcagccacctgggcctgcacgccagccccctgctgagacagttcctgcacagccccgccggcttcagcagcgacctgaccgaggccgagaccgtgcaggtgagctgcagctacagccagcccgccgcccagtag

SEQ ID NO: 23986 - DNA, 3366 bp, Artificial Sequence
  Description of Artificial Sequence: Synthetic coding sequence
atggccgacacccagacccaggtggcccccacccccaccatgagaatggccaccgccgaggacctgcccctgccccccccccccgccctggaggacctgcccctgcccccccccaaggagagcttcagcaagttccaccagcagagacaggccagcgagctgagaagactgtacagacacatccaccccgagctgagaaagaacctggccgaggccgtggccgaggacctggccgaggtgctgggcagcgaggagcccaccgagggcgacgtgcagtgcatgagatggatcttcgagaactggagactggacgccatcggcgagcacgagagacccgccgccaaggagcccgtgctgtgcggcgacgtgcaggccaccagcagaaagttcgaggagggcagcttcgccaacagcaccgaccaggagcccaccagaccccagcccggcggcggcgacgtgagagccgccagatggctgttcgagaccaagcccctggacgagctgaccggccaggccaaggagctggaggccaccgtgagagagcccgccgccagcggcgacgtgcagggcaccagaatgctgttcgagaccagacccctggacagactgggcagcagacccagcctgcaggagcagagccccctggagctgagaagcgagatccaggagctgaagggcgacgtgaagaagaccgtgaagctgttccagaccgagcccctgtgcgccatccaggacgccgagggcgccatccacgaggtgaaggccgcctgcagagaggagatccagagcaacgccgtgagaagcgccagatggctgttcgagaccagacccctggacgccatcaaccaggaccccagccaggtgagagtgatcagaggcatcagcctggaggagggcgccagacccgacgtgagcgccaccagatggatcttcgagacccagcccctggacgccatcagagagatcctggtggacgagaaggacttccagcccagccccgacctgatcccccccggccccgacgtgcagcagcagcagcacctgttcgagaccagagccctggacaccctgaagggcgacgaggaggccggcgccgaggccccccccaaggaggaggtggtgcccggcgacgtgagaagcaccctgtggctgttcgagaccaagcccctggacgccttcagagacaaggtgcaggtgggccacctgcagagagtggacccccaggacggcgagggccacctgagcagcgacagcagcagcgccctgcccttcagccagagcgccccccagagagacgagctgaagggcgacgtgaagaccttcaagaacctgttcgagaccctgcccctggacagcatcggccagggcgaggtgctggcccacggcagccccagcagagaggagggcaccgacagcgccggccaggcccagggcatcggcagccccgtgtacgccatgcaggacagcaagggcagactgcacgccctgaccagcgtgagcagagagcagatcgtgggcggcgacgtgcagggctacagatggatgttcgagacccagcccctggaccagctgggcagaagccccagcaccatcgacgtggtgagaggcatcaccagacaggaggtggtggccggcgacgtgggcaccgccagatggctgttcgagacccagcccctggagatgatccaccagagagagcagcaggagagacagaaggaggagggcaagagccagggcgacccccagcccgaggccccccccaagggcgacgtgcagaccatcagatggctgttcgagacctgccccatgagcgagctggccgagaagcagggcagcgaggtgaccgaccccaccgccaaggccgaggcccagagctgcacctggatgttcaagccccagcccgtggacagacccgtgggcagcagagagcagcacctgcaggtgagccaggtgcccgccggcgagagacagaccgacagacacgtgttcgagaccgagcccctgcaggccagcggcagaccctgcggcagaagacccgtgagatactgcagcagagtggagatccccagcggccaggtgagcagacagaaggaggtgttccaggccctggaggccggcaagaaggaggagcaggagcccagagtgatcgccggcagcatccccgccggcagcgtgcacaagttcacctggctgttcgagaactgccccatgggcagcctggccgccgagagcatccagggcggcaacctgctggaggagcagcccatgagccccagcggcaacagaatgcaggagagccaggagaccgccgccgagggcaccctgagaaccctgcacgccacccccggcatcctgcaccacggcggcatcctgatggaggccagaggccccggcgagctgtgcctggccaagtacgtgctgagcggcaccggccagggccacccctacatcagaaaggaggagctggtgagcggcgagctgcccagaatcatctgccaggtgctgagaagacccgacgtggaccagcagggcctgctggtgcaggaggaccccaccggccagctgcagctgaagcccctgagactgcccacccccggcagcagcggcaacatcgaggacatggaccccgagctgcagcagctgctggcctgcggcctgggcaccagcgtggccagaaccggcctggtgatgcaggagaccgagcagggcctggtggccctgaccgcctacagcctgcagcccagactgaccagcaaggccagcgagagaagcagcgtgcagctgctggccagctgcatcgacaagggcgacctgagcggcctgcacagcctgagatgggagccccccgccgaccccagccccgtgcccgccagcgagggcgcccagagcctgcaccccaccgagagcatcatccacgtgccccccctggaccccagcatgggcatgggccacctgagagccagcggcgccaccccctgccccccccaggccatcggcaaggccgtgcccctggccggcgaggccgccgcccccgcccagctgcagaacaccgagaagcaggaggacagccacagcggccagaagggcatggccgtgctgggcaagagcgagggcgccaccaccaccccccccggccccggcgcccccgacctgctggccgccatgcagagcctgagaatggccaccgccgaggcccagagcctgcaccagcaggtgctgaacaagcacaagcagggccccacccccaccgccaccagcaaccccatccaggacggcctgagaaaggccggcgccacccagagcaacatcagacccggcggcggcagcgaccccagaatccccgccgcccccagaaagctgctgtag

SEQ ID NO: 23987 - DNA, 1581 bp, Artificial Sequence
  Description of Artificial Sequence: Synthetic coding sequence
atgccccccaagaagaagccccagctgccccccaagcccgcccacctgacccagagccaccccccccagagactgcccaagcccctgcccctgagccccagcttcagcagcgaggtgggccagagagagcaccagagaggcgagagagacaccgccatcccccagcccgccaaggtgcccaccaccgtggaccagggccacatccccctggccagatgccccagcggccacagccagcccagcctgcagcacggcctgagcaccaccgcccccagacccaccaagaaccaggccaccggcagcaacgcccagagcagcgagccccccaagctgaacgccctgaaccacgaccccaccagcccccagtggggccccggccccagcggcgagcagcccatggagggcagccaccagggcgcccccgagagccccgacagcctgcagagaaaccagaaggagctgcagggcctgctgaaccaggtgcaggccctggagaaggaggccgccagcagcgtggacgtgcaggccctgagaagactgttcgaggccgtgccccagctgggcggcgccgccccccaggcccccgccgcccaccagaagcccgaggccagcgtggagcaggccttcggcgagctgaccagagtgagcaccgaggtggcccagctgaaggagcagaccctggccagactgctggacatcgaggaggccgtgcacaaggccctgagcagcatgagcagcctgcagcccgaggccagcgccagaggccacttccagggcccccccaaggaccacagcgcccacaagatcagcgtgaccgtgagcagcagcgccagacccagcggcagcggccaggaggtgggcggccagaccgccgtgaagaaccaggccaaggtggagtgccacaccgaggcccagagccaggtgaagatcagaaaccacaccgaggccagaggccacaccgccagcaccgcccccagcaccagaagacaggagaccagcagagagtacctgtgcccccccagagtgctgcccagcagcagagacagccccagcagccccaccttcatcagcatccagagcgccaccagaaagcccctggagacccccagcttcaagggcaaccccgacgtgagcgtgaagagcacccagctggcccaggacatcggccaggccctgctgcaccagaagggcgtgcaggacaagaccggcaagaaggacatcacccagtgcagcgtgcagcccgagcccgccccccccagcgccagccccctgcccagaggctggcagaagagcgtgctggagctgcagaccggccccggcagcagccagcactacggcgccatgagaaccgtgaccgagcagtacgaggaggtggaccagttcggcaacaccgtgctgatgagcagcaccaccgtgaccgagcaggccgagccccccagaaaccccggcagccacctgggcctgcacgccagccccctgctgagacagttcctgcacagccccgccggcttcagcagcgacctgaccgaggccgagaccgtgcaggtgagctgcagctacagccagcccgccgcccagtag

SEQ ID NO: 23988 - DNA, 1953 bp, Artificial Sequence
  Description of Artificial Sequence: Synthetic coding sequence
atggccgccaagagcgacggcagactgaagatgaagaagagcagcgacgtggccttcacccccctgcagaacagcgaccacagcggcagcgtgcagggcctggcccccggcctgcccagcggcagcggcgccgaggacgaggaggccgccggcggcggctgctgccccgacggcggcggctgcagcagatgctgctgctgctgcgccggcagcggcggcagcgccggcagcggcggcagcggcggcgtggccggccccggcggcggcggcgccggcagcgccgccctgtgcctgagactgggcagagagcagagaagatacagcctgtgggactgcctgtggatcctggccgccgtggccgtgtacttcgccgacgtgggcaccgacgtgtggctggccgtggactactacctgagaggccagagatggtggttcggcctgaccctgttcttcgtggtgctgggcagcctgagcgtgcaggtgttcagcttcagatggttcgtgcacgacttcagcaccgaggacagcgccaccgccgccgccgccagcagctgcccccagcccggcgccgactgcaagaccgtggtgggcggcggcagcgccgccggcgagggcgaggccagacccagcaccccccagagacaggccagcaacgccagcaagagcaacatcgccgccgccaacagcggcagcaacagcagcggcgccaccagagccagcggcaagcacagaagcgccagctgcagcttctgcatctggctgctgcagagcctgatccacatcctgcagctgggccagatctggagatacttccacaccatctacctgggcatcagaagcagacagagcggcgagaacgacagatggagattctactggaagatggtgtacgagtacgccgacgtgagcatgctgcacctgctggccaccttcctggagagcgccccccagctggtgctgcagctgtgcatcatcgtgcagacccacagcctgcaggccctgcagggcttcaccgccgccgccagcctggtgagcctggcctgggccctggccagctaccagaaggccctgagagacagcagagacgacaagaagcccatcagctacatggccgtgatcatccagttctgctggcacttcttcaccatcgccgccagagtgatcaccttcgccctgttcgccagcgtgttccagctgtacttcggcatcttcatcgtgctgcactggtgcatcatgaccttctggatcgtgcactgcgagaccgagttctgcatcaccaagtgggaggagatcgtgttcgacatggtggtgggcatcatctacatcttcagctggttcaacgtgaaggagggcagaaccagatgcagactgttcatctactacttcgtgatcctgctggagaacaccgccctgagcgccctgtggtacctgtacaaggccccccagatcgccgacgccttcgccatccccgccctgtgcgtggtgttcagcagcttcctgaccggcgtggtgttcatgctgatgtactacgccttcttccaccccaacggccccagattcggccagagccccagctgcgcctgcgaggaccccgccgccgccttcaccctgccccccgacgtggccaccagcaccctgagaagcatcagcaacaacagaagcgtggtgagcgacagagaccagaagttcgccgagagagacggctgcgtgcccgtgttccaggtgagacccaccgcccccagcacccccagcagcagaccccccagaatcgaggagagcgtgatcaagatcgacctgttcagaaacagataccccgcctgggagagacacgtgctggacagaagcctgagaaaggccatcctggccttcgagtgcagccccagcccccccagactgcagtacaaggacgacgccctgatccaggagagactggagtacgagaccaccctgtag

SEQ ID NO: 23989 - DNA, 1953 bp, Artificial Sequence; identical to SEQ ID NO: 23988
  Description of Artificial Sequence: Synthetic coding sequence

SEQ ID NO: 23990 - DNA, 1089 bp, Artificial Sequence
  Description of Artificial Sequence: Synthetic coding sequence
atgatgtacgagtacgccgacgtgaacatgctgagactgctggagaccttcctggagagcgccccccagctggtgctgcagctgtacatcatgctgcagaagaacagcgccgagaccctgccctgcgtgagcagcgtgaccagcctgatgagcctggcctgggtgctggccagctaccacaagctgctgagagacagcagagacgacaagaagagcatgagctacagaggcgccatcatccaggtgttctggagactgttcaccatcagcagcagagtgatcagcttcgccctgttcgccagcatcttccagctgtacttcggcatcttcgtggtggtgcactggtgcgccatggccttctggatcatccacggcggcaccgacttctgcatgagcaagtgggaggagatcctgttcaacatggtggtgggcatcgtgtacatcttctgctggttcaacgtgaaggagggcagaaccagatacagaatgttcgcctactacaccatcgtgctgaccgagaacgccgccctgaccttcctgtggtacttctacagagaccccgagaccaccgacagctacgccgtgcccgccctgtgctgcgtgttcatcagcttcgtggccggcatcgccatgatgctgctgtactacggcgtgctgcaccccaccggccccagagccaagatcctggccagcagctgctgcgccgagctgctgtggggcatccccctgccccccgacgtggagcccatggcccccgagatccccggctacagaggcacccaggtgacccccaccagagccgtgaccgagcagcaggaggacctgaccgccgacacctgcctgcccgtgttccaggtgagacccatgggcccccccacccccctgggcagaccctacctgcccgagggccccctgatcaagatcgacatgcccagaaagagataccccgcctgggacgcccacttcgtggacagaagactgagaagaaccatcaacatcctgcagtacgtgacccccaccgccgtgggcatcagatacagagacggccccctgctgtacgagctgctgcagtacgagagcagcctgtag

SEQ ID NO: 23991 - DNA, 1926 bp, Artificial Sequence
  Description of Artificial Sequence: Synthetic coding sequence
atggccgccaagagcgacggcggcggcgtgggcgtgggcttcgcccagctgcacaacctggacgaggccgtgggcagcggcggcgaggaggacggcgagcccggcggcggcggctgcggcggcggcggcgacggcagcgagcccggcgagagcagcagcatgcacatctgccactgctgcaacaccagcagctgctactggggctgcagaagcgcctgcctgagaagcctgctgggcagaaagcccagaagaagcgccgccgccgacggcggcgaccagcccctgcagccccccgccgcccccggcgccggcagacagccccccacccccagcgccgccagacccgagcccccccccccccaggtggagagaccctggctggactgcctgtggatcgtgctggccctgctggtgttcttcggcgacgtgggcaccgacctgtggctggccctggactactacagaaagggcgactacgtgtacttcggcctgaccctgttcttcgtgctggtgcccagcctgctggtgcagagcctgagcttcagatggttcgtgcaggactacaccggcggcggcctgggcgccgtggagggcctgaccagcagaggcccccccatgatgggcgccggctacgtgcacggcgccgccagaggcggccccggcgtgagagtgagccccacccccggcgcccagagactgtgcagactgagcgtgtggatctggcagagcgtgatccacctgctgcagatgggccaggtgtggagatacatcagaaccatgtacctgggcatccagagccagagaagaaaggagcaccagagaagattctactgggccatgatgtacgagtacgccgacgtgaacatgctgagactgctggagaccttcctggagagcgccccccagctggtgctgcagctgtacatcatgctgcagaagaacagcgccgagaccctgccctgcgtgagcagcgtgaccagcctgatgagcctggcctgggtgctggccagctaccacaagctgctgagagacagcagagacgacaagaagagcatgagctacagaggcgccatcatccaggtgttctggagactgttcaccatcagcagcagagtgatcagcttcgccctgttcgccagcatcttccagctgtacttcggcatcttcgtggtggtgcactggtgcgccatggccttctggatcatccacggcggcaccgacttctgcatgagcaagtgggaggagatcctgttcaacatggtggtgggcatcgtgtacatcttctgctggttcaacgtgaaggagggcagaaccagatacagaatgttcgcctactacaccatcgtgctgaccgagaacgccgccctgaccttcctgtggtacttctacagagaccccgagaccaccgacagctacgccgtgcccgccctgtgctgcgtgttcatcagcttcgtggccggcatcgccatgatgctgctgtactacggcgtgctgcaccccaccggccccagagccaagatcctggccagcagctgctgcgccgagctgctgtggggcatccccctgccccccgacgtggagcccatggcccccgagatccccggctacagaggcacccaggtgacccccaccagagccgtgaccgagcagcaggaggacctgaccgccgacacctgcctgcccgtgttccaggtgagacccatgggcccccccacccccctgggcagaccctacctgcccgagggccccctgatcaagatcgacatgcccagaaagagataccccgcctgggacgcccacttcgtggacagaagactgagaagaaccatcaacatcctgcagtacgtgacccccaccgccgtgggcatcagatacagagacggccccctgctgtacgagctgctgcagtacgagagcagcctgtag

SEQ ID NO: 23992 - DNA, 2034 bp, Artificial Sequence
  Description of Artificial Sequence: Synthetic coding sequence
atgctgagcagcaccgacttcaccttcgccagctgggagctggtggtgagagtggaccaccccaacgaggagcagcagaaggacgtgaccctgagagtgagcggcgacctgcacgtgggcggcgtgatgctgaagctggtggagcagatcaacatcagccaggactggagcgacttcgccctgtggtgggagcagaagcactgctggctgctgaagacccactggaccctggacaagtacggcgtgcaggccgacgccaagctgctgttcaccccccagcacaagatgctgagactgagactgcccaacctgaagatggtgagactgagagtgagcttcagcgccgtggtgttcaaggccgtgagcgacatctgcaagatcctgaacatcagaagaagcgaggagctgagcctgctgaagcccagcggcgactacttcaagaagaagaagaagaaggacaagaacaacaaggagcccatcatcgaggacatcctgaacctggagagcagccccaccgccagcggcagcagcgtgagccccggcctgtacagcaagaccatgacccccatctacgaccccatcaacggcacccccgccagcagcaccatgacctggttcagcgacagccccctgaccgagcagaactgcagcatcctggccttcagccagcccccccagagccccgaggccctggccgacatgtaccagcccagaagcctggtggacaaggccaagctgaacgccggctggctggacagcagcagaagcctgatggagcagggcatccaggaggacgagcagctgctgctgagattcaagtactacagcttcttcgacctgaaccccaagtacgacgccgtgagaatcaaccagctgtacgagcaggccagatgggccatcctgctggaggagatcgactgcaccgaggaggagatgctgatcttcgccgccctgcagtaccacatcagcaagctgagcctgagcgccgagacccaggacttcgccggcgagagcgaggtggacgagatcgaggccgccctgagcaacctggaggtgaccctggagggcggcaaggccgacagcctgctggaggacatcaccgacatccccaagctggccgacaacctgaagctgttcagacccaagaagctgctgcccaaggccttcaagcagtactggttcatcttcaaggacaccagcatcgcctacttcaagaacaaggagctggagcagggcgagcccctggagaagctgaacctgagaggctgcgaggtggtgcccgacgtgaacgtggccggcagaaagttcggcatcaagctgctgatccccgtggccgacggcatgaacgagatgtacctgagatgcgaccacgagaaccagtacgcccagtggatggccgcctgcatgctggccagcaagggcaagaccatggccgacagcagctaccagcccgaggtgctgaacatcctgagcttcctgagaatgaagaacagaaacagcgccagccaggtggccagcagcctggagaacatggacatgaaccccgagtgcttcgtgagccccagatgcgccaagagacacaagagcaagcagctggccgccagaatcctggaggcccaccagaacgtggcccagatgcccctggtggaggccaagctgagattcatccaggcctggcagagcctgcccgagttcggcctgacctactacctggtgagattcaagggcagcaagaaggacgacatcctgggcgtgagctacaacagactgatcaagatcgacgccgccaccggcatccccgtgaccacctggagattcaccaacatcaagcagtggaacgtgaactgggagaccagacaggtggtgatcgagttcgaccagaacgtgttcaccgccttcacctgcctgagcgccgactgcaagatcgtgcacgagtacatcggcggctacatcttcctgagcaccagaagcaaggaccagaacgagaccctggacgaggacctgttccacaagctgaccggcggccaggactag

SEQ ID NO: 23993 - DNA, 1188 bp, Artificial Sequence
  Description of Artificial Sequence: Synthetic coding sequence
atgccctggagcagcagaggcgccctgctgagagacctggtgctgggcgtgctgggcaccgccgccttcctgctggacctgggcaccgacctgtgggccgccgtgcagtacgccctgggcggcagatacctgtgggccgccctggtgctggccctgctgggcctggccagcgtggccctgcagctgttcagctggctgtggctgagagccgaccccgccggcctgcacggcagccagccccccagaagatgcctggccctgctgcacctgctgcagctgggctacctgtacagatgcgtgcaggagctgagacagggcctgctggtgtggcagcaggaggagcccagcgagttcgacctggcctacgccgacttcctggccctggacatcagcatgctgagactgttcgagaccttcctggagaccgccccccagctgaccctggtgctggccatcatgctgcagagcggcagagccgagtactaccagtgggtgggcatctgcaccagcttcctgggcatcagctgggccctgctggactaccacagagccctgagaacctgcctgcccagcaagcccctgctgggcctgggcagcagcgtgatctacttcctgtggaacctgctgctgctgtggcccagagtgctggccgtggccctgttcagcgccctgttccccagctacgtggccctgcacttcctgggcctgtggctggtgctgctgctgtgggtgtggctgcagggcaccgacttcatgcccgaccccagcagcgagtggctgtacagagtgaccgtggccaccatcctgtacttcagctggttcaacgtggccgagggcagaaccagaggcagagccatcatccacttcgccttcctgctgagcgacagcatcctgctggtggccacctgggtgacccacagcagctggctgcccagcggcatccccctgcagctgtggctgcccgtgggctgcggctgcttcttcctgggcctggccctgagactggtgtactaccactggctgcaccccagctgctgctggaagcccgaccccgaccaggtggacggcgccagaagcctgctgagccccgagggctaccagctgccccagaacagaagaatgacccacctggcccagaagttcttccccaaggccaaggacgaggccgccagccccgtgaagggctag

SEQ ID NO: 23994 - DNA, 1122 bp, Artificial Sequence
  Description of Artificial Sequence: Synthetic coding sequence
atgaagtacaccaagcagaacttcatgatgagcgtgctgggcatcatcatctacgtgaccgacctgatcgtggacatctgggtgagcgtgagattcttccacgagggccagtacgtgttcagcgccctggccctgagcttcatgctgttcggcaccctggtggcccagtgcttcagctacagctggttcaaggccgacctgaagaaggccggccaggagagccagcactgcttcctgctgctgcactgcctgcagggcggcgtgttcaccagatactggttcgccctgaagagaggctaccacgccgccttcaagtacgacagcaacaccagcaacttcgtggaggagcagatcgacctgcacaaggaggtgatcgacagagtgaccgacctgagcatgctgagactgttcgagacctacctggagggctgcccccagctgatcctgcagctgtacatcctgctggagcacggccaggccaacttcagccagtacgccgccatcatggtgagctgctgcgccatcagctggagcaccgtggactaccaggtggccctgagaaagagcctgcccgacaagaagctgctgaacggcctgtgccccaagatcacctacctgttctacaagctgttcaccctgctgagctggatgctgagcgtggtgctgctgctgttcctgaacgtgaagatcgccctgttcctgctgctgttcctgtggctgctgggcatcatctgggccttcaagaacaacacccagttctgcacctgcatcagcatggagttcctgtacagaatcgtggtgggcttcatcctgatcttcaccttcttcaacatcaagggccagaacaccaagtgccccatgagctgctactacatcgtgagagtgctgggcaccctgggcatcctgaccgtgttctgggtgtgccccctgaccatcttcaaccccgactacttcatccccatcagcatcaccatcgtgctgaccctgctgctgggcatcctgttcctgatcgtgtactacggcagcttccaccccaacagaagcgccgagaccaagtgcgacgagatcgacggcaagcccgtgctgagagagtgcagaatgagatacttcctgatggagtag

SEQ ID NO: 23995 - DNA, 1122 bp, Artificial Sequence; identical to SEQ ID NO: 23994
  Description of Artificial Sequence: Synthetic coding sequence

SEQ ID NO: 23996 - DNA, 1182 bp, Artificial Sequence
  Description of Artificial Sequence: Synthetic coding sequence
atgggcctgctgagaggcggcctgccctgcgccagagccatggccagactgggcgccgtgagaagccactactgcgccctgctgctggccgccgccctggccgtgtgcgccttctactacctgggcagcggcagagagaccttcagcagcgccaccaagagactgaaggaggccagagccggcgcccccgccgcccccagcccccccgccctggagctggccagaggcagcgtggcccccgcccccggcgccaaggccaagagcctggagggcggcggcgccggccccgtggactaccacctgctgatgatgttcaccaaggccgagcacaacgccgccctgcaggccaaggccagagtggccctgagaagcctgctgagactggccaagttcgaggcccacgaggtgctgaacctgcacttcgtgagcgaggaggccagcagagaggtggccaagggcctgctgagagagctgctgccccccgccgccggcttcaagtgcaaggtgatcttccacgacgtggccgtgctgaccgacaagctgttccccatcgtggaggccatgcagaagcacttcagcgccggcctgggcacctactacagcgacagcatcttcttcctgagcgtggccatgcaccagatcatgcccaaggagatcctgcagatcatccagctggacctggacctgaagttcaagaccaacatcagagagctgttcgaggagttcgacagcttcctgcccggcgccatcatcggcatcgccagagagatgcagcccgtgtacagacacaccttctggcagttcagacacgagaacccccagaccagagtgggcggccccccccccgagggcctgcccggcttcaacagcggcgtgatgctgctgaacctggaggccatgagacagagccccctgtacagcagactgctggagcccgcccaggtgcagcagctggccgacaagtaccacttcagaggccacctgggcgaccaggacttcttcaccatgatcggcatggagcaccccaagctgttccacgtgctggactgcacctggaacagacagctgtgcacctggtggagagaccacggctacagcgacgtgttcgaggcctacttcagatgcgagggccacgtgaagatctaccacggcaactgcaacacccccatccccgaggactag

SEQ ID NO: 23997 - DNA, 573 bp, Artificial Sequence
  Description of Artificial Sequence: Synthetic coding sequence
atgtggccccccagatgcaaggaccccggcagacagagcgccgagatcctgcagatcatccagctggacctggacctgaagttcaagaccaacatcagagagctgttcgaggagttcgacagcttcctgcccggcgccatcatcggcatcgccagagagatgcagcccgtgtacagacacaccttctggcagttcagacacgagaacccccagaccagagtgggcggccccccccccgagggcctgcccggcttcaacagcggcgtgatgctgctgaacctggaggccatgagacagagccccctgtacagcagactgctggagcccgcccaggtgcagcagctggccgacaagtaccacttcagaggccacctgggcgaccaggacttcttcaccatgatcggcatggagcaccccaagctgttccacgtgctggactgcacctggaacagacagctgtgcacctggtggagagaccacggctacagcgacgtgttcgaggcctacttcagatgcgagggccacgtgaagatctaccacggcaactgcaacacccccatccccgaggactag

SEQ ID NO: 23998 - DNA, 564 bp, Artificial Sequence
  Description of Artificial Sequence: Synthetic coding sequence
atgaacggcatgagcgtgctgatgaaggagaccctgaagagcagcgtgacccccagcccctacgaggagaccggcgagagacagcccagcgtgaactgggccgtgagcccccaccagacccagaaccagtgggccagatggagctggaccagccagcccctggagctgcacaccttctggcagttcagacacgagaacccccagaccagagtgggcggccccccccccgagggcctgcccggcttcaacagcggcgtgatgctgctgaacctggaggccatgagacagagccccctgtacagcagactgctggagcccgcccaggtgcagcagctggccgacaagtaccacttcagaggccacctgggcgaccaggacttcttcaccatgatcggcatggagcaccccaagctgttccacgtgctggactgcacctggaacagacagctgtgcacctggtggagagaccacggctacagcgacgtgttcgaggcctacttcagatgcgagggccacgtgaagatctaccacggcaactgcaacacccccatccccgaggactag

SEQ ID NO: 23999 - DNA, 573 bp, Artificial Sequence; identical to SEQ ID NO: 23997
  Description of Artificial Sequence: Synthetic coding sequence

SEQ ID NO: 24000 - DNA, 570 bp, Artificial Sequence
  Description of Artificial Sequence: Synthetic coding sequence
atggtgagatgcgtgcccagcgccgtgatcgtgtgcttcctgagacccccccagcccggcagaaccgtgatcttccacgacgtggccgtgctgaccgacaagctgttccccatcgtggaggccatgcagaagcacttcagcgccggcctgggcacctactacagcgacagcatcttcttcctgagcgtggccatgcaccagatcatgcccaaggagatcctgcagatcatccagctggacctggacctgaagttcaagaccaacatcagagagctgttcgaggagttcgacagcttcctgcccggcgccatcatcggcatcgccagagagatgcagcagctggccgacaagtaccacttcagaggccacctgggcgaccaggacttcttcaccatgatcggcatggagcaccccaagctgttccacgtgctggactgcacctggaacagacagctgtgcacctggtggagagaccacggctacagcgacgtgttcgaggcctacttcagatgcgagggccacgtgaagatctaccacggcaactgcaacacccccatccccgaggactag

SEQ ID NO: 24001 - DNA, 504 bp, Artificial Sequence
  Description of Artificial Sequence: Synthetic coding sequence
atgagcctggtgatcagaaacctgcagagagtgatccccatcagaagagcccccctgagaagcaagatcgagatcgtgagaagaatcctgggcgtgcagaagttcgacctgggcatcatctgcgtggacaacaagaacatccagcacatcaacagaatctacagagacagaaacgtgcccaccgacgtgctgagcttccccttccacgagcacctgaaggccggcgagttcccccagcccgacttccccgacgactacaacctgggcgacatcttcctgggcgtggagtacatcttccaccagtgcaaggagaacgaggactacaacgacgtgctgaccgtgaccgccacccacggcctgtgccacctgctgggcttcacccacggcaccgaggccgagtggcagcagatgttccagaaggagaaggccgtgctggacgagctgggcagaagaaccggcaccagactgcagcccctgaccagaggcctgttcggcggcagctag

SEQ ID NO: 24002 - DNA, 375 bp, Artificial Sequence
  Description of Artificial Sequence: Synthetic coding sequence
atgagcctggtgatcagaaacctgcagagagtgatccccatcagaagagcccccctgagaagcaagatcgagatcgtgagaagaatcctgggcgtgcagaagttcgacctgggcatcatctgcgtggacaacaagaacatccagcacatcaacagaatctacagagacagaaacgtgcccaccgacgtgctgagcttccccttccacgaggtgaccgccacccacggcctgtgccacctgctgggcttcacccacggcaccgaggccgagtggcagcagatgttccagaaggagaaggccgtgctggacgagctgggcagaagaaccggcaccagactgcagcccctgaccagaggcctgttcggcggcagctag

SEQ ID NO: 24003 - DNA, 504 bp, Artificial Sequence; identical to SEQ ID NO: 24001
  Description of Artificial Sequence: Synthetic coding sequence

SEQ ID NO: 24004 - DNA, 240 bp, Artificial Sequence
  Description of Artificial Sequence: Synthetic coding sequence
atgagcctggtgatcagaaacctgcagagagtgatccccatcagaagagcccccctgagaagcaagatcgagatcgtgaccgccacccacggcctgtgccacctgctgggcttcacccacggcaccgaggccgagtggcagcagatgttccagaaggagaaggccgtgctggacgagctgggcagaagaaccggcaccagactgcagcccctgaccagaggcctgttcggcggcagctag

SEQ ID NO: 24005 - DNA, 369 bp, Artificial Sequence
  Description of Artificial Sequence: Synthetic coding sequence
atgagcctggtgatcagaaacctgcagagagtgatccccatcagaagagcccccctgagaagcaagatcgagatccacctgaaggccggcgagttcccccagcccgacttccccgacgactacaacctgggcgacatcttcctgggcgtggagtacatcttccaccagtgcaaggagaacgaggactacaacgacgtgctgaccgtgaccgccacccacggcctgtgccacctgctgggcttcacccacggcaccgaggccgagtggcagcagatgttccagaaggagaaggccgtgctggacgagctgggcagaagaaccggcaccagactgcagcccctgaccagaggcctgttcggcggcagctag

SEQ ID NO: 24006 - DNA, 504 bp, Artificial Sequence; identical to SEQ ID NO: 24001
  Description of Artificial Sequence: Synthetic coding sequence

SEQ ID NO: 24007 - DNA, 921 bp, Artificial Sequence
  Description of Artificial Sequence: Synthetic coding sequence
atggccgccgtggacgacctgcagttcgaggagttcggcaacgccgccaccagcctgaccgccaaccccgacgccaccaccgtgaacatcgaggaccccggcgagacccccaagcaccagcccggcagccccagaggcagcggcagagaggaggacgacgagctgctgggcaacgacgacagcgacaagaccgagctgctggccggccagaagaagagcagccccttctggaccttcgagtactaccagaccttcttcgacgtggacacctaccaggtgttcgacagaatcaagggcagcctgctgcccatccccggcaagaacttcgtgagactgtacatcagaagcaaccccgacctgtacggccccttctggatctgcgccaccctggtgttcgccatcgccatcagcggcaacctgagcaacttcctgatccacctgggcgagaagacctaccactacgtgcccgagttcagaaaggtgagcatcgccgccaccatcatctacgcctacgcctggctggtgcccctggccctgtggggcttcctgatgtggagaaacagcaaggtgatgaacatcgtgagctacagcttcctggagatcgtgtgcgtgtacggctacagcctgttcatctacatccccaccgccatcctgtggatcatcccccagaaggccgtgagatggatcctggtgatgatcgccctgggcatcagcggcagcctgctggccatgaccttctggcccgccgtgagagaggacaacagaagagtggccctggccaccatcgtgaccatcgtgctgctgcacatgctgctgagcgtgggctgcctggcctacttcttcgacgcccccgagatggaccacctgcccaccaccaccgccacccccaaccagaccgtggccgccgccaagagcagctag

SEQ ID NO: 24008 - DNA, 372 bp, Artificial Sequence
  Description of Artificial Sequence: Synthetic coding sequence
atgtggagaaacagcaaggtgatgaacatcgtgagctacagcttcctggagatcgtgtgcgtgtacggctacagcctgttcatctacatccccaccgccatcctgtggatcatcccccagaaggccgtgagatggatcctggtgatgatcgccctgggcatcagcggcagcctgctggccatgaccttctggcccgccgtgagagaggacaacagaagagtggccctggccaccatcgtgaccatcgtgctgctgcacatgctgctgagcgtgggctgcctggcctacttcttcgacgcccccgagatggaccacctgcccaccaccaccgccacccccaaccagaccgtggccgccgccaagagcagctag

SEQ ID NO: 24009 - DNA, 654 bp, Artificial Sequence
  Description of Artificial Sequence: Synthetic coding sequence
atggccgccgtggacgacctgcagttcgaggagttcggcaacgccgccaccagcctgaccgccaaccccgacgccaccaccgtgaacatcgaggaccccggcgagacccccaagcaccagcccggcagccccagaggcagcggcagagaggaggacgacgagctgctgggcaacgacgacagcgacaagaccgagctgctggccggccagaagaagagcagccccttctggaccttcgagtactaccagaccttcttcgacgtggacacctaccaggtgttcgacagaatcaagggcagcctgctgcccatccccggcaagaacttcgtgagactgtacatcagaagcaaccccgacctgtacggccccttctggatctgcgccaccctggtgttcgccatcgccatcagcggcaacctgagcaacttcctgatccacctgggcgagaagacctaccactacgtgcccgagttcagaaaggtgagcatcgccgccaccatcatctacgcctacgcctggctggtgcccctggccctgtggggcttcctgatgtggagaaacagcaaggtgatgaacatcgtgagctacagcttcctggagatcgtgtgcgtgtacggctacagcctgttcatctacatccccaccgccgtgtag

SEQ ID NO: 24010 - DNA, 921 bp, Artificial Sequence; identical to SEQ ID NO: 24007
  Description of Artificial Sequence: Synthetic coding sequence

SEQ ID NO: 24011 - DNA, 996 bp, Artificial Sequence
  Description of Artificial Sequence: Synthetic coding sequence
atgagcggcggcgagatcagcagcagaaccctgcagatcttcttcctgatcatcggcagaagactgaccggcagaatggccgccgtggacgacctgcagttcgaggagttcggcaacgccgccaccagcctgaccgccaaccccgacgccaccaccgtgaacatcgaggaccccggcgagacccccaagcaccagcccggcagccccagaggcagcggcagagaggaggacgacgagctgctgggcaacgacgacagcgacaagaccgagctgctggccggccagaagaagagcagccccttctggaccttcgagtactaccagaccttcttcgacgtggacacctaccaggtgttcgacagaatcaagggcagcctgctgcccatccccggcaagaacttcgtgagactgtacatcagaagcaaccccgacctgtacggccccttctggatctgcgccaccctggtgttcgccatcgccatcagcggcaacctgagcaacttcctgatccacctgggcgagaagacctaccactacgtgcccgagttcagaaaggtgagcatcgccgccaccatcatctacgcctacgcctggctggtgcccctggccctgtggggcttcctgatgtggagaaacagcaaggtgatgaacatcgtgagctacagcttcctggagatcgtgtgcgtgtacggctacagcctgttcatctacatccccaccgccatcctgtggatcatcccccagaaggccgtgagatggatcctggtgatgatcgccctgggcatcagcggcagcctgctggccatgaccttctggcccgccgtgagagaggacaacagaagagtggccctggccaccatcgtgaccatcgtgctgctgcacatgctgctgagcgtgggctgcctggcctacttcttcgacgcccccgagatggaccacctgcccaccaccaccgccacccccaaccagaccgtggccgccgccaagagcagctag

SEQ ID NO: 24012 - DNA, 951 bp, Artificial Sequence
  Description of Artificial Sequence: Synthetic coding sequence
atggccagcgccgacgagctgaccttccacgagttcgaggaggccaccaacctgctggccgacacccccgacgccgccaccaccagcagaagcgaccagctgaccccccagggccacgtggccgtggccgtgggcagcggcggcagctacggcgccgaggacgaggtggaggaggagagcgacaaggccgccctgctgcaggagcagcagcagcagcagcagcccggcttctggaccttcagctactaccagagcttcttcgacgtggacaccagccaggtgctggacagaatcaagggcagcctgctgcccagacccggccacaacttcgtgagacaccacctgagaaacagacccgacctgtacggccccttctggatctgcgccaccctggccttcgtgctggccgtgaccggcaacctgaccctggtgctggcccagagaagagaccccagcatccactacagcccccagttccacaaggtgaccgtggccggcatcagcatctactgctacgcctggctggtgcccctggccctgtggggcttcctgagatggagaaagggcgtgcaggagagaatgggcccctacaccttcctggagaccgtgtgcatctacggctacagcctgttcgtgttcatccccatggtggtgctgtggctgatccccgtgccctggctgcagtggctgttcggcgccctggccctgggcctgagcgccgccggcctggtgttcaccctgtggcccgtggtgagagaggacaccagactggtggccaccgtgctgctgagcgtggtggtgctgctgcacgccctgctggccatgggctgcaagctgtacttcttccagagcctgccccccgagaacgtggccccccccccccagatcaccagcctgcccagcaacatcgccctgagccccaccctgccccagagcctggcccccagctag

SEQ ID NO: 24013 - DNA, 735 bp, Artificial Sequence
  Description of Artificial Sequence: Synthetic coding sequence
atgcagccccccggccccccccccgcctacgcccccaccaacggcgacttcaccttcgtgagcagcgccgacgccgaggacctgagcggcagcatcgccagccccgacgtgaagctgaacctgggcggcgacttcatcaaggagagcaccgccaccaccttcctgagacagagaggctacggctggctgctggaggtggaggacgacgaccccgaggacaacaagcccctgctggaggagctggacatcgacctgaaggacatctactacaagatcagatgcgtgctgatgcccatgcccagcctgggcttcaacagacaggtggtgagagacaaccccgacttctggggccccctggccgtggtgctgttcttcagcatgatcagcctgtacggccagttcagagtggtgagctggatcatcaccatctggatcttcggcagcctgaccatcttcctgctggccagagtgctgggcggcgaggtggcctacggccaggtgctgggcgtgatcggctacagcctgctgcccctgatcgtgatcgcccccgtgctgctggtggtgggcagcttcgaggtggtgagcaccctgatcaagctgttcggcgtgttctgggccgcctacagcgccgccagcctgctggtgggcgaggagttcaagaccaagaagcccctgctgatctaccccatcttcctgctgtacatctacttcctgagcctgtacaccggcgtgtag

SEQ ID NO: 24014 - DNA, 582 bp, Artificial Sequence
  Description of Artificial Sequence: Synthetic coding sequence
atggccgaggccgaggagagccccggcgaccccggcaccgccagccccagacccctgatgagagacctgaaggccgtgggcaagaagttcatgcacgtgctgtaccccagaaagagcaacaccctgctgagagactgggacctgtggggccccctgatcctgtgcgtgaccctggccctgatgctgcagagagacagcgccgacagcgagaaggacggcggcccccagttcgccgaggtgttcgtgatcgtgtggttcggcgccgtgaccatcaccctgaacagcaagctgctgggcggcaacatcagcttcttccagagcctgtgcgtgctgggctactgcatcctgcccctgaccgtggccatgctgatctgcagactggtgctgctggccgaccccggccccgtgaacttcatggtgagactgttcgtggtgatcgtgatgttcgcctggagcatcgtggccagcaccgccttcctggccgacagccagccccccaacagaagagccctggccgtgtaccccgtgttcctgttctacttcgtgatcagctggatgatcctgaccttcaccccccagtag

SEQ ID NO: 24015 - DNA, 567 bp, Artificial Sequence
  Description of Artificial Sequence: Synthetic coding sequence
atggccgaggccgaggagagccccggcgaccccggcaccgccagccccagacccctgatgagagacctgaaggccgtgggcaagaagttcatgcacgtgctgtaccccagaaagagcaacaccctgctgagagactgggacctgtggggccccctgatcctgtgcgtgaccctggccctgatgctgcagagagacagcgccgacagcgagaaggacggcggcccccagttcgccgaggtgttcgtgatcgtgtggttcggcgccgtgaccatcaccctgaacagcaagctgctgggcggcaacatcagcttcttccagagcctgtgcgtgctgggctactgcatcctgcccctgaccgtggccatgctgatctgcagactggtgctgctggccgaccccggccccgtgaacttcatggtgagactgttcgtggtgatcgtgatgttcgcctggagcatcgtggccagcaccgccttcctggccgacagccagccccccaacagaagagccctggccgtgtaccccgtgttcctgttctacttcgtgatcagctggatgatcctgtag

SEQ ID NO: 24016 - DNA, 711 bp, Artificial Sequence
  Description of Artificial Sequence: Synthetic coding sequence
atggccgaggccgaggagagccccggcgaccccggcaccgccagccccagacccctgttcgccggcctgagcgacatcagcatcagccaggacatccccgtggagggcgagatcaccatccccatgagaagcagaatcagagagttcgacagcagcaccctgaacgagagcgtgagaaacaccatcatgagagacctgaaggccgtgggcaagaagttcatgcacgtgctgtaccccagaaagagcaacaccctgctgagagactgggacctgtggggccccctgatcctgtgcgtgaccctggccctgatgctgcagagagacagcgccgacagcgagaaggacggcggcccccagttcgccgaggtgttcgtgatcgtgtggttcggcgccgtgaccatcaccctgaacagcaagctgctgggcggcaacatcagcttcttccagagcctgtgcgtgctgggctactgcatcctgcccctgaccgtggccatgctgatctgcagactggtgctgctggccgaccccggccccgtgaacttcatggtgagactgttcgtggtgatcgtgatgttcgcctggagcatcgtggccagcaccgccttcctggccgacagccagccccccaacagaagagccctggccgtgtaccccgtgttcctgttctacttcgtgatcagctggatgatcctgaccttcaccccccagtag

SEQ ID NO: 24017 - DNA, 843 bp, Artificial Sequence
  Description of Artificial Sequence: Synthetic coding sequence
atggacctgctgaagatcagccacaccaagctgcacctgctggaggacctgagcatcaagaacaagcagagaatgagcaacctggcccagttcgacagcgacttctaccagagcaacttcaccatcgacaaccaggagcagagcggcaacgacagcaacgcctacggcaacctgtacggcagcagaaagcagcaggccggcgagcagccccagcccgccagcttcgtgcccagcgagatgctgatgagcagcggctacgccggccagttcttccagcccgccagcaacagcgactactacagccagagcccctacatcgacagcttcgacgaggagccccccctgctggaggagctgggcatccacttcgaccacatctggcagaagaccctgaccgtgctgaaccccatgaagcccgtggacggcagcatcatgaacgagaccgacctgaccggccccatcctgttctgcgtggccctgggcgccaccctgctgctggccggcaaggtgcagttcggctacgtgtacggcatgagcgccatcggctgcctggtgatccacgccctgctgaacctgatgagcagcagcggcgtgagctacggctgcgtggccagcgtgctgggctactgcctgctgcccatggtgatcctgagcggctgcgccatgttcttcagcctgcagggcatcttcggcatcatgagcagcctggtgatcatcggctggtgcagcctgagcgccagcaagatcttcatcgccgccctgcacatggagggccagcagctgctggtggcctacccctgcgccatcctgtacggcctgttcgccctgctgaccatcttctag

SEQ ID NO: 24018 - DNA, 774 bp, Artificial Sequence
  Description of Artificial Sequence: Synthetic coding sequence
tgaatgagcaacctggcccagttcgacagcgacttctaccagagcaacttcaccatcgacaaccaggagcagagcggcaacgacagcaacgcctacggcaacctgtacggcagcagaaagcagcaggccggcgagcagccccagcccgccagcttcgtgcccagcgagatgctgatgagcagcggctacgccggccagttcttccagcccgccagcaacagcgactactacagccagagcccctacatcgacagcttcgacgaggagccccccctgctggaggagctgggcatccacttcgaccacatctggcagaagaccctgaccgtgctgaaccccatgaagcccgtggacggcagcatcatgaacgagaccgacctgaccggccccatcctgttctgcgtggccctgggcgccaccctgctgctggccggcaaggtgcagttcggctacgtgtacggcatgagcgccatcggctgcctggtgatccacgccctgctgaacctgatgagcagcagcggcgtgagctacggctgcgtggccagcgtgctgggctactgcctgctgcccatggtgatcctgagcggctgcgccatgttcttcagcctgcagggcatcttcggcatcatgagcagcctggtgatcatcggctggtgcagcctgagcgccagcaagatcttcatcgccgccctgcacatggagggccagcagctgctggtggcctacccctgcgccatcctgtacggcctgttcgccctgctgaccatcttctag

SEQ ID NO: 24019 - DNA, 900 bp, Artificial Sequence
  Description of Artificial Sequence: Synthetic coding sequence
atgcccggcagcgccagcaagagaagaatccccgtgagccagcccggcatggccgacccccaccagctgttcgacgacaccagcagcgcccagagcagaggctacggcgcccagagagcccccggcggcctgagctaccccgccgccagccccaccccccacgccgccttcctggccgaccccgtgagcaacatggccatggcctacggcagcagcctggccgcccagggcaaggagctggtggacaagaacatcgacagattcatccccatcaccaagctgaagtactacttcgccgtggacaccatgtacgtgggcagaaagctgggcctgctgttcttcccctacctgcaccaggactgggaggtgcagtaccagcaggacacccccgtggcccccagattcgacgtgaacgcccccgacctgtacatccccgccatggccttcatcacctacgtgctggtggccggcctggccctgggcacccaggacagattcagccccgacctgctgggcctgcaggccagcagcgccctggcctggctgaccctggaggtgctggccatcctgctgagcctgtacctggtgaccgtgaacaccgacctgaccaccatcgacctggtggccttcctgggctacaagtacgtgggcatgatcggcggcgtgctgatgggcctgctgttcggcaagatcggctactacctggtgctgggctggtgctgcgtggccatcttcgtgttcatgatcagaaccctgagactgaagatcctggccgacgccgccgccgagggcgtgcccgtgagaggcgccagaaaccagctgagaatgtacctgaccatggccgtggccgccgcccagcccatgctgatgtactggctgaccttccacctggtgagatag

SEQ ID NO: 24020 - DNA, 876 bp, Artificial Sequence
  Description of Artificial Sequence: Synthetic coding sequence
atgcaccccgccggcctggccgccgccgccgccggcacccccagactgcccagcaagagaagaatccccgtgagccagcccggcatggccgacccccaccagctgttcgacgacaccagcagcgcccagagcagaggctacggcgcccagagagcccccggcggcctgagctaccccgccgccagccccaccccccacgccgccttcctggccgaccccgtgagcaacatggccatggcctacggcagcagcctggccgcccagggcaaggagctggtggacaagaacatcgacagattcatccccatcaccaagctgaagtactacttcgccgtggacaccatgtacgtgggcagaaagctgggcctgctgttcttcccctacctgcaccaggactgggaggtgcagtaccagcaggacacccccgtggcccccagattcgacgtgaacgcccccgacctgtacatccccgccatggccttcatcacctacgtgctggtggccggcctggccctgggcacccaggacagattcagccccgacctgctgggcctgcaggccagcagcgccctggcctggctgaccctggaggtgctggccatcctgctgagcctgtacctggtgaccgtgaacaccgacctgaccaccatcgacctggtggccttcctgggctacaagtacgtgggcatgatcggcggcgtgctgatgggcctgctgttcggcaagatcggctactacctggtgctgggctggtgctgcgtggccatcttcgtgttcatgttccccctgctgcccggcgccgtggcccacgcctgcaaccccagcaccctgggcggcagaggcggcagaatcaccagaagcggcagatgcggctag

SEQ ID NO: 24021 - DNA, 945 bp, Artificial Sequence
  Description of Artificial Sequence: Synthetic coding sequence
atgcaccccgccggcctggccgccgccgccgccggcacccccagactgagaaagtggcccagcaagagaagaatccccgtgagccagcccggcatggccgacccccaccagctgttcgacgacaccagcagcgcccagagcagaggctacggcgcccagagagcccccggcggcctgagctaccccgccgccagccccaccccccacgccgccttcctggccgaccccgtgagcaacatggccatggcctacggcagcagcctggccgcccagggcaaggagctggtggacaagaacatcgacagattcatccccatcaccaagctgaagtactacttcgccgtggacaccatgtacgtgggcagaaagctgggcctgctgttcttcccctacctgcaccaggactgggaggtgcagtaccagcaggacacccccgtggcccccagattcgacgtgaacgcccccgacctgtacatccccgccatggccttcatcacctacgtgctggtggccggcctggccctgggcacccaggacagattcagccccgacctgctgggcctgcaggccagcagcgccctggcctggctgaccctggaggtgctggccatcctgctgagcctgtacctggtgaccgtgaacaccgacctgaccaccatcgacctggtggccttcctgggctacaagtacgtgggcatgatcggcggcgtgctgatgggcctgctgttcggcaagatcggctactacctggtgctgggctggtgctgcgtggccatcttcgtgttcatgatcagaaccctgagactgaagatcctggccgacgccgccgccgagggcgtgcccgtgagaggcgccagaaaccagctgagaatgtacctgaccatggccgtggccgccgcccagcccatgctgatgtactggctgaccttccacctggtgagatag

SEQ ID NO: 24022 - DNA, 852 bp, Artificial Sequence
  Description of Artificial Sequence: Synthetic coding sequence
atggccgacccccaccagctgttcgacgacaccagcagcgcccagagcagaggctacggcgcccagagagcccccggcggcctgagctaccccgccgccagccccaccccccacgccgccttcctggccgaccccgtgagcaacatggccatggcctacggcagcagcctggccgcccagggcaaggagctggtggacaagaacatcgacagattcatccccatcaccaagctgaagtactacttcgccgtggacaccatgtacgtgggcagaaagctgggcctgctgttcttcccctacctgcaccaggactgggaggtgcagtaccagcaggacacccccgtggcccccagattcgacgtgaacgcccccgacctgtacatccccgccatggccttcatcacctacgtgctggtggccggcctggccctgggcacccaggacagattcagccccgacctgctgggcctgcaggccagcagcgccctggcctggctgaccctggaggtgctggccatcctgctgagcctgtacctggtgaccgtgaacaccgacctgaccaccatcgacctggtggccttcctgggctacaagtacgtgggcatgatcggcggcgtgctgatgggcctgctgttcggcaagatcggctactacctggtgctgggctggtgctgcgtggccatcttcgtgttcatgatcagaaccctgagactgaagatcctggccgacgccgccgccgagggcgtgcccgtgagaggcgccagaaaccagctgagaatgtacctgaccatggccgtggccgccgcccagcccatgctgatgtactggctgaccttccacctggtgagatag

SEQ ID NO: 24023 - DNA, 609 bp, Artificial Sequence
  Description of Artificial Sequence: Synthetic coding sequence
atgagcggcagaagcgtgagagccgagaccagaagcagagccaaggacgacatcaagaaggtgatggccgccatcgagaaggtgagaaagtgggagaagaagtgggtgaccgtgggcgacaccagcctgagaatcttcaagtgggtgcccgtgaccgacagcaaggagaaggagaagagcaagagcaacagcagcgccgccagagagcccaacggcttccccagcgacgccagcgccaacagcagcctgctgctggagttccaggacgagaacagcaaccagagcagcgtgagcgacgtgtaccagctgaaggtggacagcagcaccaacagcagccccagcccccagcagagcgagagcctgagccccgcccacaccagcgacttcagaaccgacgacagccagccccccaccctgggccaggagatcctggaggagcccagcctgcccagcagcgaggtggccgacgagccccccaccctgaccaaggaggagcccgtgcccctggagacccaggtggtggaggaggaggaggacagcggcgccccccccctgaagagattctgcgtggaccagcccaccgtgccccagaccgccagcgagagctag

SEQ ID NO: 24024 - DNA, 495 bp, Artificial Sequence
  Description of Artificial Sequence: Synthetic coding sequence
atgaagctgtacagcctgagcgtgctgtacaagggcgaggccaaggtggtgctgctgaaggccgcctacgacgtgagcagcttcagcttcttccagagaagcagcgtgcaggagttcatgaccttcaccagccagctgatcgtggagagaagcagcaagggcaccagagccagcgtgaaggagcaggactacctgtgccacgtgtacgtgagaaacgacagcctggccggcgtggtgatcgccgacaacgagtaccccagcagagtggccttcaccctgctggagaaggtgctggacgagttcagcaagcaggtggacagaatcgactggcccgtgggcagccccgccaccatccactaccccgccctggacggccacctgagcagataccagaaccccagagaggccgaccccatgaccaaggtgcaggccgagctggacgagaccaagatcatcctggccagaaagcagaacagctgctgcgccatcatgtag

SEQ ID NO: 24025 - DNA, 1119 bp, Artificial Sequence
  Description of Artificial Sequence: Synthetic coding sequence
atggccagcaacgaggacttcagcatcacccaggacctggagatccccgccgacatcgtggagctgcacgacatcaacgtggagcccctgcccatggaggacatccccaccgagagcgtgcagtacgaggacgtggacggcaactggatctacggcggccacaaccacccccccctgatggtgctgcagcccctgttcaccaacaccggctacggcgaccacgaccaggagatgctgatgctgcagacccaggaggaggtggtgggctactgcgacagcgacaaccagctgggcaacgacctggaggaccagctggccctgcccgacagcatcgaggacgagcacttccagatgaccctggccagcctgagcgccagcgccgccagcaccagcaccagcacccagagcagaagcaagaagcccagcaagaagcccagcggcaagagcgccaccagcaccgaggccaaccccgccggcagcagcagcagcctgggcaccagaaagtgggagcagaagcagatgcaggtgaagaccctggagggcgagttcagcgtgaccatgtggagccccaacgacaacaacgaccagggcgccgtgggcgagggccaggccgagaacccccccgactacagcgagtacctgaagggcaagaagctgccccccggcggcctgcccggcatcgacctgagcgaccccaagcagctggccgagttcaccaaggtgaagcccaagagaagcaagggcgagccccccaagaccgtgccctgcagctacagcggctgcgagaagatgttcagagactacgccgccatgagaaagcacctgcacatccacggccccagagtgcacgtgtgcgccgagtgcggcaaggccttcctggagagcagcaagctgagaagacaccagctggtgcacaccggcgagaagcccttccagtgcaccttcgagggctgcggcaagagattcagcctggacttcaacctgagaacccacctgagaatccacaccggcgacaagcccttcgtgtgccccttcgacgtgtgcaacagaaagttcgcccagagcaccaacctgaagacccacatcctgacccacgtgaagaccaagaacaacccctag

SEQ ID NO: 24026 - DNA, 2301 bp, Artificial Sequence
  Description of Artificial Sequence: Synthetic coding sequence
atggccagcgacacccccgagagcctgatggccctgtgcaccgacttctgcctgagaaacctggacggcaccctgggctacctgctggacaaggagaccctgagactgcaccccgacatcttcctgcccagcgagatctgcgacagactggtgaacgagtacgtggagctggtgaacgccgcctgcaacttcgagccccacgagagcttcttcagcctgttcagcgaccccagaagcaccagactgaccagaatccacctgagagaggacctggtgcaggaccaggacctggaggccatcagaaagcaggacctggtggagctgtacctgaccaactgcgagaagctgagcgccaagagcctgcagaccctgagaagcttcagccacaccctggtgagcctgagcctgttcggctgcaccaacatcttctacgaggaggagaaccccggcggctgcgaggacgagtacctggtgaaccccacctgccaggtgctggtgaaggacttcaccttcgagggcttcagcagactgagattcctgaacctgggcagaatgatcgactgggtgcccgtggagagcctgctgagacccctgaacagcctggccgccctggacctgagcggcatccagaccagcgacgccgccttcctgacccagtggaaggacagcctggtgagcctggtgctgtacaacatggacctgagcgacgaccacatcagagtgatcgtgcagctgcacaagctgagacacctggacatcagcagagacagactgagcagctactacaagttcaagctgaccagagaggtgctgagcctgttcgtgcagaagctgggcaacctgatgagcctggacatcagcggccacatgatcctggagaactgcagcatcagcaagatggaggaggaggccggccagaccagcatcgagcccagcaagagcagcatcatccccttcagagccctgaagagacccctgcagttcctgggcctgttcgagaacagcctgtgcagactgacccacatccccgcctacaaggtgagcggcgacaagaacgaggagcaggtgctgaacgccatcgaggcctacaccgagcacagacccgagatcaccagcagagccatcaacctgctgttcgacatcgccagaatcgagagatgcaaccagctgctgagagccctgaagctggtgatcaccgccctgaagtgccacaagtacgacagaaacatccaggtgaccggcagcgccgccctgttctacctgaccaacagcgagtacagaagcgagcagagcgtgaagctgagaagacaggtgatccaggtggtgctgaacggcatggagagctaccaggaggtgaccgtgcagagaaactgctgcctgaccctgtgcaacttcagcatccccgaggagctggagttccagtacagaagagtgaacgagctgctgctgagcatcctgaaccccaccagacaggacgagagcatccagagaatcgccgtgcacctgtgcaacgccctggtgtgccaggtggacaacgaccacaaggaggccgtgggcaagatgggcttcgtggtgaccatgctgaagctgatccagaagaagctgctggacaagacctgcgaccaggtgatggagttcagctggagcgccctgtggaacatcaccgacgagacccccgacaactgcgagatgttcctgaacttcaacggcatgaagctgttcctggactgcctgaaggagttccccgagaagcaggagctgcacagaaacatgctgggcctgctgggcaacgtggccgaggtgaaggagctgagaccccagctgatgaccagccagttcatcagcgtgttcagcaacctgctggagagcaaggccgacggcatcgaggtgagctacaacgcctgcggcgtgctgagccacatcatgttcgacggccccgaggcctggggcgtgtgcgagccccagagagaggaggtggaggagagaatgtgggccgccatccagagctgggacatcaacagcagaagaaacatcaactacagaagcttcgagcccatcctgagactgctgccccagggcatcagccccgtgagccagcactgggccacctgggccctgtacaacctggtgagcgtgtaccccgacaagtactgccccctgctgatcaaggagggcggcatgcccctgctgagagacatcatcaagatggccaccgccagacaggagaccaaggagatggccagaaaggtgatcgagcactgcagcaacttcaaggaggagaacatggacaccagcagatag

SEQ ID NO: 24027 - DNA, 498 bp, Artificial Sequence
  Description of Artificial Sequence: Synthetic coding sequence
atggccagcgacacccccgagagcctgatggccctgtgcaccgacttctgcctgagaaacctggacggcaccctgggctacctgctggacaaggagaccctgagactgcaccccgacatcttcctgcccagcgagatctgcgacagactggtgaacgagtacgtggagctggtgaacgccgcctgcaacttcgagccccacgagagcttcttcagcctgttcagcgaccccagaagcaccagactgaccagaatccacctgagagaggacctggtgcaggaccaggacctggaggccatcagaaagcaggacctggtggagctgtacctgaccaactgcgagaagctgagcgccaagagcctgcagaccctgagaagcttcagccacaccctggtgagcctgagcctgttcggctgcaccaacatcttctacgaggaggagaaccccggcggctgcgaggacgagtacctggtgaaccccacctgccaggtgctgtag

SEQ ID NO: 24028 - DNA, 306 bp, Artificial Sequence
  Description of Artificial Sequence: Synthetic coding sequence
atggccagcgacacccccgagagcctgatggccctgtgcaccgacttctgcctgagaaacctggacggcaccctgggctacctgctggacaaggagaccctgagactgcaccccgacatcttcctgcccagcgagatctgcgacagactggtgaacgagtacgtggagctggtgaacgccgcctgcaacttcgagccccacgagagcttcttcagcctgttcagcgaccccagaagcaccagactgaccagaatccacctgagagaggacctggtgcaggaccaggacctggaggccatcagatag

SEQ ID NO: 24029 - DNA, 1239 bp, Artificial Sequence
  Description of Artificial Sequence: Synthetic coding sequence
atgatggccctgtggagcctgctgcacctgaccttcctgggcttcagcatcaccctgctgctggtgcacggccagggcttccagggcaccgccgccatctggcccagcctgttcaacgtgaacctgagcaagaaggtgcaggagagcatccagatccccaacaacggcagcgcccccctgctggtggacgtgagagtgttcgtgagcaacgtgttcaacgtggacatcctgagatacaccatgagcagcatgctgctgctgagactgagctggctggacaccagactggcctggaacaccagcgcccaccccagacacgccatcaccctgccctgggagagcctgtggacccccagactgaccatcctggaggccctgtgggtggactggagagaccagagcccccaggccagagtggaccaggacggccacgtgaagctgaacctggccctggccaccgagaccaactgcaacttcgagctgctgcacttccccagagaccacagcaactgcagcctgagcttctacgccctgagcaacaccgccatggagctggagttccaggcccacgtggtgaacgagatcgtgagcgtgaagagagagtacgtggtgtacgacctgaagacccaggtgcccccccagcagctggtgccctgcttccaggtgaccctgagactgaagaacaccgccctgaagagcatcatcgccctgctggtgcccgccgaggccctgctgctggccgacgtgtgcggcggcctgctgcccctgagagccatcgagagaatcggctacaaggtgaccctgctgctgagctacctggtgctgcacagcagcctggtgcaggccctgcccagcagcagcagctgcaaccccctgctgatctactacttcaccatcctgctgctgctgctgttcctgagcaccatcgagaccgtgctgctggccggcctgctggccagaggcaacctgggcgccaagagcggccccagccccgcccccagaggcgagcagagagagcacggcaaccccggcccccaccccgccgaggagcccagcagaggcgtgaagggcagccagagaagctggcccgagaccgccgacagaatcttcttcctggtgtacgtggtgggcgtgctgtgcacccagttcgtgttcgccggcatctggatgtgggccgcctgcaagagcgacgccgcccccggcgaggccgccccccacggcagaagacccagactgtag

SEQ ID NO: 24030 - DNA, 381 bp, Artificial Sequence
  Description of Artificial Sequence: Synthetic coding sequence
atgatggccctgtggagcctgctgcacctgaccttcctgggcttcagcatcaccctgctgctggtgcacggccagggcttccagggcaccgccgccatctggcccagcctgttcaacgtgaacctgagcaagaaggtgcaggagagcatccagatccccaacaacggcagcgcccccctgctggtggacgtgagagtgttcgtgagcaacgtgttcaacgtgagcagcgtgctgcccagagccaccgccctgcacagccacggcgactgcagcggcagcgccccctgcagcaaggccagaggcagcggctgccacggcctgacccccggcaaccacctgaaggtgcagcccccctgcatcaaccccagcggcgacatctag

SEQ ID NO: 24031 - DNA, 3393 bp, Artificial Sequence
  Description of Artificial Sequence: Synthetic coding sequence
atgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcaacgagagcgacctggagctggagaagaagtgcaaggaggacgacagagagaaggccagcaagagacccagaagccagaagaccgagaaggtgcagaagatcagcggcaaggaggccagacagctgagcggcgccaagaagcccatcatcagcgtggtgctgaccgcccacgaggccatccccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggagaccgccaccgaggcccccgaggagcccagcacccagtacctgcacatcaccgaggccgaggaggacgtgcagggcacccaggccgccgtggccgccctgcaggacctgagatacaccagcgagagcggcgacagactggaccccaccgccgtgaacatcctgcagcagatcatcgagctgggcgccgagacccacgacgccaccgccctggccagcgtggtggccatggcccccggcaccgtgaccgtggtgaagcaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 24032 - DNA, 3132 bp, Artificial Sequence
  Description of Artificial Sequence: Synthetic coding sequence
atggccatggccctggagctgcaggcccaggccagcccccagcccgagcccgaggagctgctgatcgtgaagctggaggaggacagctggggcagcgagagcaagctgtgggagaaggacagaggcagcgtgagcggccccgaggccagcagacagagattcagacagttccagtacagagacgccgccggcccccacgaggccttcagccagctgtgggccctgtgctgcagatggctgagacccgagatcagactgaaggagcagatcctggagctgctggtgctggagcagttcctgaccatcctgcccagagaggtgcagacctgggtgcaggccagacaccccgagagcggcgaggaggccgtggccctggtggaggactggcacagagagaccagaaccgccggccagagcggcctggagctgcacaccgaggagaccagacccctgaagaccggcgaggaggcccagagcttccagctgcagcccgtggacccctggcccgagggccagagccagaagaagggcgtgaagaacacctgccccgacctgcccaaccacctgaacgccgaggtggccccccagcccctgaaggagagcgccgtgctgacccccagagtgcccaccctgcccaagatgggcagcgtgggcgactgggaggtgaccgccgagagccaggaggccctgggccccggcaagcacgccgagaaggagctgtgcaaggacccccccggcgacgactgcggcaacagcgtgtgcctgggcgtgcccgtgagcaagcccagcaacaccagcgagaaggagcagggccccgagttctggggcctgagcctgatcaacagcggcaagagaagcaccgccgactacagcctggacaacgagcccgcccaggccctgacctggagagacagcagagcctgggaggagcagtaccagtgggacgtggaggacatgaaggtgagcggcgtgcactggggctacgaggagaccaagaccttcctggccatcctgagcgagagccccttcagcgagaagctgagaacctgccaccagaacagacaggtgtacagagccatcgccgagcagctgagagccagaggcttcctgagaaccctggagcagtgcagatacagagtgaagaacctgctgagaaactacagaaaggccaagagcagccacccccccggcacctgccccttctacgaggagctggaggccctggtgagagccagaaccgccatcagagccaccgacggccccggcgaggccgtggccctgcccagactgggctacagcgacgccgagatggacgagcaggaggagggcggctgggaccccgaggagatggccgaggactgcaacggcgccggcctggtgaacgtggagagcacccagggccccagaatcgccggcgcccccgccctgttccagagcagaatcgccggcgtgcactggggctacgaggagaccaaggccttcctggccatcctgagcgagagccccttcagcgagaagctgagaacctgccaccagaacagccaggtgtacagagccatcgccgagagactgtgcgccctgggcttcctgagaaccctggagcagtgcagatacagattcaagaacctgctgagaagctacagaaaggccaagagcagccacccccccggcacctgccccttctacgaggagctggacagcctgatgagagccagagccgccgtgagagccatgggcaccgtgagagaggccgccggcctgcccagatgcggccagagcagcgccgagaccgacgcccaggaggcctggggcgaggtggccaacgaggacgccgtgaagcccagcaccctgtgccccaaggcccccgacatgggcttcgagatgagacacgaggacgaggaccagatcagcgagcaggacatcttcgagggcctgcccggcgccctgagcaagtgccccaccgaggccgtgtgccagcccctggactggggcgaggacagcgagaacgagaacgaggacgagggccagtggggcaaccccagccaggagcagtggcaggagagcagcagcgaggaggacctggagaagctgatcgaccaccagggcctgtacctggccgagaagccctacaagtgcgacacctgcatgaagagcttcagcagaagcagccacttcatcgcccaccagagaatccacaccggcgagaagccctacaagtgcctggagtgcggcaagaacttcagcgacagaagcaacctgaacacccaccagagaatccacaccggcgagaagccctacaagtgcctggagtgcggcaagagcttcagcgaccacagcaacctgatcacccaccagagaatccacaccggcgagaagccctacaagtgcggcgagtgctggaagagcttcaaccagagcagcaacctgctgaagcaccagagaatccacctgggcggcaaccccgaccagtgcagcgagcccggcggcaacttcgcccagagccccagcttcagcgcccactggagaaacagcaccgaggagaccgcccccgagcagccccagagcatcagcaaggacctgaacagccccggcccccacagcaccaacagcggcgagaagctgtacgagtgcagcgagtgcggcagaagcttcagcaagagcagcgccctgatcagccaccagagaatccacaccggcgagaagccctacgagtgcgccgagtgcggcaagagcttcagcaagagcagcaccctggccaaccaccagagaacccacaccggcgagaagccctacaagtgcgtggactgcggcaagtgcttcagcgagagaagcaagctgatcacccaccagagagtgcacaccggcgagaagccctacaagtgcctggagtgcggcaagttcttcagagacagaagcaacctgatcacccaccagagaatccacaccggcgagaagccctacaagtgcagagagtgcggcaagtgcttcaaccagagcagcagcctgatcatccaccagagaatccacaccggcgagaagccctacaagtgcaccgagtgcggcaaggacttcaacaacagcagccacttcagcgcccacagaagaacccacgccggcggcaaggccagctag

SEQ ID NO: 24033 - DNA, 2934 bp, Artificial Sequence
  Description of Artificial Sequence: Synthetic coding sequence
atggccatggccctggagctgcaggcccaggccagcccccagcccgagcccgaggagctgctgatcgtgaagctggagctgctggtgctggagcagttcctgaccatcctgcccagagaggtgcagacctgggtgcaggccagacaccccgagagcggcgaggaggccgtggccctggtggaggactggcacagagagaccagaaccgccggccagagcggcctggagctgcacaccgaggagaccagacccctgaagaccggcgaggaggcccagagcttccagctgcagcccgtggacccctggcccgagggccagagccagaagaagggcgtgaagaacacctgccccgacctgcccaaccacctgaacgccgaggtggccccccagcccctgaaggagagcgccgtgctgacccccagagtgcccaccctgcccaagatgggcagcgtgggcgactgggaggtgaccgccgagagccaggaggccctgggccccggcaagcacgccgagaaggagctgtgcaaggacccccccggcgacgactgcggcaacagcgtgtgcctgggcgtgcccgtgagcaagcccagcaacaccagcgagaaggagcagggccccgagttctggggcctgagcctgatcaacagcggcaagagaagcaccgccgactacagcctggacaacgagcccgcccaggccctgacctggagagacagcagagcctgggaggagcagtaccagtgggacgtggaggacatgaaggtgagcggcgtgcactggggctacgaggagaccaagaccttcctggccatcctgagcgagagccccttcagcgagaagctgagaacctgccaccagaacagacaggtgtacagagccatcgccgagcagctgagagccagaggcttcctgagaaccctggagcagtgcagatacagagtgaagaacctgctgagaaactacagaaaggccaagagcagccacccccccggcacctgccccttctacgaggagctggaggccctggtgagagccagaaccgccatcagagccaccgacggccccggcgaggccgtggccctgcccagactgggctacagcgacgccgagatggacgagcaggaggagggcggctgggaccccgaggagatggccgaggactgcaacggcgccggcctggtgaacgtggagagcacccagggccccagaatcgccggcgcccccgccctgttccagagcagaatcgccggcgtgcactggggctacgaggagaccaaggccttcctggccatcctgagcgagagccccttcagcgagaagctgagaacctgccaccagaacagccaggtgtacagagccatcgccgagagactgtgcgccctgggcttcctgagaaccctggagcagtgcagatacagattcaagaacctgctgagaagctacagaaaggccaagagcagccacccccccggcacctgccccttctacgaggagctggacagcctgatgagagccagagccgccgtgagagccatgggcaccgtgagagaggccgccggcctgcccagatgcggccagagcagcgccgagaccgacgcccaggaggcctggggcgaggtggccaacgaggacgccgtgaagcccagcaccctgtgccccaaggcccccgacatgggcttcgagatgagacacgaggacgaggaccagatcagcgagcaggacatcttcgagggcctgcccggcgccctgagcaagtgccccaccgaggccgtgtgccagcccctggactggggcgaggacagcgagaacgagaacgaggacgagggccagtggggcaaccccagccaggagcagtggcaggagagcagcagcgaggaggacctggagaagctgatcgaccaccagggcctgtacctggccgagaagccctacaagtgcgacacctgcatgaagagcttcagcagaagcagccacttcatcgcccaccagagaatccacaccggcgagaagccctacaagtgcctggagtgcggcaagaacttcagcgacagaagcaacctgaacacccaccagagaatccacaccggcgagaagccctacaagtgcctggagtgcggcaagagcttcagcgaccacagcaacctgatcacccaccagagaatccacaccggcgagaagccctacaagtgcggcgagtgctggaagagcttcaaccagagcagcaacctgctgaagcaccagagaatccacctgggcggcaaccccgaccagtgcagcgagcccggcggcaacttcgcccagagccccagcttcagcgcccactggagaaacagcaccgaggagaccgcccccgagcagccccagagcatcagcaaggacctgaacagccccggcccccacagcaccaacagcggcgagaagctgtacgagtgcagcgagtgcggcagaagcttcagcaagagcagcgccctgatcagccaccagagaatccacaccggcgagaagccctacgagtgcgccgagtgcggcaagagcttcagcaagagcagcaccctggccaaccaccagagaacccacaccggcgagaagccctacaagtgcgtggactgcggcaagtgcttcagcgagagaagcaagctgatcacccaccagagagtgcacaccggcgagaagccctacaagtgcctggagtgcggcaagttcttcagagacagaagcaacctgatcacccaccagagaatccacaccggcgagaagccctacaagtgcagagagtgcggcaagtgcttcaaccagagcagcagcctgatcatccaccagagaatccacaccggcgagaagccctacaagtgcaccgagtgcggcaaggacttcaacaacagcagccacttcagcgcccacagaagaacccacgccggcggcaaggccagctag

SEQ ID NO: 24034 - DNA, 1284 bp, Artificial Sequence
  Description of Artificial Sequence: Synthetic coding sequence
atggccatggccctggagctgcaggcccaggccagcccccagcccgagcccgaggagctgctgatcgtgaagctggaggaggacagctggggcagcgagagcaagctgtgggagaaggacagaggcagcgtgagcggccccgaggccagcagacagagattcagacagttccagtacagagacgccgccggcccccacgaggccttcagccagctgtgggccctgtgctgcagatggctgagacccgagatcagactgaaggagcagatcctggagctgctggtgctggagcagttcctgaccatcctgcccagagaggtgcagacctgggtgcaggccagacaccccgagagcggcgaggaggccgtggccctggtggaggactggcacagagagaccagaaccgccggccagagcggcctggagctgcacaccgaggagaccagacccctgaagaccggcgaggaggcccagagcttccagctgcagcccgtggacccctggcccgagggccagagccagaagaagggcgtgaagaacacctgccccgacctgcccaaccacctgaacgccgaggtggccccccagcccctgaaggagagcggcgtgcccgtgagcaagcccagcaacaccagcgagaaggagcagggccccgagttctggggcctgagcctgatcaacagcggcaagagaagcaccgccgactacagcctggacaacgagcccgcccaggccctgacctggagagacagcagagcctgggaggagcagtaccagtgggacgtggaggacatgaaggtgagcggcgtgcactggggctacgaggagaccaagaccttcctggccatcctgagcgagagccccttcagcgagaagctgagaacctgccaccagaacagacaggtgtacagagccatcgccgagcagctgagagccagaggcttcctgagaaccctggagcagtgcagatacagagtgaagaacctgctgagaaactacagaaaggccaagagcagccacccccccggcacctgccccttctacgaggagctggaggccctggtgagagccagaaccgccatcagagccaccgacggccccggcgaggccgtggccctgcccagactgggctacagcgacgccgagatggacgagcaggaggagggcggctgggaccccgaggagatggccgaggactgcaacggcgccggcctggtgaacgtggagagcacccagggccccagaatcgccggcgcccccgccctgttccagagcagaatctag

SEQ ID NO: 24035 - DNA, 1302 bp, Artificial Sequence
  Description of Artificial Sequence: Synthetic coding sequence
atggccatggccctggagctgcaggcccaggccagcccccagcccgagcccgaggagctgctgatcgtgaagctggaggaggacagctggggcagcgagagcaagctgtgggagaaggacagaggcagcgtgagcggccccgaggccagcagacagagattcagacagttccagtacagagacgccgccggcccccacgaggccttcagccagctgtgggccctgtgctgcagatggctgagacccgagatcagactgaaggagcagatcctggagctgctggtgctggagcagttcctgaccatcctgcccagagaggtgcagacctgggtgcaggccagacaccccgagagcggcgaggaggccgtggccctggtggaggactggcacagagagaccagaaccgccggccagagcggcctggagctgcacaccgaggagaccagacccctgaagaccggcgaggaggcccagagcttccagctgcagcccgtggacccctggcccgagggccagagccagaagaagggcgtgaagaacacctgccccgacctgcccaaccacctgaacgccgaggtggccccccagcccctgaaggagagcggcgtgcccgtgagcaagcccagcaacaccagcgagaaggagcagggccccgagttctggggcctgagcctgatcaacagcggcaagagaagcaccgccgactacagcctggacaacgagcccgcccaggccctgacctggagagacagcagagcctgggaggagcagtaccagtgggacgtggaggacatgaaggtgagcggcgtgcactggggctacgaggagaccaagaccttcctggccatcctgagcgagagccccttcagcgagaagctgagaacctgccaccagaacagacaggtgtacagagccatcgccgagcagctgagagccagaggcttcctgagaaccctggagcagtgcagatacagagtgaagaacctgctgagaaactacagaaaggccaagagcagccacccccccggcacctgccccttctacgaggagctggaggccctggtgagagccagaaccgccatcagagccaccgacggccccggcgaggccgtggccctgcccagactgggctacagcgacgccgagatggacgagcaggaggagggcggctgggaccccgaggagatggccgaggactgcaacggcgccggcctggtgaacgtggagagcacccagggccccagaatcgccggcgcccccgccctgttccagagcagaatcggcaagaacatgggcgtgtag

SEQ ID NO: 24036 - DNA, 2934 bp, Artificial Sequence; identical to SEQ ID NO: 24033
  Description of Artificial Sequence: Synthetic coding sequence

SEQ ID NO: 24037 - DNA, 1800 bp, Artificial Sequence
  Description of Artificial Sequence: Synthetic coding sequence
atgagcggcccctgcggcgagaagcccgtgctggaggccagccccaccatgagcctgtgggagttcgaggacagccacagcagacagggcacccccagacccggccaggagctggccgccgaggaggccagcgccctggagctgcagatgaaggtggacttcttcagaaagctgggctacagcagcaccgagatccacagcgtgctgcagaagctgggcgtgcaggccgacaccaacaccgtgctgggcgagctggtgaagcacggcaccgccaccgagagagagagacagaccagccccgacccctgcccccagctgcccctggtgcccagaggcggcggcacccccaaggcccccaacctggagccccccctgcccgaggaggagaaggagggcagcgacctgagacccgtggtgatcgacggcagcaacgtggccatgagccacggcaacaaggaggtgttcagctgcagaggcatcctgctggccgtgaactggttcctggagagaggccacaccgacatcaccgtgttcgtgcccagctggagaaaggagcagcccagacccgacgtgcccatcaccgaccagcacatcctgagagagctggagaagaagaagatcctggtgttcacccccagcagaagagtgggcggcaagagagtggtgtgctacgacgacagattcatcgtgaagctggcctacgagagcgacggcatcgtggtgagcaacgacacctacagagacctgcagggcgagagacaggagtggaagagattcatcgaggagagactgctgatgtacagcttcgtgaacgacaagttcatgccccccgacgaccccctgggcagacacggccccagcctggacaacttcctgagaaagaagcccctgaccctggagcacagaaagcagccctgcccctacggcagaaagtgcacctacggcatcaagtgcagattcttccaccccgagagacccagctgcccccagagaagcgtggccgacgagctgagagccaacgccctgctgagcccccccagagcccccagcaaggacaagaacggcagaagacccagccccagcagccagagcagcagcctgctgaccgagagcgagcagtgcagcctggacggcaagaagctgggcgcccaggccagccccggcagcagacaggagggcctgacccagacctacgcccccagcggcagaagcctggcccccagcggcggcagcggcagcagcttcggccccaccgactggctgccccagaccctggacagcctgccctacgtgagccaggactgcctggacagcggcatcggcagcctggagagccagatgagcgagctgtggggcgtgagaggcggcggccccggcgagcccggcccccccagagccccctacaccggctacagcccctacggcagcgagctgcccgccaccgccgccttcagcgccttcggcagagccatgggcgccggccacttcagcgtgcccgccgactacccccccgccccccccgccttcccccccagagagtactggagcgagccctaccccctgcccccccccaccagcgtgctgcaggagccccccgtgcagagccccggcgccggcagaagcccctggggcagagccggcagcctggccaaggagcaggccagcgtgtacaccaagctgtgcggcgtgttccccccccacctggtggaggccgtgatgggcagattcccccagctgctggacccccagcagctggccgccgagatcctgagctacaagagccagcaccccagcgagtag

SEQ ID NO: 24038 - DNA, 1800 bp, Artificial Sequence; identical to SEQ ID NO: 24037
  Description of Artificial Sequence: Synthetic coding sequence

SEQ ID NO: 24039 - DNA, 1281 bp, Artificial Sequence
  Description of Artificial Sequence: Synthetic coding sequence
atgccccccaagaagcaggcccaggccggcggcagcaagaaggccgagcagaagaagaaggagaagatcatcgaggacaagaccttcggcctgaagaacaagaagggcgccaagcagcagaagttcatcaaggccgtgacccaccaggtgaagttcggccagcagaaccccagacaggtggcccagagcgaggccgagaagaagctgaagaaggacgacaagaagaaggagctgcaggagctgaacgagctgttcaagcccgtggtggccgcccagaagatcagcaagggcgccgaccccaagagcgtggtgtgcgccttcttcaagcagggccagtgcaccaagggcgacaagtgcaagttcagccacgacctgaccctggagagaaagtgcgagaagagaagcgtgtacatcgacgccagagacgaggagctggagaaggacaccatggacaactgggacgagaagaagctggaggaggtggtgaacaagaagcacggcgaggccgagaagaagaagcccaagacccagatcgtgtgcaagcacttcctggaggccatcgagaacaacaagtacggctggttctgggtgtgccccggcggcggcgacatctgcatgtacagacacgccctgccccccggcttcgtgctgaagaaggacaagaagaaggaggagaaggaggacgagatcagcctggaggacctgatcgagagagagagaagcgccctgggccccaacgtgaccaagatcaccctggagagcttcctggcctggaagaagagaaagagacaggagaagatcgacaagctggagcaggacatggagagaagaaaggccgacttcaaggccggcaaggccctggtgatcagcggcagagaggtgttcgagttcagacccgagctggtgaacgacgacgacgaggaggccgacgacaccagatacacccagggcaccggcggcgacgaggtggacgacagcgtgagcgtgaacgacatcgacctgagcctgtacatccccagagacgtggacgagaccggcatcaccgtggccagcctggagagattcagcacctacaccagcgacaaggacgagaacaagctgagcgaggccagcggcggcagagccgagaacggcgagagaagcgacctggaggaggacaacgagagagagggcaccgagaacggcgccatcgacgccgtgcccgtggacgagaacctgttcaccggcgaggacctggacgagctggaggaggagctgaacaccctggacctggaggagtag

SEQ ID NO: 24040 - DNA, 1179 bp, Artificial Sequence
  Description of Artificial Sequence: Synthetic coding sequence
atgccccccaagaagcaggcccaggccggcggcagcaagaaggccgagcagaagaagaaggagaagatcatcgaggacaagaccttcggcctgaagaacaagaagggcgccaagcagcagaagttcatcaaggccgtgacccaccaggtgaagttcggccagcagaaccccagacaggtggcccagagcgaggccgagaagaagctgaagaaggacgacaagaagaaggagctgcaggagctgaacgagctgttcaagcccgtggtggccgcccagaagatcagcaagggcgccgaccccaagagcgtggtgtgcgccttcttcaagcagggccagtgcaccaagggcgacaagtgcaagttcagccacgacctgaccctggagagaaagtgcgagaagagaagcgtgtacatcgacgccagagacgaggagctggagaaggacaccatggacaactgggacgagaagaagctggaggaggtggtgaacaagaagcacggcgaggccgagaagaagaagcccaagacccagatcgtgtgcaagcacttcctggaggccatcgagaacaacaagtacggctggttctgggtgtgccccggcggcggcgacatctgcatgtacagacacgccctgccccccggcttcgtgctgaagaaggacaagaagaaggaggagaaggaggacgagatcagcctggaggacctgatcgagagagagagaagcgccctgggccccaacgtgaccaagatcaccctggagagcttcctggcctggaagaagagaaagagacaggagaagatcgacaagctggagcaggacatggagagaagaaaggccgacttcaaggccggcaaggccctggtgatcagcggcagagaggtgttcgagttcagacccgagctggtgaacgacgacgacgaggaggccgacgacaccagatacacccagggcaccggcggcgacgaggtggacgacagcgtgagcgtgaacgacatcgacctgagcctgtacatccccagagacgtggacgagaccggcatcaccgtggccagcctggagagattcagcacctacaccagcgacaaggacgagaacaagctgagcgaggccagcggcggcagagccgagaacggcgagagaagcgacctggaggaggacaacgagagacacgtgctgtag

SEQ ID NO: 24041 - DNA, 489 bp, Artificial Sequence
  Description of Artificial Sequence: Synthetic coding sequence
atgtacagacacgccctgccccccggcttcgtgctgaagaaggacaagaagaaggaggagaaggaggacgagatcagcctggaggacctgatcgagagagagagaagcgccctgggccccaacgtgaccaagatcaccctggagagcttcctggcctggaagaagagaaagagacaggagaagatcgacaagctggagcaggacatggagagaagaaaggccgacttcaaggccggcaaggccctggtgatcagcggcagagaggtgttcgagttcagacccgagctggtgaacgacgacgacgaggaggccgacgacaccagatacacccagggcaccggcggcgacgaggtgagaggcagcttcgtgccccacctgctgatgctgatcgagagaaacaacagaaagtaccacaacatggtgaagagccaccagcaccagagccacagcgcctgggtgcagatcctgacccccaccatgggcaactag

SEQ ID NO: 24042 - DNA, 1269 bp, Artificial Sequence
  Description of Artificial Sequence: Synthetic coding sequence
atgttccagaccgcctggagacaggagcccgtgaccttcgaggacgtggccgtgtacttcacccagaacgagtgggccagcctggacagcgtgcagagagccctgtacagagaggtgatgctggagaactacgccaacgtggccagcctggccttccccttcaccacccccgtgctggtgagccagctggagcagggcgagctgccctggggcctggacccctgggagcccatgggcagagaggccctgagaggcatctgccccggcgacgaggccagaaccgagaaggagggcctgacccccaaggaccacgtgagcaaggagaccgagagcttcagactgatggtgggcggcctgcccggcaacgtgagccagcacctggacttcggcagcagcctggagcagccccagggccactggatcatcaagaccaagagcaagagaagacacttcaccgacaccagcgccagacaccacgaggcctacgaggtgaagaacggcgagaagttcgagaagctgggcaagaacatcagcgtgagcacccagctgaccaccaaccagaccaaccccagcggccagatcagctacgagtgcggccagtgcggcagatacttcatccagatggccgacttccacagacacgagaagtgccacaccggcgagaagagcttcgagtgcaaggagtgcggcaagtacttcagatacaacagcctgctgatcagacaccagatcatccacaccggcaagaagcccttcaagtgcaaggagtgcggcaagggcctgagcagcgacaccgccctgatccagcaccagagaatccacaccggcgagaagccctacgagtgcaaggagtgcggcaaggccttcagcagcagcagcgtgttcctgcagcaccagagattccacaccggcgagaagctgtacgagtgcaacgagtgctggaagaccttcagctgcagcagcagcttcaccgtgcaccagagaatgcacaccggcgagaagccctacgagtgcaaggagtgcggcaagagactgagcagcaacaccgccctgacccagcaccagagaatccacaccggcgagaagcccttcgagtgcaaggagtgcggcaaggccttcaaccagaagatcaccctgatccagcaccagagagtgcacaccggcgagaagccctacgagtgcaaggtgtgcggcaagaccttcagctggtgcggcagattcatcctgcaccagaagctgcacacccagaagacccccgtgcaggcctag

SEQ ID NO: 24043 - DNA, 354 bp, Artificial Sequence
  Description of Artificial Sequence: Synthetic coding sequence
atgttccagaccgcctggagacaggagcccgtgaccttcgaggacgtggccgtgtacttcacccagaacgagtgggccagcctggacagcgtgcagagagccctgtacagagaggtgatgctggagaactacgccaacgtggccagcctggccttccccttcaccacccccgtgctggtgagccagctggagcagggcgagctgccctggggcctggacccctgggagcccatgggcagagaggccctgagaggcatctgccccggcgacgaggccagaaccgagaaggagggcctgacccccaaggaccacgtgagcaaggagaccgagagcttcagactgatggtgggctag

SEQ ID NO: 24044 - DNA, 933 bp, Artificial Sequence
  Description of Artificial Sequence: Synthetic coding sequence
atgggcctgtgcaagtgccccaagagaaaggtgaccaacctgttctgcttcgagcacagagtgaacgtgtgcgagcactgcctggtggccaaccacgccaagtgcatcgtgcagagctacctgcagtggctgcaggacagcgactacaaccccaactgcagactgtgcaacatccccctggccagcagagagaccaccagactggtgtgctacgacctgttccactgggcctgcctgaacgagagagccgcccagctgcccagaaacaccgcccccgccggctaccagtgccccagctgcaacggccccatcttcccccccaccaacctggccggccccgtggccagcgccctgagagagaagctggccaccgtgaactgggccagagccggcctgggcctgcccctgatcgacgaggtggtgagccccgagcccgagcccctgaacaccagcgacttcagcgactggagcagcttcaacgccagcagcacccccggccccgaggaggtggacagcgccagcgccgcccccgccttctacagccaggcccccagaccccccgccagccccggcagacccgagcagcacaccgtgatccacatgggcaaccccgagcccctgacccacgcccccagaaaggtgtacgacaccagagacgacgacagaacccccggcctgcacggcgactgcgacgacgacaagtacagaagaagacccgccctgggctggctggccagactgctgagaagcagagccggcagcagaaagagacccctgaccctgctgcagagagccggcctgctgctgctgctgggcctgctgggcttcctggccctgctggccctgatgagcagactgggcagagccgccgccgacagcgaccccaacctggaccccctgatgaacccccacatcagagtgggccccagctag

SEQ ID NO: 24045 - DNA, 567 bp, Artificial Sequence
  Description of Artificial Sequence: Synthetic coding sequence
atgggcctgtgcaagtgccccaagagaaaggtgaccaacctgttctgcttcgagcacagagtgaacgtgtgcgagcactgcctggtggccaaccacgccaagtgcatcgtgcagagctacctgcagtggctgcaggacagcgactacaaccccaactgcagactgtgcaacatccccctggccagcagagagaccaccagactggtgtgctacgacctgttccactgggcctgcctgaacgagagagccgcccagctgcccagaaacaccgcccccgccggctaccagtgccccagctgcaacggccccatcttcccccccaccaacctggccggccccgtggccagcgccctgagagagaagctggccaccgtgaactgggccagagccggcctgggcctgcccctgatcgacgaggtggtgagccccgagcccgagcccctgaacaccagcgacttcagcgactggagcagcttcaacgccagcagcacccccggccccgaggaggtggacagcgccagcgccgcccccgccttctacagccaggcccccagaccccccgcctag

SEQ ID NO: 24046 - DNA, 624 bp, Artificial Sequence
  Description of Artificial Sequence: Synthetic coding sequence
atgggcctgtgcaagtgccccaagagaaaggtgaccaacctgttctgcttcgagcacagagtgaacgtgtgcgagcactgcctggtggccaaccacgccaagtgcatcgtgcagagctacctgcagtggctgcaggacagcgactacaaccccaactgcagactgtgcaacatccccctggccagcagagagaccaccagactggtgtgctacgacctgttccactgggcctgcctgaacgagagagccgcccagctgcccagaaacaccgcccccgccggctaccagtgccccagctgcaacggccccatcttcccccccaccaacctggccggccccgtggccagcgccctgagagagaagctggccaccgtgaactgggccagagccggcctgggcctgcccctgatcgacgaggtggtgagccccgagcccgagcccctgaacaccagcgacttcagcgactggagcagcttcaacgccagcagcacccccggccccgaggaggtggacagcgccagcgccgcccccgccttctacagccaggcccccagaccccccgccagccccggcagacccgagcagcacaccgtgatccacatgggcaaccccgagcccctgtag

SEQ ID NO: 24047 - DNA, 1458 bp, Artificial Sequence
  Description of Artificial Sequence: Synthetic coding sequence
atgtacaagatgaacatctgcaacaagcccagcaacaagaccgcccccgagaagagcgtgtggaccgcccccgcccagcccagcggccccagccccgagctgcagggccagagaagcagaagaaacggctggagctggcccccccaccccctgcagatcgtggcctggctgctgtacctgttcttcgccgtgatcggcttcggcatcctggtgcccctgctgccccaccactgggtgcccgccggctacgcctgcatgggcgccatcttcgccggccacctggtggtgcacctgaccgccgtgagcatcgaccccgccgacgccaacgtgagagacaagagctacgccggccccctgcccatcttcaacagaagccagcacgcccacgtgatcgaggacctgcactgcaacctgtgcaacgtggacgtgagcgccagaagcaagcactgcagcgcctgcaacaagtgcgtgtgcggcttcgaccaccactgcaagtggctgaacaactgcgtgggcgagagaaactacagactgttcctgcacagcgtggccagcgccctgctgggcgtgctgctgctggtgctggtggccacctacgtgttcgtggagttcttcgtgaaccccatgagactgagaaccaacagacacttcgaggtgctgaagaaccacaccgacgtgtggttcgtgttcctgcccgccgcccccgtggagacccaggcccccgccatcctggccctggccgccctgctgatcctgctgggcctgctgagcaccgccctgctgggccacctgctgtgcttccacatctacctgatgtggcacaagctgaccacctacgagtacatcgtgcagcacagacccccccaggaggccaagggcgtgcacagagagctggagagctgcccccccaagatgagacccatccaggagatggagttctacatgagaaccttcagacacatgagacccgagccccccggccaggccggccccgccgccgtgaacgccaagcacagcagacccgccagccccgaccccacccccggcagaagagactgcgccggcccccccgtgcaggtggagtgggacagaaagaagcccctgccctggagaagccccctgctgctgctggccatgtggggcccccaggcccccccctgcctgtgcagaaagagaggcagaggcgcctgcatcaagtgcgagagactgagacccagaatcagaagaagaggcctgggcccccccgccgccgcccccgccagaagaagaatccccagaacccccgccctgtgcacccccctggccctgcccgcccccaccaccagaagaagacagagcccctggaccagattccagtggagaagaagagcctgggccgcccccctgtggccccccagaggcgccggcgccgacagccccagatggagaggcagaagagtgagaccccccttcagctag

SEQ ID NO: 24048 - DNA, 1239 bp, Artificial Sequence
  Description of Artificial Sequence: Synthetic coding sequence
atggacaccagaagcggcagccagtgcagcgtgacccccgaggccatcctgaacaacgagaagctggtgctgccccccagaatcagcagagtgaacggctggagcctgcccctgcactacttccaggtggtgacctgggccgtgttcgtgggcctgagcagcgccaccttcggcatcttcatccccttcctgccccacgcctggaagtacatcgcctacgtggtgaccggcggcatcttcagcttccacctggtggtgcacctgatcgccagctgcatcgaccccgccgacagcaacgtgagactgatgaagaactacagccagcccatgcccctgttcgacagaagcaagcacgcccacgtgatccagaaccagttctgccacctgtgcaaggtgaccgtgaacaagaagaccaagcactgcatcagctgcaacaagtgcgtgagcggcttcgaccaccactgcaagtggatcaacaactgcgtgggcagcagaaactactggttcttcttcagcaccgtggccagcgccaccgccggcatgctgtgcctgatcgccatcctgctgtacgtgctggtgcagtacctggtgaaccccggcgtgctgagaaccgaccccagatacgaggacgtgaagaacatgaacacctggctgctgttcctgcccctgttccccgtgcaggtgcagaccctgatcgtggtgatcatcggcatgctggtgctgctgctggacttcctgggcctggtgcacctgggccagctgctgatcttccacatctacctgaaggccaagaagatgaccaccttcgagtacctgatcaacaacagaaaggaggagagcagcaagcaccaggccgtgagaaaggacccctacgtgcagatggacaagggcgtgctgcagcagggcgccggcgccctgggcagcagcgcccagggcgtgaaggccaagagcagcctgctgatccacaagcacctgtgccacttctgcaccagcgtgaaccaggacggcgacagcaccgccagagagggcgacgaggacccctgccccagcgccctgggcgccaaggccagaaacagcagactgatctgcagaagactgtgccagttcagcaccagagtgcaccccgacggcggcagcatggcccaggaggccgacgacgcccccagcatcagcaccctgggcctgcagcaggagaccaccgagcccatgaagaccgacagcgccgagagcgaggactag

SEQ ID NO: 24049 - DNA, 1239 bp, Artificial Sequence; identical to SEQ ID NO: 24048
  Description of Artificial Sequence: Synthetic coding sequence

SEQ ID NO: 24050 - DNA, 804 bp, Artificial Sequence
  Description of Artificial Sequence: Synthetic coding sequence
atggccccctgggccctgctgagccccggcgtgctggtgagaaccggccacaccgtgctgacctggggcatcaccctggtgctgttcctgcacgacaccgagctgagacagtgggaggagcagggcgagctgctgctgcccctgaccttcctgctgctggtgctgggcagcctgctgctgtacctggccgtgagcctgatggaccccggctacgtgaacgtgcagccccagccccaggaggagctgaaggaggagcagaccgccatggtgccccccgccatccccctgagaagatgcagatactgcctggtgctgcagcccctgagagccagacactgcagagagtgcagaagatgcgtgagaagatacgaccaccactgcccctggatggagaactgcgtgggcgagagaaaccaccccctgttcgtggtgtacctggccctgcagctggtggtgctgctgtggggcctgtacctggcctggagcggcctgagattcttccagccctggggccagtggctgagaagcagcggcctgctgttcgccaccttcctgctgctgagcctgttcagcctggtggccagcctgctgctggtgagccacctgtacctggtggccagcaacaccaccacctgggagttcatcagcagccacagaatcgcctacctgagacagagacccagcaaccccttcgacagaggcctgaccagaaacctggcccacttcttctgcggctggcccagcggcagctgggagaccctgtgggccgaggaggaggaggagggcagcagccccgccgtgtag

SEQ ID NO: 24051 - DNA, 648 bp, Artificial Sequence
  Description of Artificial Sequence: Synthetic coding sequence
atggccccctgggccctgctgagccccggcgtgctggtgagaaccggccacaccgtgctgacctggggcatcaccctggtgctgttcctgcacgacaccgagctgagacagtgggaggagcagggcgagctgctgctgcccctgaccttcctgctgctggtgctgggcagcctgctgctgtacctggccgtgagcctgatggaccccggctacgtgaacgtgcagccccagccccaggaggagctgaaggaggagcagaccgccatggtgccccccgccatccccctgagaagatgcagatactgcctggtgctgcagcccctgagagccagacactgcagagagtgcagaagatgcgtgagaagatacgaccaccactgcccctggatggagaactgcgtgggcgagagaaaccaccccctgttcgtggtgtacctggccctgcagctggtggtgctgctgtggggcctgtacctggcctggagcggcctgagattcttccagccctggggccagtggctgagaagcagcggcctgctgttcgccaccttcctgctgctgagccacttcttctgcggctggcccagcggcagctgggagaccctgtgggccgaggaggaggaggagggcagcagccccgccgtgtag

SEQ ID NO: 24052 - DNA, 846 bp, Artificial Sequence
  Description of Artificial Sequence: Synthetic coding sequence
atggccccctgggccctgctgagccccggcgtgctggtgagaaccggccacaccgtgctgacctggggcatcaccctggtgctgttcctgcacgacaccggcgagcccgaccccgagagacccagaacccaccccatcccccagctgagacagtgggaggagcagggcgagctgctgctgcccctgaccttcctgctgctggtgctgggcagcctgctgctgtacctggccgtgagcctgatggaccccggctacgtgaacgtgcagccccagccccaggaggagctgaaggaggagcagaccgccatggtgccccccgccatccccctgagaagatgcagatactgcctggtgctgcagcccctgagagccagacactgcagagagtgcagaagatgcgtgagaagatacgaccaccactgcccctggatggagaactgcgtgggcgagagaaaccaccccctgttcgtggtgtacctggccctgcagctggtggtgctgctgtggggcctgtacctggcctggagcggcctgagattcttccagccctggggccagtggctgagaagcagcggcctgctgttcgccaccttcctgctgctgagcctgttcagcctggtggccagcctgctgctggtgagccacctgtacctggtggccagcaacaccaccacctgggagttcatcagcagccacagaatcgcctacctgagacagagacccagcaaccccttcgacagaggcctgaccagaaacctggcccacttcttctgcggctggcccagcggcagctgggagaccctgtgggccgaggaggaggaggagggcagcagccccgccgtgtag

SEQ ID NO: 24053 - DNA, 648 bp, Artificial Sequence; identical to SEQ ID NO: 24051
  Description of Artificial Sequence: Synthetic coding sequence

SEQ ID NO: 24054 - DNA, 633 bp, Artificial Sequence
  Description of Artificial Sequence: Synthetic coding sequence
atggccccctgggccctgctgagccccggcgtgctggtgagaaccggccacaccgtgctgacctggggcatcaccctggtgctgttcctgcacgacaccgacaagagcgccgacgagctgctggccacccacagccacagctggaaccagcacctgcaggccttcgcccagcccggcacccacttccccaccagcaactgcacccccaccccccccacccccgtgctgcccggccccgccagcctgtgcagccccgccagccccgagctgagacagtgggaggagcagggcgagctgctgctgcccctgaccttcctgctgctggtgctgggcagcctgctgctgtacctggccgtgagcctgatggaccccggctacgtgaacgtgcagccccagccccaggaggagctgaaggaggagcagaccgccatggtgccccccgccatccccctgagaagatgcagatactgcctggtgctgcagcccctgagagccagacactgcagagagtgcagaagatgcgtgagaagatacgaccaccactgcccctggatggagaactgcgtgggcgagagaaaccaccccctgttcgtggtgtacctggccctgcagctggtggtgctgctgtggtag

SEQ ID NO: 24055 - DNA, 618 bp, Artificial Sequence
  Description of Artificial Sequence: Synthetic coding sequence
atggccccctgggccctgctgagccccggcgtgctggtgagaaccggccacaccgtgctgacctggggcatcaccctggtgctgttcctgcacgacaccgagctgagacagtgggaggagcagggcgagctgctgctgcccctgaccttcctgctgctggtgctgggcagcctgctgctgtacctggccgtgagcctgatggaccccggctacgtgaacgtgcagccccagccccaggaggagctgaaggaggagcagaccgccatggtgccccccgccatccccctgagaagatgcagatactgcctggtgctgcagcccctgagagccagacactgcagagagtgcagaagatgcgtgagaagatacgaccaccactgcccctggatggagaactgcgtgggcgagagaaaccaccccctgttcgtggtgtacctggccctgcagctggtggtgctgctgtggggcctgtacctggcctgcaccagacccctgagccccgccccccaggtgagaccccccgtgctgcccgccctgggcagcgtggtggccgtgcagagagcccccgtgagacacctgcccgccgccgtgcccctgctggtgggcggccagccctag

SEQ ID NO: 24056 - DNA, 1467 bp, Artificial Sequence
  Description of Artificial Sequence: Synthetic coding sequence
atgccccccggcggcggcggccccatgaaggactgcgagtacagccagatcagcacccacagcagcagccccatggagagcccccacaagaagaagaagatcgccgccagaagaaagtgggaggtgttccccggcagaaacaagttcttctgcaacggcagaatcatgatggccagacagaccggcgtgttctacctgaccctggtgctgatcctggtgaccagcggcctgttcttcgccttcgactgcccctacctggccgtgaagatcacccccgccatccccgccgtggccggcatcctgttcttcttcgtgatgggcaccctgctgagaaccagcttcagcgaccccggcgtgctgcccagagccacccccgacgaggccgccgacctggagagacagatcgacatcgccaacggcaccagcagcggcggctacagacccccccccagaaccaaggaggtgatcatcaacggccagaccgtgaagctgaagtactgcttcacctgcaagatcttcagaccccccagagccagccactgcagcctgtgcgacaactgcgtggagagattcgaccaccactgcccctgggtgggcaactgcgtgggcaagagaaactacagattcttctacatgttcatcctgagcctgagcttcctgaccgtgttcatcttcgccttcgtgatcacccacgtgatcctgagaagccagcagaccggcttcctgaacgccctgaaggacagccccgccagcgtgctggaggccgtggtgtgcttcttcagcgtgtggagcatcgtgggcctgagcggcttccacacctacctgatcagcagcaaccagaccaccaacgaggacatcaagggcagctggagcaacaagagaggcaaggagaactacaacccctacagctacggcaacatcttcaccaactgctgcgtggccctgtgcggccccatcagccccagcctgatcgacagaagaggctacatccagcccgacaccccccagcccgccgcccccagcaacggcatcaccatgtacggcgccacccagagccagagcgacatgtgcgaccaggaccagtgcatccagagcaccaagttcgtgctgcaggccgccgccacccccctgctgcagagcgagcccagcctgaccagcgacgagctgcacctgcccggcaagcccggcctgggcaccccctgcgccagcctgaccctgggcccccccaccccccccgccagcatgcccaacctggccgaggccaccctggccgacgtgatgcccagaaaggacgagcacatgggccaccagttcctgacccccgacgaggcccccagcccccccagactgctggccgccggcagccccctggcccacagcagaaccatgcacgtgctgggcctggccagccaggacagcctgcacgaggacagcgtgagaggcctggtgaagctgagcagcgtgtag

SEQ ID NO: 24057 - DNA, 1422 bp, Artificial Sequence
  Description of Artificial Sequence: Synthetic coding sequence
atgccccccggcggcggcggccccatgaaggactgcgagtacagccagatcagcacccacagcagcagccccatggagagcccccacaagaagaagaagatcgccgccagaagaaagtgggaggtgttccccggcagaaacaagttcttctgcaacggcagaatcatgatggccagacagaccggcgtgttctacctgaccctggtgctgatcctggtgaccagcggcctgttcttcgccttcgactgcccctacctggccgtgaagatcacccccgccatccccgccgtggccggcatcctgttcttcttcgtgatgggcaccctgctgagaaccagcttcagcgaccccggcgtgctgcccagagccacccccgacgaggccgccgacctggagagacagatcgacatcgccaacggcaccagcagcggcggctacagacccccccccagaaccaaggaggtgatcatcaacggccagaccgtgaagctgaagtactgcttcacctgcaagatcttcagaccccccagagccagccactgcagcctgtgcgacaactgcgtggagagattcgaccaccactgcccctgggtgggcaactgcgtgggcaagagaaactacagattcttctacatgttcatcctgagcctgagcttcctgaccgtgttcatcttcgccttcgtgatcacccacgtgatcctgagaagccagcagaccggcttcctgaacgccctgaaggacagccccgccagcgtgctggaggccgtggtgtgcttcttcagcgtgtggagcatcgtgggcctgagcggcttccacacctacctgatcagcagcaaccagaccaccaacgaggacatcaagggcagctggagcaacaagagaggcaaggagaactacaacccctacagctacggcaacatcttcaccaactgctgcgtggccctgtgcggccccatcagccccagcctgatcgacagaagaggctacatccagcccgacaccccccagcccgccgcccccagcaacggcatcaccatgtacggcgccacccagagccagagcgacatggccgccgccacccccctgctgcagagcgagcccagcctgaccagcgacgagctgcacctgcccggcaagcccggcctgggcaccccctgcgccagcctgaccctgggcccccccaccccccccgccagcatgcccaacctggccgaggccaccctggccgacgtgatgcccagaaaggacgagcacatgggccaccagttcctgacccccgacgaggcccccagcccccccagactgctggccgccggcagccccctggcccacagcagaaccatgcacgtgctgggcctggccagccaggacagcctgcacgaggacagcgtgagaggcctggtgaagctgagcagcgtgtag

SEQ ID NO: 24058 - DNA, 1479 bp, Artificial Sequence
  Description of Artificial Sequence: Synthetic coding sequence
gaggtggcccccgaggaggccggcggcggcggccccatgaaggactgcgagtacagccagatcagcacccacagcagcagccccatggagagcccccacaagaagaagaagatcgccgccagaagaaagtgggaggtgttccccggcagaaacaagttcttctgcaacggcagaatcatgatggccagacagaccggcgtgttctacctgaccctggtgctgatcctggtgaccagcggcctgttcttcgccttcgactgcccctacctggccgtgaagatcacccccgccatccccgccgtggccggcatcctgttcttcttcgtgatgggcaccctgctgagaaccagcttcagcgaccccggcgtgctgcccagagccacccccgacgaggccgccgacctggagagacagatcgacatcgccaacggcaccagcagcggcggctacagacccccccccagaaccaaggaggtgatcatcaacggccagaccgtgaagctgaagtactgcttcacctgcaagatcttcagaccccccagagccagccactgcagcctgtgcgacaactgcgtggagagattcgaccaccactgcccctgggtgggcaactgcgtgggcaagagaaactacagattcttctacatgttcatcctgagcctgagcttcctgaccgtgttcatcttcgccttcgtgatcacccacgtgatcctgagaagccagcagaccggcttcctgaacgccctgaaggacagccccgccagcgtgctggaggccgtggtgtgcttcttcagcgtgtggagcatcgtgggcctgagcggcttccacacctacctgatcagcagcaaccagaccaccaacgaggacatcaagggcagctggagcaacaagagaggcaaggagaactacaacccctacagctacggcaacatcttcaccaactgctgcgtggccctgtgcggccccatcagccccagcctgatcgacagaagaggctacatccagcccgacaccccccagcccgccgcccccagcaacggcatcaccatgtacggcgccacccagagccagagcgacatgtgcgaccaggaccagtgcatccagagcaccaagttcgtgctgcaggccgccgccacccccctgctgcagagcgagcccagcctgaccagcgacgagctgcacctgcccggcaagcccggcctgggcaccccctgcgccagcctgaccctgggcccccccaccccccccgccagcatgcccaacctggccgaggccaccctggccgacgtgatgcccagaaaggacgagcacatgggccaccagttcctgacccccgacgaggcccccagcccccccagactgctggccgccggcagccccctggcccacagcagaaccatgcacgtgctgggcctggccagccaggacagcctgcacgaggacagcgtgagaggcctggtgaagctgagcagcgtgtag

SEQ ID NO: 24059 - DNA, 891 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtgggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagacctaccaccagacccccccccccaccttcagcttcagagagagaatgacccacaagagcctggtgtacctgtggttcctgtgcagcagcgtggccctggccctgggcgccctgaccgtgtggcacgccgtgctgatcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24060 - DNA, 1086 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagacctaccaccagacccccccccccaccttcagcttcagagagagaatgacccacaagagcctggtgtacctgtggttcctgtgcagcagcgtggccctggccctgggcgccctgaccgtgtggcacgccgtgctgatcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24061 - DNA, 1017 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagctacggcagctgggacctgttcagagaggcctacgccgccatcgagaagatgaagcagctggacaagaacaagctgcaggccgtggccaaccagacctaccaccagacccccccccccaccttcagcttcagagagagaatgacccacaagagcctggtgtacctgtggttcctgtgcagcagcgtggccctggccctgggcgccctgaccgtgtggcacgccgtgctgatcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24062 - DNA, 1086 bp, Artificial Sequence; identical to SEQ ID NO: 24060
  Description of Artificial Sequence: Synthetic coding sequence

SEQ ID NO: 24063 - DNA, 924 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgccacatcctgccccccgccctgagcaagctgcccaccagcctgagacccagcttcctgagcagcgtggccctggccctgggcgccctgaccgtgtggcacgccgtgctgatcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24064 - DNA, 1134 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagaagatgaagcagctggacaagaacaagctgcaggccgtggccaaccagacctaccaccagacccccccccccaccttcagcttcagagagagaatgacccacaagagcctggtgtacctgtggttcctgtgcagcagcgtggccctggccctgggcgccctgaccgtgtggcacgccgtgctgatcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24065 - DNA, 1134 bp, Artificial Sequence; identical to SEQ ID NO: 24064
  Description of Artificial Sequence: Synthetic coding sequence

SEQ ID NO: 24066 - DNA, 642 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactag

SEQ ID NO: 24067 - DNA, 906 bp, Artificial Sequence
  Description of Artificial Sequence: Synthetic coding sequence
tgagccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagaagatgaagcagctggacaagaacaagctgcaggccgtggccaaccagacctaccaccagacccccccccccaccttcagcttcagagagagaatgacccacaagagcctggtgtacctgtggttcctgtgcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24068 - DNA, 960 bp, Artificial Sequence
  Description of Artificial Sequence: Synthetic coding sequence
tgaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtggtgttcgtggtgctggtgatcgtgctgaccggcagcatcgtggccatcgcctacctgtgcgtgctgcccctgatcctgagaacctacagcgtgcccagactgtgctggcacttcttctacagccactggaacctgatcctgatcgtgttccactactaccaggccatcaccaccccccccggctaccccccccagggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagacctaccaccagacccccccccccaccttcagcttcagagagagaatgacccacaagagcctggtgtacctgtggttcctgtgcagcagaggcgagaccagcatcgagagacacatcaacaagaaggagagaagaagactgcaggccaagggcagagtgttcagaaacccctacaactacggctgcctggacaactggaaggtgttcctgggcgtggacaccggcagacactggctgaccagagtgctgctgcccagcagccacctgccccacggcaacggcatgagctgggagccccccccctgggtgaccgcccacagcgccagcgtgatggccgtgtag

SEQ ID NO: 24069 - DNA, 729 bp, Artificial Sequence
  Description of Artificial Sequence: Synthetic coding sequence
atgagaggccagagaagcctgctgctgggccccgccagactgtgcctgagactgctgctgctgctgggctacagaagaagatgcccccccctgctgagaggcctggtgcagagatggagatacggcaaggtgtgcctgagaagcctgctgtacaacagcttcggcggcagcgacaccgccgtggacgccgccttcgagcccgtgtactggctggtggacaacgtgatcagatggttcggcgtgggcagaaacgacatcgccaccgtgagcatctgcaagaagtgcatctaccccaagcccgccagaacccaccactgcagcatctgcaacagatgcgtgctgaagatggaccaccactgcccctggctgaacaactgcgtgggccactacaaccacagatacttcttcagcttctgcttcttcatgaccctgggctgcgtgtactgcagctacggcagctgggacctgttcagagaggcctacgccgccatcgagaagatgaagcagctggacaagaacaagctgcaggccgtggccaaccagacctaccaccagacccccccccccaccttcagcttcagagagagaatgacccacaagagcctggtgtacctgtggttcctgtgcagcagcgtggccctggccctgggcgccctgaccgtgtggcacgccgtgctgatcagcagaggcgagaccagcatcgagagacacatcaacaagaaggagtag

SEQ ID NO: 24070 - DNA, 1167 bp, Artificial Sequence
  Description of Artificial Sequence: Synthetic coding sequence
atgaaggactgcgagtaccagcagatcagccccggcgccgcccccctgcccgccagccccggcgccagaagacccggccccgccgccagccccacccccggccccggccccgccccccccgccgcccccgccccccccagatggagcagcagcggcagcggcagcggcagcggcagcggcagcctgggcagaagacccagaagaaagtgggaggtgttccccggcagaaacagattctactgcggcggcagactgatgctggccggccacggcggcgtgttcgccctgaccctgctgctgatcctgaccaccaccggcctgttcttcgtgttcgactgcccctacctggccagaaagctgaccctggccatccccatcatcgccgccatcctgttcttcttcgtgatgagctgcctgctgcagaccagcttcaccgaccccggcatcctgcccagagccaccgtgtgcgaggccgccgccctggagaagcagatcgacaacaccggcagcagcacctacagacccccccccagaaccagagaggtgctgatcaacggccagatggtgaagctgaagtactgcttcacctgcaagatgttcagaccccccagaaccagccactgcagcgtgtgcgacaactgcgtggagagattcgaccaccactgcccctgggtgggcaactgcgtgggcagaagaaactacagattcttctacgccttcatcctgagcctgagcttcctgaccgccttcatcttcgcctgcgtggtgacccacctgaccctgagagcccagggcagcaacttcctgagcaccctgaaggagacccccgccagcgtgctggagctggtgatctgcttcttcagcatctggagcatcctgggcctgagcggcttccacacctacctggtggccagcaacctgaccaccaacgaggacatcaagggcagctggagcagcaagagaggcggcgaggccagcgtgaacccctacagccacaagagcatcatcaccaactgctgcgccgtgctgtgcggccccctgccccccagcctgatcgacagaagaggcttcgtgcagagcgacaccgtgctgcccagccccatcagaagcgacgagcccgcctgcagagccaagcccgacgccagcatggtgggcggccacccctag

SEQ ID NO: 24071 - DNA, 930 bp, Artificial Sequence
  Description of Artificial Sequence: Synthetic coding sequence
atgaccctgctgaccgacgccacccccctggtgaaggagccccaccccctgcccctggtgcccagaccctggttcctgcccagcctgttcgccgccttcaacgtggtgctgctggtgttcttcagcggcctgttcttcgccttcccctgcagatggctggcccagaacggcgagtgggccttccccgtgatcaccggcagcctgttcgtgctgaccttcttcagcctggtgagcctgaacttcagcgaccccggcatcctgcaccagggcagcgccgagcagggccccctgaccgtgcacgtggtgtgggtgaaccacggcgccttcagactgcagtggtgccccaagtgctgcttccacagaccccccagaacctaccactgcccctggtgcaacatctgcgtggaggacttcgaccaccactgcaagtgggtgaacaactgcatcggccacagaaacttcagattcttcatgctgctggtgctgagcctgtgcctgtacagcggcgccatgctggtgacctgcctgatcttcctggtgagaaccacccacctgcccttcagcaccgacaaggccatcgccatcgtggtggccgtgagcgccgccggcctgctggtgcccctgagcctgctgctgctgatccaggccctgagcgtgagcagcgccgacagaacctacaagggcaagtgcagacacctgcagggctacaaccccttcgaccagggctgcgccagcaactggtacctgaccatctgcgcccccctgggccccaagtacatggccgaggccgtgcagctgcagagagtggtgggccccgactggaccagcatgcccaacctgcacccccccatgagccccagcgccctgaacccccccgcccccaccagcggcagcctgcagagcagagagggcacccccggcgcctggtag

SEQ ID NO: 24072 - DNA, 1104 bp, Artificial Sequence
  Description of Artificial Sequence: Synthetic coding sequence
atggcccccagcggccccggcagcagcgccagaagaagatgcagaagagtgctgtactggatccccgtggtgttcatcaccctgctgctgggctggagctactacgcctacgccatccagctgtgcatcgtgagcatggagaacaccggcgagcaggtggtgtgcctgatggcctaccacctgctgttcgccatgttcgtgtggagctactggaagaccatcttcaccctgcccatgaaccccagcaaggagttccacctgagctacgccgagaaggacctgctggagagagagcccagaggcgaggcccaccaggaggtgctgagaagagccgccaaggacctgcccatctacaccagaaccatgagcggcgccatcagatactgcgacagatgccagctgatcaagcccgacagatgccaccactgcagcgtgtgcgacaagtgcatcctgaagatggaccaccactgcccctgggtgaacaactgcgtgggcttcagcaactacaagttcttcctgctgttcctggcctacagcctgctgtactgcctgttcatcgccgccaccgacctgcagtacttcatcaagttctggaccaacggcctgcccgacacccaggccaagttccacatcatgttcctgttcttcgccgccgccatgttcagcgtgagcctgagcagcctgttcggctaccactgctggctggtgagcaagaacaagagcaccctggaggccttcagaagccccgtgttcagacacggcaccgacaagaacggcttcagcctgggcttcagcaagaacatgagacaggtgttcggcgacgagaagaagtactggctgctgcccatcttcagcagcctgggcgacggctgcagcttccccacctgcctggtgaaccaggaccccgagcaggccagcacccccgccggcctgaacagcaccgccaagaacctggagaaccaccagttccccgccaagcccctgagagagagccagagccacctgctgaccgacagccagagctggaccgagagcagcatcaaccccggcaagtgcaaggccggcatgagcaaccccgccctgaccatggagaacgagacctag

SEQ ID NO: 24073 - DNA, 963 bp, Artificial Sequence
  Description of Artificial Sequence: Synthetic coding sequence
atggccccctggaccctgtggagatgctgccagagagtggtgggctgggtgcccgtgctgttcatcaccttcgtggtggtgtggagctactacgcctacgtggtggagctgtgcgtgttcaccatcttcggcaacgaggagaacggcaagaccgtggtgtacctggtggccttccacctgttcttcgtgatgttcgtgtggagctactggatgaccatcttcaccagccccgccagccccagcaaggagttctacctgagcaacagcgagaaggagagatacgagaaggagttcagccaggagagacagcaggagatcctgagaagagccgccagagccctgcccatctacaccaccagcgccagcaagaccatcagatactgcgagaagtgccagctgatcaagcccgacagagcccaccactgcagcgcctgcgacagctgcatcctgaagatggaccaccactgcccctgggtgaacaactgcgtgggcttcagcaactacaagttcttcctgctgttcctgctgtacagcctgctgtactgcctgttcgtggccgccaccgtgctggagtacttcatcaagttctggaccaacgagctgaccgacaccagagccaagttccacgtgctgttcctgttcttcgtgagcgccatgttcttcatcagcgtgctgagcctgttcagctaccactgctggctggtgggcaagaacagaaccaccatcgagagcttcagagcccccaccttcagctacggccccgacggcaacggcttcagcctgggctgcagcaagaactggagacaggtgttcggcgacgagaagaagtactggctgctgcccatcttcagcagcctgggcgacggctgcagcttccccaccagactggtgggcatggaccccgagcaggccagcgtgaccaaccagaacgagtacgccagaagaagcaagctgcagagatag

SEQ ID NO: 24074 - DNA, 1065 bp, Artificial Sequence
  Description of Artificial Sequence: Synthetic coding sequence
atggccccctggaccctgtggagatgctgccagagagtggtgggctgggtgcccgtgctgttcatcaccttcgtggtggtgtggagctactacgcctacgtggtggagctgtgcgtgttcaccatcttcggcaacgaggagaacggcaagaccgtggtgtacctggtggccttccacctgttcttcgtgatgttcgtgtggagctactggatgaccatcttcaccagccccgccagccccagcaaggagttctacctgagcaacagcgagaaggagagatacgagaaggagttcagccaggagagacagcaggagatcctgagaagagccgccagagccctgcccatctacaccaccagcgccagcaagaccatcagatactgcgagaagtgccagctgatcaagcccgacagagcccaccactgcagcgcctgcgacagctgcatcctgaagatggaccaccactgcccctgggtgaacaactgcgtgggcttcagcaactacaagttcttcctgctgttcctgctgtacagcctgctgtactgcctgttcgtggccgccaccgtgctggagtacttcatcaagttctggaccaacgagctgaccgacaccagagccaagttccacgtgctgttcctgttcttcgtgagcgccatgttcttcatcagcgtgctgagcctgttcagctaccactgctggctggtgggcaagaacagaaccaccatcgagagcttcagagcccccaccttcagctacggccccgacggcaacggcttcagcctgggctgcagcaagaactggagacaggtgttcggcgacgagaagaagtactggctgctgcccatcttcagcagcctgggcgacggctgcagcttccccaccagactggtgggcatggaccccgagcaggccagcgtgaccaaccagaacgagtacgccagaagcggcagcaaccagcccttccccatcaagcccctgagcgagagcaagaacagactgctggacagcgagagccagtggctggagaacggcgccgaggagggcatcgtgaagagcggcgtgtag

SEQ ID NO: 24075 - DNA, 1098 bp, Artificial Sequence
  Description of Artificial Sequence: Synthetic coding sequence
atggccccctggaccctgtggagatgctgccagagagtggtgggctgggtgcccgtgctgttcatcaccttcgtggtggtgtggagctactacgcctacgtggtggagctgtgcgtgttcaccatcttcggcaacgaggagaacggcaagaccgtggtgtacctggtggccttccacctgttcttcgtgatgttcgtgtggagctactggatgaccatcttcaccagccccgccagccccagcaaggagttctacctgagcaacagcgagaaggagagatacgagaaggagttcagccaggagagacagcaggagatcctgagaagagccgccagagccctgcccatctacaccaccagcgccagcaagaccatcagatactgcgagaagtgccagctgatcaagcccgacagagcccaccactgcagcgcctgcgacagctgcatcctgaagatggaccaccactgcccctgggtgaacaactgcgtgggcttcagcaactacaagttcttcctgctgttcctgctgtacagcctgctgtactgcctgttcgtggccgccaccgtgctggagtacttcatcaagttctggaccaacgagctgaccgacaccagagccaagttccacgtgctgttcctgttcttcgtgagcgccatgttcttcatcagcgtgctgagcctgttcagctaccactgctggctggtgggcaagaacagaaccaccatcgagagcttcagagcccccaccttcagctacggccccgacggcaacggcttcagcctgggctgcagcaagaactggagacaggtgttcggcgacgagaagaagtactggctgctgcccatcttcagcagcctgggcgacggctgcagcttccccaccagactggtgggcatggaccccgagcaggccagcgtgaccaaccagaacgagtacgccagaagcagcggcagcaaccagcccttccccatcaagcccctgagcgagagcaagaacagactgctggacagcgagagccagtggctggagaacggcgccgaggagggcatcgtgaagagcggcaccaacaaccacgtgaccgtggccatcgagaactag

SEQ ID NO: 24076 - DNA, 1098 bp, Artificial Sequence; identical to SEQ ID NO: 24075
  Description of Artificial Sequence: Synthetic coding sequence

SEQ ID NO: 24077 - DNA, 393 bp, Artificial Sequence
  Description of Artificial Sequence: Synthetic coding sequence
atggccccctggaccctgtggagatgctgccagagagtggtgggctgggtgcccgtgctgttcatcaccttcgtggtggtgtggagctactacgcctacgtggtggagctgtgcgtgttcaccatcttcggcaacgaggagaacggcaagaccgtggtgtacctggtggccttccacctgttcttcgtgatgttcgtgtggagctactggatgaccatcttcaccagccccgccagccccagcaaggagttctacctgagcaacagcgagaaggagagatacgagaaggagttcagccaggagagacagcaggagatcctgagaagagccgccagagccctgcccatctacaccaccagcgccagcaagagcctgatgcagagcaccaagtag

SEQ ID NO: 24078 - DNA, 879 bp, Artificial Sequence
  Description of Artificial Sequence: Synthetic coding sequence
atgttcgtgtggagctactggatgaccatcttcaccagccccgccagccccagcaaggagttctacctgagcaacagcgagaaggagagatacgagaaggagttcagccaggagagacagcaggagatcctgagaagagccgccagagccctgcccatctacaccaccagcgccagcaagaccatcagatactgcgagaagtgccagctgatcaagcccgacagagcccaccactgcagcgcctgcgacagctgcatcctgaagatggaccaccactgcccctgggtgaacaactgcgtgggcttcagcaactacaagttcttcctgctgttcctgctgtacagcctgctgtactgcctgttcgtggccgccaccgtgctggagtacttcatcaagttctggaccaacgagctgaccgacaccagagccaagttccacgtgctgttcctgttcttcgtgagcgccatgttcttcatcagcgtgctgagcctgttcagctaccactgctggctggtgggcaagaacagaaccaccatcgagagcttcagagcccccaccttcagctacggccccgacggcaacggcttcagcctgggctgcagcaagaactggagacaggtgttcggcgacgagaagaagtactggctgctgcccatcttcagcagcctgggcgacggctgcagcttccccaccagactggtgggcatggaccccgagcaggccagcgtgaccaaccagaacgagtacgccagaagcagcggcagcaaccagcccttccccatcaagcccctgagcgagagcaagaacagactgctggacagcgagagccagtggctggagaacggcgccgaggagggcatcgtgaagagcggcgtgtag

SEQ ID NO: 24079 - DNA, 798 bp, Artificial Sequence
  Description of Artificial Sequence: Synthetic coding sequence
atgggcctgagaatccacttcgtggtggacccccacggctggtgctgcatgggcctgatcgtgttcgtgtggctgtacaacatcgtgctgatccccaagatcgtgctgttcccccactacgaggagggccacatccccggcatcctgatcatcatcttctacggcatcagcatcttctgcctggtggccctggtgagagccagcatcaccgaccccggcagactgcccgagaaccccaagatcccccacggcgagagagagttctgggagctgtgcaacaagtgcaacctgatgagacccaagagaagccaccactgcagcagatgcggccactgcgtgagaagaatggaccaccactgcccctggatcaacaactgcgtgggcgaggacaaccactggctgttcctgcagctgtgcttctacaccgagctgctgacctgctacgccctgatgttcagcttctgccactactactacttcctgcccctgaagaagagaaacctggacctgttcgtgttcagacacgagctggccatcatgagactggccgccttcatgggcatcaccatgctggtgggcatcaccggcctgttctacacccagctgatcggcatcatcaccgacaccaccagcatcgagaagatgagcaactgctgcgaggacatcagcagacccagaaagccctggcagcagaccttcagcgaggtgttcggcaccagatggaagatcctgtggttcatccccttcagacagagacagcccctgagagtgccctaccacttcgccaaccacgtgtag

SEQ ID NO: 24080 - DNA, 792 bp, Artificial Sequence
  Description of Artificial Sequence: Synthetic coding sequence
atgctggccctgagactgctgaacgtggtggcccccgcctacttcctgtgcatcagcctggtgaccttcgtgctgcagctgttcctgttcctgcccagcatgagagaggaccccgccgccgccagactgttcagccccgccctgctgcacggcgccctgttcctgttcctgagcgccaacgccctgggcaactacgtgctggtgatccagaacagccccgacgacctgggcgcctgccagggcgccagcgccagaaagaccccctgccccagccccagcacccacttctgcagagtgtgcgccagagtgaccctgagacacgaccaccactgcttcttcaccggcaactgcatcggcagcagaaacatgagaaacttcgtgctgttctgcctgtacaccagcctggcctgcctgtacagcatggtggccggcgtggcctacatcagcgccgtgctgagcatcagcttcgcccaccccctggccttcctgaccctgctgcccaccagcatcagccagttcttcagcggcgccgtgctgggcagcgagatgttcgtgatcctgatgctgtacctgtggttcgccatcggcctggcctgcgccggcttctgctgccaccagctgctgctgatcctgagaggccagaccagacaccaggtgagaaagggcgtggccgtgagagccagaccctggagaaagaacctgcaggaggtgttcggcaagagatggctgctgggcctgctggtgcccatgttcaacgtgggcagcgagagcagcaagcagcaggacaagtag

SEQ ID NO: 24081 - DNA, 126 bp, Artificial Sequence
  Description of Artificial Sequence: Synthetic coding sequence
atgctggccctgagactgctgaacgtggtggcccccgcctacttcctgtgcatcagcctggtgaccttcgtgctgcagctgttcctgttcctgcccagcatgagagaggaccccgccgccgcctag

SEQ ID NO: 24082 - DNA, 330 bp, Artificial Sequence
  Description of Artificial Sequence: Synthetic coding sequence
atgctggccctgagactgctgaacgtggtggcccccgcctacttcctgtgcatcagcctggtgaccttcgtgctgcagctgttcctgttcctgcccagcatgagagaggaccccgccgccgccagactgttcagccccgccctgctgcacggcgccctgttcctgttcctgagcgccaacgccctgggcaactacgtgctggtgatccagaacagccccgacgacctgggcgcctgccagggcgccagcgccagaaagaccccctgccccagccccagcacccacttctgcagagtgtgcgccagagtgaccctgagacacgaccactag

SEQ ID NO: 24083 - DNA, 1230 bp, Artificial Sequence
  Description of Artificial Sequence: Synthetic coding sequence
atgacccagaagggcagcatgaagcccgtgaagaagaagaagaccgaggagcccgagctggagcccctgtgctgctgcgagtacatcgacagaaacggcgagaagaaccacgtggccacctgcctgtgcgactgccaggacctggacgagggctgcgacagatggatcacctgcaagagcctgcagcccgagacctgcgagagaatcatggacaccatcagcgacagactgagaatcccctggctgagaggcgccaagaaggtgaacatcagcatcatcccccccctggtgctgctgcccgtgttcctgcacgtggccagctggcacttcctgctgggcgtggtggtgctgaccagcctgcccgtgctggccctgtggtactactacctgacccacagaagaaaggagcagaccctgttcttcctgagcctgggcctgttcagcctgggctacatgtactacgtgttcctgcaggaggtggtgcccaagggcagagtgggccccgtgcagctggccgtgctgacctgcggcctgttcctgatcctgctggccctgcacagagccaagaagaaccccggctacctgagcaaccccgccagcggcgacagaagcctgagcagcagccagctggagtgcctgagcagaaagggccaggagaagaccaagggcttccccggcgccgacatgagcggcagcctgaacaacagaaccaccaaggacgaccccaagggcagcagcaagatgcccgccggcagccccaccaaggccaaggaggactggtgcgccaagtgccagctggtgagacccgccagagcctggcactgcagaatctgcggcatctgcgtgagaagaatggaccaccactgcgtgtggatcaacagctgcgtgggcgagagcaaccaccaggccttcatcctggccctgctgatcttcctgctgaccagcgtgtacggcatcaccctgaccctggacaccatctgcagagacagaagcgtgttcaccgccctgttctactgccccggcgtgtacgccaactacagcagcgccctgagcttcacctgcgtgtggtacagcgtgatcatcaccgccggcatggcctacatcttcctgatccagctgatcaacatcagctacaacgtgaccgagagagaggtgcagcaggccctgagacagaagaccggcagaagactgctgtgcggcctgatcgtggacaccggcctgctgggctag

SEQ ID NO: 24084 - DNA, 447 bp, Artificial Sequence
  Description of Artificial Sequence: Synthetic coding sequence
atgacccagaagggcagcatgaagcccgtgaagaagaagaagaccgaggagcccgagctggagcccctgtgctgctgcgagtacatcgacagaaacggcgagaagaaccacgtggccacctgcctgtgcgactgccaggacctggacgagggctgcgacagatggatcacctgcaagagcctgcagcccgagacctgcgagagaatcatggacaccatcagcgacagactgagaatcccctggctgagaggcgccaagaaggtgaacatcagcatcatcccccccctggtgctgctgcccgtgttcctgcacgtggccagctggcacttcctgctgggcgtggtggtgctgaccagcctgcccgtgctggccctgtggtactactacctgacccacagaagaaaggagcagaccctgttcttcctgagcctgggcctgttcagctag

SEQ ID NO: 24085 - DNA, 855 bp, Artificial Sequence
  Description of Artificial Sequence: Synthetic coding sequence
atgggccagccctgggccgccggcagcaccgacggcgcccccgcccagctgcccctggtgctgaccgccctgtgggccgccgccgtgggcctggagctggcctacgtgctggtgctgggccccggccccccccccctgggccccctggccagagccctgcagctggccctggccgccttccagctgctgaacctgctgggcaacgtgggcctgttcctgagaagcgaccccagcatcagaggcgtgatgctggccggcagaggcctgggccagggctgggcctactgctaccagtgccagagccaggtgccccccagaagcggccactgcagcgcctgcagagtgtgcatcctgagaagagaccaccactgcagactgctgggcagatgcgtgggcttcggcaactacagacccttcctgtgcctgctgctgcacgccgccggcgtgctgctgcacgtgagcgtgctgctgggccccgccctgagcgccctgctgagagcccacacccccctgcacatggccgccctgctgctgctgccctggctgatgctgctgaccggcagagtgagcctggcccagttcgccctggccttcgtgaccgacacctgcgtggccggcgccctgctgtgcggcgccggcctgctgttccacggcatgctgctgctgagaggccagaccacctgggagtgggccagaggccagcacagctacgacctgggcccctgccacaacctgcaggccgccctgggccccagatgggccctggtgtggctgtggcccttcctggccagccccctgcccggcgacggcatcaccttccagaccaccgccgacgtgggccacaccgccagctag

SEQ ID NO: 24086 - DNA, 984 bp, Artificial Sequence
  Description of Artificial Sequence: Synthetic coding sequence
atgatgctgatccccacccaccacttcagaaacatcgagagaaagcccgagtacctgcagcccgagaagtgcgtgccccccccctaccccggccccgtgggcaccatgtggttcatcagagacggctgcggcatcgcctgcgccatcgtgacctggttcctggtgctgtacgccgagttcgtggtgctgttcgtgatgctgatccccagcagagactacgtgtacagcatcatcaacggcatcgtgttcaacctgctggccttcctggccctggccagccactgcagagccatgctgaccgaccccggcgccgtgcccaagggcaacgccaccaaggagttcatcgagagcctgcagctgaagcccggccaggtggtgtacaagtgccccaagtgctgcagcatcaagcccgacagagcccaccactgcagcgtgtgcaagagatgcatcagaaagatggaccaccactgcccctgggtgaacaactgcgtgggcgagaacaaccagaagtacttcgtgctgttcaccatgtacatcgccctgatcagcctgcacgccctgatcatggtgggcttccacttcctgcactgcttcgaggaggactggaccacctacggcctgaacagagaggagatggccgagaccggcatcagcctgcacgagaagatgcagcccctgaacttcagcagcaccgagtgcagcagcttcagcccccccaccaccgtgatcctgctgatcctgctgtgcttcgagggcctgctgttcctgatcttcaccagcgtgatgttcggcacccaggtgcacagcatctgcaccgacgagaccggcatcgagcagctgaagaaggaggagagaagatgggccaagaagaccaagtggatgaacatgaaggccgtgttcggccaccccttcagcctgggctgggccagccccttcgccacccccgaccagggcaaggccgacccctaccagtacgtggtgtag

SEQ ID NO: 24087 - DNA, 588 bp, Artificial Sequence
  Description of Artificial Sequence: Synthetic coding sequence
atcaagcccgacagagcccaccactgcagcgtgtgcaagagatgcatcagaaagatggaccaccactgcccctgggtgaacaactgcgtgggcgagaacaaccagaagtacttcgtgctgttcaccatgtacatcgccctgatcagcctgcacgccctgatcatggtgggcttccacttcctgcactgcttcgaggaggactggaccaagtgcagcagcttcagcccccccaccaccgtgatcctgctgatcctgctgtgcttcgagggcctgctgttcctgatcttcaccagcgtgatgttcggcacccaggtgcacagcatctgcaccgacgagaccggcatcgagagactgaagagaaagaaccagcccagagagcacatgggcagctggcagagcgtgaaggagaccttcggcggcgacttcagcctgaactggttcaaccccttcagcagaccctgccagcccgagatccccagcgacaaggacatggtgagacaggtgaccagcctgagcgacaccgagaccatggaggaccccagcgaggagaccaaggacgaggacagcgtggaggtgaccgacgagtag

SEQ ID NO: 24088 - DNA, 900 bp, Artificial Sequence
  Description of Artificial Sequence: Synthetic coding sequence
atgatgctgatccccacccaccacttcagaaacatcgagagaaagcccgagtacctgcagcccgagaagtgcgtgccccccccctaccccggccccgtgggcaccatgtggttcatcagagacggctgcggcatcgcctgcgccatcgtgacctggttcctggtgctgtacgccgagttcgtggtgctgttcgtgatgctgatccccagcagagactacgtgtacagcatcatcaacggcatcgtgttcaacctgctggccttcctggccctggccagccactgcagagccatgctgaccgaccccggcgccgtgcccaagggcaacgccaccaaggagttcatcgagagcctgcagctgaagcccggccaggtggtgtacaagtgccccaagtgctgcagcatcaagcccgacagagcccaccactgcagcgtgtgcaagagatgcatcagaaagatggaccaccactgcccctgggtgaacaactgcgtgggcgagaacaaccagaagtacttcgtgctgttcaccatgtacatcgccctgatcagcctgcacgccctgatcatggtgggcttccacttcctgcactgcttcgaggaggactggaccaagtgcagcagcttcagcccccccaccaccgtgatcctgctgatcctgctgtgcttcgagggcctgctgttcctgatcttcaccagcgtgatgttcggcacccaggtgcacagcatctgcaccgacgagaccggcatcgagcagctgaagaaggaggagagaagatgggccaagaagaccaagtggatgaacatgaaggccgtgttcggccaccccttcagcctgggctgggccagccccttcgccacccccgaccagggcaaggccgacccctaccagtacgtggtgtag

SEQ ID NO: 24089 - DNA, 1035 bp, Artificial Sequence
  Description of Artificial Sequence: Synthetic coding sequence
atggacttcctggtgctgttcctgttctacctggccagcgtgctgatgggcctggtgctgatctgcgtgtgcagcaagacccacagcctgaagggcctggccagaggcggcgcccagatcttcagctgcatcatccccgagtgcctgcagagagccgtgcacggcctgctgcactacctgttccacaccagaaaccacaccttcatcgtgctgcacctggtgctgcagggcatggtgtacaccgagtacacctgggaggtgttcggctactgccaggagctggagctgagcctgcactacctgctgctgccctacctgctgctgggcgtgaacctgttcttcttcaccctgacctgcggcaccaaccccggcatcatcaccaaggccaacgagctgctgttcctgcacgtgtacgagttcgacgaggtgatgttccccaagaacgtgagatgcagcacctgcgacctgagaaagcccgccagaagcaagcactgcagcgtgtgcaactggtgcgtgcacagattcgaccaccactgcgtgtgggtgaacaactgcatcggcgcctggaacatcagatacttcctgatctacgtgctgaccctgaccgccagcgccgccaccgtggccatcgtgagcaccaccttcctggtgcacctggtggtgatgagcgacctgtaccaggagacctacatcgacgacctgggccacctgcacgtgatggacaccgtgttcctgatccagtacctgttcctgaccttccccagaatcgtgttcatgctgggcttcgtggtggtgctgagcttcctgctgggcggctacctgctgttcgtgctgtacctggccgccaccaaccagaccaccaacgagtggtacagaggcgactgggcctggtgccagagatgccccctggtggcctggccccccagcgccgagccccaggtgcacagaaacatccacagccacggcctgagaagcaacctgcaggagatcttcctgcccgccttcccctgccacgagagaaagaagcaggagtag

SEQ ID NO: 24090 - DNA, 1035 bp, Artificial Sequence; identical to SEQ ID NO: 24089
  Description of Artificial Sequence: Synthetic coding sequence

SEQ ID NO: 24091 - DNA, 1035 bp, Artificial Sequence; identical to SEQ ID NO: 24089
  Description of Artificial Sequence: Synthetic coding sequence

SEQ ID NO: 24092 - DNA, 1035 bp, Artificial Sequence; identical to SEQ ID NO: 24089
  Description of Artificial Sequence: Synthetic coding sequence

SEQ ID NO: 24093 - DNA, 1035 bp, Artificial Sequence; identical to SEQ ID NO: 24089
  Description of Artificial Sequence: Synthetic coding sequence

SEQ ID NO: 24094 - DNA, 1035 bp, Artificial Sequence; identical to SEQ ID NO: 24089
  Description of Artificial Sequence: Synthetic coding sequence

SEQ ID NO: 24095 - DNA, 498 bp, Artificial Sequence
  Description of Artificial Sequence: Synthetic coding sequence
atggacttcctggtgctgttcctgttctacctggccagcgtgctgatgggcctggtgctgatctgcgtgtgcagcaagacccacagcctgaagggcctggccagaggcggcgcccagatcttcagctgcatcatccccgagtgcctgcagagagccgtgcacggcctgctgcactacctgttccacaccagaaaccacaccttcatcgtgctgcacctggtgctgcagggcatggtgtacaccgagtacacctgggaggtgttcggctactgccaggagctggagctgagcctgcactacctgctgctgccctacctgctgctgggcgtgaacctgttcttcttcaccctgacctgcggcaccaaccccggcatcatcaccaaggccaacgagctgctgttcctgcacgtgtacgagttcgacgaggtgatgttccccaagaacgtgagatgcagcacctgcgacctgagaaagcccgccagaagcaagcactgctag

SEQ ID NO: 24096 - DNA, 2148 bp, Artificial Sequence
  Description of Artificial Sequence: Synthetic coding sequence
atgcccgccgagagcggcaagagattcaagcccagcaagtacgtgcccgtgagcgccgccgccatcttcctggtgggcgccaccaccctgttcttcgccttcacctgccccggcctgagcctgtacgtgagccccgccgtgcccatctacaacgccatcatgttcctgttcgtgctggccaacttcagcatggccaccttcatggaccccggcatcttccccagagccgaggaggacgaggacaaggaggacgacttcagagcccccctgtacaagaccgtggagatcaagggcatccaggtgagaatgaagtggtgcgccacctgcagattctacagaccccccagatgcagccactgcagcgtgtgcgacaactgcgtggaggagttcgaccaccactgcccctgggtgaacaactgcatcggcagaagaaactacagatacttcttcctgttcctgctgagcctgaccgcccacatcatgggcgtgttcggcttcggcctgctgtacgtgctgtaccacatcgaggagctgagcggcgtgagaaccgccgtgaccatggccgtgatgtgcgtggccggcctgttcttcatccccgtggccggcctgaccggcttccacgtggtgctggtggccagaggcagaaccaccaacgagcaggtgaccggcaagttcagaggcggcgtgaaccccttcaccaacggctgctgcaacaacgtgagcagagtgctgtgcagcagccccgcccccagatacctgggcagacccaagaaggagaagaccatcgtgatcagaccccccttcctgagacccgaggtgagcgacggccagatcaccgtgaagatcatggacaacggcatccagggcgagctgagaagaaccaagagcaagggcagcctggagatcaccgagagccagagcgccgacgccgagcccccccccccccccaagcccgacctgagcagatacaccggcctgagaacccacctgggcctggccaccaacgaggacagcagcctgctggccaaggacagcccccccacccccaccatgtacaagtacagacccggctacagcagcagcagcaccagcgccgccatgccccacagcagcagcgccaagctgagcagaggcgacagcctgaaggagcccaccagcatcgccgagagcagcagacaccccagctacagaagcgagcccagcctggagcccgagagcttcagaagccccaccttcggcaagagcttccacttcgaccccctgagcagcggcagcagaagcagcagcctgaagagcgcccagggcaccggcttcgagctgggccagctgcagagcatcagaagcgagggcaccaccagcaccagctacaagagcctggccaaccagaccagaaacggcagcctgagctacgacagcctgctgacccccagcgacagccccgacttcgagagcgtgcaggccggccccgagcccgacccccccctgggctacaccagccccttcctgagcgccagactggcccagcagagagaggccgagagacaccccagactggtgcccaccggccccacccacagagagcccagccccgtgagatacgacaacctgagcagacacatcgtggccagcctgcaggagagagagaagctgctgagacagagcccccccctgcccggcagagaggaggagcccggcctgggcgacagcggcatccagagcacccccggcagcggccacgcccccagaaccagcagcagcagcgacgacagcaagagaagccccctgggcaagacccccctgggcagacccgccgtgcccagattcggcaagcccgacggcctgagaggcagaggcgtgggcagccccgagcccggccccaccgccccctacctgggcagaagcatgagctacagcagccagaaggcccagcccggcgtgagcgagaccgaggaggtggccctgcagcccctgctgacccccaaggacgaggtgcagctgaagaccacctacagcaagagcaacggccagcccaagagcctgggcagcgccagccccggccccggccagccccccctgagcagccccaccagaggcggcgtgaagaaggtgagcggcgtgggcggcaccacctacgagatcagcgtgtag

SEQ ID NO: 24097 - DNA, 1989 bp, Artificial Sequence
  Description of Artificial Sequence: Synthetic coding sequence
atgttcctgttcgtgctggccaacttcagcatggccaccttcatggaccccggcatcttccccagagccgaggaggacgaggacaaggaggacgacttcagagcccccctgtacaagaccgtggagatcaagggcatccaggtgagaatgaagtggtgcgccacctgcagattctacagaccccccagatgcagccactgcagcgtgtgcgacaactgcgtggaggagttcgaccaccactgcccctgggtgaacaactgcatcggcagaagaaactacagatacttcttcctgttcctgctgagcctgaccgcccacatcatgggcgtgttcggcttcggcctgctgtacgtgctgtaccacatcgaggagctgagcggcgtgagaaccgccgtgaccatggccgtgatgtgcgtggccggcctgttcttcatccccgtggccggcctgaccggcttccacgtggtgctggtggccagaggcagaaccaccaacgagcaggtgaccggcaagttcagaggcggcgtgaaccccttcaccaacggctgctgcaacaacgtgagcagagtgctgtgcagcagccccgcccccagatacctgggcagacccaagaaggagaagaccatcgtgatcagaccccccttcctgagacccgaggtgagcgacggccagatcaccgtgaagatcatggacaacggcatccagggcgagctgagaagaaccaagagcaagggcagcctggagatcaccgagagccagagcgccgacgccgagcccccccccccccccaagcccgacctgagcagatacaccggcctgagaacccacctgggcctggccaccaacgaggacagcagcctgctggccaaggacagcccccccacccccaccatgtacaagtacagacccggctacagcagcagcagcaccagcgccgccatgccccacagcagcagcgccaagctgagcagaggcgacagcctgaaggagcccaccagcatcgccgagagcagcagacaccccagctacagaagcgagcccagcctggagcccgagagcttcagaagccccaccttcggcaagagcttccacttcgaccccctgagcagcggcagcagaagcagcagcctgaagagcgcccagggcaccggcttcgagctgggccagctgcagagcatcagaagcgagggcaccaccagcaccagctacaagagcctggccaaccagaccagaaacggcagcctgagctacgacagcctgctgacccccagcgacagccccgacttcgagagcgtgcaggccggccccgagcccgacccccccctgggctacaccagccccttcctgagcgccagactggcccagcagagagaggccgagagacaccccagactggtgcccaccggccccacccacagagagcccagccccgtgagatacgacaacctgagcagacacatcgtggccagcctgcaggagagagagaagctgctgagacagagcccccccctgcccggcagagaggaggagcccggcctgggcgacagcggcatccagagcacccccggcagcggccacgcccccagaaccagcagcagcagcgacgacagcaagagaagccccctgggcaagacccccctgggcagacccgccgtgcccagattcggcaagcccgacggcctgagaggcagaggcgtgggcagccccgagcccggccccaccgccccctacctgggcagaagcatgagctacagcagccagaaggcccagcccggcgtgagcgagaccgaggaggtggccctgcagcccctgctgacccccaaggacgaggtgcagctgaagaccacctacagcaagagcaacggccagcccaagagcctgggcagcgccagccccggccccggccagccccccctgagcagccccaccagaggcggcgtgaagaaggtgagcggcgtgggcggcaccacctacgagatcagcgtgtag

SEQ ID NO: 24098 - DNA, 1230 bp, Artificial Sequence
  Description of Artificial Sequence: Synthetic coding sequence
atgggcaccttctgcagcgtgatcaagttcgagaacctgcaggagctgaagagactgtgccactggggccccatcatcgccctgggcgtgatcgccatctgcagcaccatggccatgatcgacagcgtgctgtggtactggcccctgcacaccaccggcggcagcgtgaacttcatcatgctgatcaactggaccgtgatgatcctgtacaactacttcaacgccatgttcgtgggccccggcttcgtgcccctgggctggaagcccgacaccatgtacctgcagtactgcaaggtgtgccaggcctacaaggcccccagaagccaccactgcagaaagtgcaacagatgcgtgatgaagatggaccaccactgcccctggatcaacaactgctgcggctaccagaaccacgccagcttcaccctgttcctgctgctggcccccctgggctgcatccacgccgccttcatcttcgtgatgaccatgtacacccagctgtaccacagactgagcttcggctggaacaccgtgaagatcgacatgagcgccgccagaagagaccccctgcccatcgtgcccttcggcctggccgccttcgccaccaccctgttcgccctgggcctggccctgggcaccaccatcgccgtgggcatgctgttcttcatccagatgaagatcatcctgagaaacaagaccagcatcgagagctggatcgaggagaaggccaaggacagaatccagtactaccagctggacgaggtgttcgtgttcccctacgacatgggcagcagatggagaaacttcaagcaggtgttcacctggagcggcgtgcccgagggcgacggcctggagtggcccgtgagagagggctgccaccagtacagcctgaccatcgagcagctgaagcagaaggccgacaagagagtgagaagcgtgagatacaaggtgatcgaggactacagcggcgcctgctgccccctgaacaagggcatcaagaccttcttcaccagcccctgcaccgaggagcccagaatccagctgcagaagggcgagttcatcctggccaccagaggcctgagatactggctgtacggcgacaagatcctggacgacagcttcatcgagggcgtgagcagaatcagaggctggttccccagaaagtgcgtggagaagtgcccctgcgacgccgagaccgaccaggcccccgagggcgagaagaagaacagatag

SEQ ID NO: 24099 - DNA, 1242 bp, Artificial Sequence
  Description of Artificial Sequence: Synthetic coding sequence
atgggcaccttctgcagcgtgatcaagttcgagaacctgcaggagctgaagagactgtgccactggggccccatcatcgccctgggcgtgatcgccatctgcagcaccatggccatgatcgacagcgtgctgtggtactggcccctgcacaccaccggcggcagcgtgaacttcatcatgctgatcaactggaccgtgatgatcctgtacaactacttcaacgccatgttcgtgggccccggcttcgtgcccctgggctggaagcccgagatcagccaggacaccatgtacctgcagtactgcaaggtgtgccaggcctacaaggcccccagaagccaccactgcagaaagtgcaacagatgcgtgatgaagatggaccaccactgcccctggatcaacaactgctgcggctaccagaaccacgccagcttcaccctgttcctgctgctggcccccctgggctgcatccacgccgccttcatcttcgtgatgaccatgtacacccagctgtaccacagactgagcttcggctggaacaccgtgaagatcgacatgagcgccgccagaagagaccccctgcccatcgtgcccttcggcctggccgccttcgccaccaccctgttcgccctgggcctggccctgggcaccaccatcgccgtgggcatgctgttcttcatccagatgaagatcatcctgagaaacaagaccagcatcgagagctggatcgaggagaaggccaaggacagaatccagtactaccagctggacgaggtgttcgtgttcccctacgacatgggcagcagatggagaaacttcaagcaggtgttcacctggagcggcgtgcccgagggcgacggcctggagtggcccgtgagagagggctgccaccagtacagcctgaccatcgagcagctgaagcagaaggccgacaagagagtgagaagcgtgagatacaaggtgatcgaggactacagcggcgcctgctgccccctgaacaagggcatcaagaccttcttcaccagcccctgcaccgaggagcccagaatccagctgcagaagggcgagttcatcctggccaccagaggcctgagatactggctgtacggcgacaagatcctggacgacagcttcatcgagggcgtgagcagaatcagaggctggttccccagaaagtgcgtggagaagtgcccctgcgacgccgagaccgaccaggcccccgagggcgagaagaagaacagatag

SEQ ID NO: 24100 - DNA, 927 bp, Artificial Sequence
  Description of Artificial Sequence: Synthetic coding sequence
atgcagcccagcggccacagactgagagacgtggagcaccaccccctgctggccgagaacgacaactacgacagcagcagcagcagcagcagcgaggccgacgtggccgacagagtgtggttcatcagagacggctgcggcatgatctgcgccgtgatgacctggctgctggtggcctacgccgacttcgtggtgaccttcgtgatgctgctgcccagcaaggacttctggtacagcgtggtgaacggcgtgatcttcaactgcctggccgtgctggccctgagcagccacctgagaaccatgctgaccgaccccggcgccgtgcccaagggcaacgccaccaaggagtacatggagagcctgcagctgaagcccggcgaggtgatctacaagtgccccaagtgctgctgcatcaagcccgagagagcccaccactgcagcatctgcaagagatgcatcagaaagatggaccaccactgcccctgggtgaacaactgcgtgggcgagaagaaccagagattcttcgtgctgttcaccatgtacatcgccctgagcagcgtgcacgccctgatcctgtgcggcttccagttcatcagctgcgtgagaggccagtggaccgagtgcagcgacttcagcccccccatcaccgtgatcctgctgatcttcctgtgcctggagggcctgctgttcttcaccttcaccgccgtgatgttcggcacccagatccacagcatctgcaacgacgagaccgagatcgagagactgaagagcgagaagcccacctgggagagaagactgagatgggagggcatgaagagcgtgttcggcggcccccccagcctgctgtggatgaaccccttcgtgggcttcagattcagaagactgcccaccagacccagaaagggcggccccgagttcagcgtgtag

SEQ ID NO: 24101 - DNA, 1038 bp, Artificial Sequence
  Description of Artificial Sequence: Synthetic coding sequence
atgcagcccagcggccacagactgagagacgtggagcaccaccccctgctggccgagaacgacaactacgacagcagcagcagcagcagcagcgaggccgacgtggccgacagagtgtggttcatcagagacggctgcggcatgatctgcgccgtgatgacctggctgctggtggcctacgccgacttcgtggtgaccttcgtgatgctgctgcccagcaaggacttctggtacagcgtggtgaacggcgtgatcttcaactgcctggccgtgctggccctgagcagccacctgagaaccatgctgaccgaccccgagaagagcagcgactgcagacccagcgcctgcaccgtgaagaccggcctggaccccaccctggtgggcatctgcggcgagggcaccgagagcgtgcagagcctgctgctgggcgccgtgcccaagggcaacgccaccaaggagtacatggagagcctgcagctgaagcccggcgaggtgatctacaagtgccccaagtgctgctgcatcaagcccgagagagcccaccactgcagcatctgcaagagatgcatcagaaagatggaccaccactgcccctgggtgaacaactgcgtgggcgagaagaaccagagattcttcgtgctgttcaccatgtacatcgccctgagcagcgtgcacgccctgatcctgtgcggcttccagttcatcagctgcgtgagaggccagtggaccgagtgcagcgacttcagcccccccatcaccgtgatcctgctgatcttcctgtgcctggagggcctgctgttcttcaccttcaccgccgtgatgttcggcacccagatccacagcatctgcaacgacgagaccgagatcgagagactgaagagcgagaagcccacctgggagagaagactgagatgggagggcatgaagagcgtgttcggcggcccccccagcctgctgtggatgaaccccttcgtgggcttcagattcagaagactgcccaccagacccagaaagggcggccccgagttcagcgtgtag

SEQ ID NO: 24102 - DNA, 4620 bp, Artificial Sequence
  Description of Artificial Sequence: Synthetic coding sequence
atggacagctacttcaaggccgccgtgagcgacctggacaagctgctggacgacttcgagcagaaccccgacgagcaggactacctgcaggacgtgcagaacgcctacgacagcaaccactgcagcgtgagcagcgagctggccagcagccagagaaccagcctgctgcccaaggaccaggagtgcgtgaacagctgcgccagcagcgagaccagctacggcaccaacgagagcagcctgaacgagaagaccctgaagggcctgaccagcatccagaacgagaagaacgtgaccggcctggacctgctgagcagcgtggacggcggcaccagcgacgagatccagcccctgtacatgggcagatgcagcaagcccatctgcgacctgatcagcgacatgggcaacctggtgcacgccaccaacagcgaggaggacatcaagaagctgctgcccgacgacttcaagagcaacgccgacagcctgatcggcctggacctgagcagcgtgagcgacaccccctgcgtgagcagcaccgaccacgacagcgacaccgtgagagagcagcagaacgacatcagcagcgagctgcagaacagagagatcggcggcatcaaggagctgggcatcaaggtggacaccaccctgagcgacagctacaactacagcggcaccgagaacctgaaggacaagaagatcttcaaccagctggagagcatcgtggacttcaacatgagcagcgccctgaccagacagagcagcaagatgttccacgccaaggacaagctgcagcacaagagccagccctgcggcctgctgaaggacgtgggcctggtgaaggaggaggtggacgtggccgtgatcaccgccgccgagtgcctgaaggaggagggcaagaccagcgccctgacctgcagcctgcccaagaacgaggacctgtgcctgaacgacagcaacagcagagacgagaacttcaagctgcccgacttcagcttccaggaggacaagaccgtgatcaagcagagcgcccaggaggacagcaagagcctggacctgaaggacaacgacgtgatccaggacagcagcagcgccctgcacgtgagcagcaaggacgtgcccagcagcctgagctgcctgcccgccagcggcagcatgtgcggcagcctgatcgagagcaaggccagaggcgacttcctgccccagcacgagcacaaggacaacatccaggacgccgtgaccatccacgaggagatccagaacagcgtggtgctgggcggcgagcccttcaaggagaacgacctgctgaagcaggagaagtgcaagagcatcctgctgcagagcctgatcgagggcatggaggacagaaagatcgaccccgaccagaccgtgatcagagccgagagcctggacggcggcgacaccagcagcaccgtggtggagagccaggagggcctgagcggcacccacgtgcccgagagcagcgactgctgcgagggcttcatcaacaccttcagcagcaacgacatggacggccaggacctggactacttcaacatcgacgagggcgccaagagcggccccctgatcagcgacgccgagctggacgccttcctgaccgagcagtacctgcagaccaccaacatcaagagcttcgaggagaacgtgaacgacagcaagagccagatgaaccagatcgacatgaagggcctggacgacggcaacatcaacaacatctacttcaacgccgaggccggcgccatcggcgagagccacggcatcaacatcatctgcgagatcgtggacaagcagaacaccatcgagaacggcctgagcctgggcgagaagagcaccatccccgtgcagcagggcctgcccaccagcaagagcgagatcaccaaccagctgagcgtgagcgacatcaacagccagagcgtgggcggcgccagacccaagcagctgttcagcctgcccagcagaaccagaagcagcaaggacctgaacaagcccgacgtgcccgacaccatcgagagcgagcccagcaccgccgacaccgtggtgcccatcacctgcgccatcgacagcaccgccgacccccaggtgagcttcaacagcaactacatcgacatcgagagcaacagcgagggcggcagcagcttcgtgaccgccaacgaggacagcgtgcccgagaacacctgcaaggagggcctggtgctgggccagaagcagcccacctgggtgcccgacagcgaggcccccaactgcatgaactgccaggtgaagttcaccttcaccaagagaagacaccactgcagagcctgcggcaaggtgttctgcggcgtgtgctgcaacagaaagtgcaagctgcagtacctggagaaggaggccagagtgtgcgtggtgtgctacgagaccatcagcaaggcccaggccttcgagagaatgatgagccccaccggcagcaacctgaagagcaaccacagcgacgagtgcaccaccgtgcagcccccccaggagaaccagaccagcagcatccccagccccgccaccctgcccgtgagcgccctgaagcagcccggcgtggagggcctgtgcagcaaggagcagaagagagtgtggttcgccgacggcatcctgcccaacggcgaggtggccgacaccaccaagctgagcagcggcagcaagagatgcagcgaggacttcagccccctgagccccgacgtgcccatgaccgtgaacaccgtggaccacagccacagcaccaccgtggagaagcccaacaacgagaccggcgacatcaccagaaacgagatcatccagagccccatcagccaggtgcccagcgtggagaagctgagcatgaacaccggcaacgagggcctgcccaccagcggcagcttcaccctggacgacgacgtgttcgccgagaccgaggagcccagcagccccaccggcgtgctggtgaacagcaacctgcccatcgccagcatcagcgactacagactgctgtgcgacatcaacaagtacgtgtgcaacaagatcagcctgctgcccaacgacgaggacagcctgccccccctgctggtggccagcggcgagaagggcagcgtgcccgtggtggaggagcaccccagccacgagcagatcatcctgctgctggagggcgagagcttccaccccgtgaccttcgtgctgaacgccaacctgctggtgaacgtgaagttcatcttctacagcagcgacaagtactggtacttcagcaccaacggcctgcacggcctgggccaggccgagatcatcatcctgctgctgtgcctgcccaacgaggacaccatccccaaggacatcttcagactgttcatcaccatctacaaggacgccctgaagggcaagtacatcgagaacctggacaacatcaccttcaccgagagcttcctgagcagcaaggaccacggcggcttcctgttcatcacccccaccttccagaagctggacgacctgagcctgcccagcaaccccttcctgtgcggcatcctgatccagaagctggagatcccctgggccaaggtgttccccatgagactgatgctgagactgggcgccgagtacaaggcctaccccgcccccctgaccagcatcagaggcagaaagcccctgttcggcgagatcggccacaccatcatgaacctgctggtggacctgagaaactaccagtacaccctgcacaacatcgaccagctgctgatccacatggagatgggcaagagctgcatcaagatccccagaaagaagtacagcgacgtgatgaaggtgctgaacagcagcaacgagcacgtgatcagcatcggcgccagcttcagcaccgaggccgacagccacctggtgtgcatccagaacgacggcatctacgagacccaggccaacagcgccaccggccaccccagaaaggtgaccggcgccagcttcgtggtgttcaacggcgccctgaagaccagcagcggcttcctggccaagagcagcatcgtggaggacggcctgatggtgcagatcacccccgagaccatgaacggcctgagactggccctgagagagcagaaggacttcaagatcacctgcggcaaggtggacgccgtggacctgagagagtacgtggacatctgctgggtggacgccgaggagaagggcaacaagggcgtgatcagcagcgtggacggcatcagcctgcagggcttccccagcgagaagatcaagctggaggccgacttcgagaccgacgagaagatcgtgaagtgcaccgaggtgttctacttcctgaaggaccaggacctgagcatcctgagcaccagctaccagttcgccaaggagatcgccatggcctgcagcgccgccctgtgcccccacctgaagaccctgaagagcaacggcatgaacaagatcggcctgagagtgagcatcgacaccgacatggtggagttccaggccggcagcgagggccagctgctgccccagcactacctgaacgacctggacagcgccctgatccccgtgatccacggcggcaccagcaacagcagcctgcccctggagatcgagctggtgttcttcatcatcgagcacctgttctag

SEQ ID NO: 24103 - DNA, 4620 bp, Artificial Sequence; identical to SEQ ID NO: 24102
  Description of Artificial Sequence: Synthetic coding sequence

SEQ ID NO: 24104 - DNA, 4620 bp, Artificial Sequence; identical to SEQ ID NO: 24102
  Description of Artificial Sequence: Synthetic coding sequence

SEQ ID NO: 24105 - DNA, 2355 bp, Artificial Sequence
  Description of Artificial Sequence: Synthetic coding sequence
atggccagcctggacgaccccggcgaggtgagagagggcttcctgtgccccctgtgcctgaaggacctgcagagcttctaccagctgcacagccactacgaggaggagcacagcggcgaggacagagacgtgaagggccagatcaagagcctggtgcagaaggccaagaaggccaaggacagactgctgaagagagagggcgacgacagagccgagagcggcacccagggctacgagagcttcagctacggcggcgtggacccctacatgtgggagccccaggagctgggcgccgtgagaagccacctgagcgacttcaagaagcacagagccgccagaatcgaccactacgtggtggaggtgaacaagctgatcatcagactggagaagctgaccgccttcgacagaaccaacaccgagagcgccaagatcagagccatcgagaagagcgtggtgccctgggtgaacgaccaggacgtgcccttctgccccgactgcggcaacaagttcagcatcagaaacagaagacaccactgcagactgtgcggcagcatcatgtgcaagaagtgcatggagctgatcagcctgcccctggccaacaagctgaccagcgccagcaaggagagcctgagcacccacaccagccccagccagagccccaacagcgtgcacggcagcagaagaggcagcatcagcagcatgagcagcgtgagcagcgtgctggacgagaaggacgacgacagaatcagatgctgcacccactgcaaggacaccctgctgaagagagagcagcagatcgacgagaaggagcacacccccgacatcgtgaagctgtacgagaagctgagactgtgcatggagaaggtggaccagaaggcccccgagtacatcagaatggccgccagcctgaacgccggcgagaccacctacagcctggagcacgccagcgacctgagagtggaggtgcagaaggtgtacgagctgatcgacgccctgagcaagaagatcctgaccctgggcctgaaccaggacccccccccccaccccagcaacctgagactgcagagaatgatcagatacagcgccaccctgttcgtgcaggagaagctgctgggcctgatgagcctgcccaccaaggagcagttcgaggagctgaagaagaagagaaaggaggagatggagagaaagagagccgtggagagacaggccgccctggagagccagagaagactggaggagagacagagcggcctggccagcagagccgccaacggcgaggtggccagcctgagaagaggccccgcccccctgagaaaggccgagggctggctgcccctgagcggcggccagggccagagcgaggacagcgaccccctgctgcagcagatccacaacatcaccagcttcatcagacaggccaaggccgccggcagaatggacgaggtgagaaccctgcaggagaacctgagacagctgcaggacgagtacgaccagcagcagaccgagaaggccatcgagctgagcagaagacaggccgaggaggaggacctgcagagagagcagctgcagatgctgagagagagagagctggagagagagagagagcagttcagagtggccagcctgcacaccagaaccagaagcctggacttcagagagatcggccccttccagctggagcccagcagagagcccagaacccacctggcctacgccctggacctgggcagcagccccgtgcccagcagcaccgcccccaagacccccagcctgagcagcacccagcccaccagagtgtggagcggcccccccgccgtgggccaggagagactgccccagagcagcatgccccagcagcacgagggccccagcctgaaccccttcgacgaggaggacctgagcagccccatggaggaggccaccaccggcccccccgccgccggcgtgagcctggaccccagcgccagaatcctgaaggagtacaaccccttcgaggaggaggacgaggaggaggaggccgtggccggcaaccccttcatccagcccgacagccccgcccccaaccccttcagcgaggaggacgagcacccccagcagagactgagcagccccctggtgcccggcaaccccttcgaggagcccacctgcatcaaccccttcgagatggacagcgacagcggccccgaggccgaggagcccatcgaggaggagctgctgctgcagcagatcgacaacatcaaggcctacatcttcgacgccaagcagtgcggcagactggacgaggtggaggtgctgaccgagaacctgagagagctgaagcacaccctggccaagcagaagggcggcaccgactag

SEQ ID NO: 24106 - DNA, 438 bp, Artificial Sequence
  Description of Artificial Sequence: Synthetic coding sequence
atggccgccagcctgaacgccggcgagaccacctacagcctggagcacgccagcgacctgagagtggaggtgcagaaggtgtacgagctgatcgacgccctgagcaagaagatcctgaccctgggcctgaaccaggacccccccccccaccccagcaacctgagactgcagagaatgatcagatacagcgccaccctgttcgtgcaggagaagctgctgggcctgatgagcctgcccaccaaggagcagttcgaggagctgaagaagaagagaaaggaggagatggagagaaagagagccgtggagagacaggccgccctggagagccagagaagactggaggagagacagagagccagccaccccccctgcctgtgcttcggcagcagactgttccccagcagcaagcagcacagcagccaggaccccttcacctag

SEQ ID NO: 24107 - DNA, 627 bp, Artificial Sequence
  Description of Artificial Sequence: Synthetic coding sequence
atggccagcctggacgaccccggcgaggtgagagagggcttcctgtgccccctgtgcctgaaggacctgcagagcttctaccagctgcacagccactacgaggaggagcacagcggcgaggacagagacgtgaagggccagatcaagagcctggtgcagaaggccaagaaggccaaggacagactgctgaagagagagggcgacgacagagccgagagcggcacccagggctacgagagcttcagctacggcggcgtggacccctacatgtgggagccccaggagctgggcgccgtgagaagccacctgagcgacttcaagaagcacagagccgccagaatcgaccactacgtggtggaggtgaacaagctgatcatcagactggagaagctgaccgccttcgacagaaccaacaccgagagcgccaagatcagagccatcgagaagagcgtggtgccctgggtgaacgaccaggacgtgcccttctgccccgactgcggcaacaagttcagcatcagaaacagaagacaccactgcagactgtgcggcagcatcatgtgcaagaagtgcatggagctgatcagcctgcccctggccaagatcaccaccctgcacggcgagagctag

SEQ ID NO: 24108 - DNA, 2355 bp, Artificial Sequence; identical to SEQ ID NO: 24105
  Description of Artificial Sequence: Synthetic coding sequence

SEQ ID NO: 24109 - DNA, 126 bp, Artificial Sequence
  Description of Artificial Sequence: Synthetic coding sequence
atggccagcctggacgaccccggcgaggtgagagagggcttcctgtgccccctgtgcctgaaggacctgcagagcttctaccagctgcacagccactacgaggaggagcacagcggcgaggactag

SEQ ID NO: 24110 - DNA, 4278 bp, Artificial Sequence
  Description of Artificial Sequence: Synthetic coding sequence
atggagaactacttccaggccgaggcctacaacctggacaaggtgctggacgagttcgagcagaacgaggacgagaccgtgagcagcaccctgctggacaccaagtggaacaagatcctggacccccccagccacagactgagcttcaaccccaccctggccagcgtgaacgagagcgccgtgagcaacgagagccagccccagctgaaggtgttcagcctggcccacagcgcccccctgaccaccgaggaggaggaccactgcgccaacggccaggactgcaacctgaaccccgagatcgccaccatgtggatcgacgagaacgccgtggccgaggaccagctgatcaagagaaactacagctgggacgaccagtgcagcgccgtggaggtgggcgagaagaagtgcggcaacctggcctgcctgcccgacgagaagaacgtgctggtggtggccgtgatgcacaactgcgacaagagaaccctgcagaacgacctgcaggactgcaacaactacaacagccagagcctgatggacgccttcagctgcagcctggacaacgagaacagacagaccgaccagttcagcttcagcatcaacgagagcaccgagaaggacatgaacagcgagaagcagatggaccccctgaacagacccaagaccgagggcagaagcgtgaaccacctgtgccccaccagcagcgacagcctggccagcgtgtgcagccccagccagctgaaggacgacggcagcatcggcagagaccccagcatgagcgccatcaccagcctgaccgtggacagcgtgatcagcagccagggcaccgacggctgccccgccgtgaagaagcaggagaactacatccccgacgaggacctgaccggcaagatcagcagccccagaaccgacctgggcagccccaacagcttcagccacatgagcgagggcatcctgatgaagaaggagcccgccgaggagagcaccaccgaggagagcctgagaagcggcctgcccctgctgctgaagcccgacatgcccaacggcagcggcagaaacaacgactgcgagagatgcagcgactgcctggtgcccaacgaggtgagagccgacgagaacgagggctacgagcacgaggagaccctgggcaccaccgagttcctgaacatgaccgagcacttcagcgagagccaggacatgaccaactggaagctgaccaagctgaacgagatgaacgacagccaggtgaacgaggagaaggagaagttcctgcagatcagccagcccgaggacaccaacggcgacagcggcggccagtgcgtgggcctggccgacgccggcctggacctgaagggcacctgcatcagcgagagcgaggagtgcgacttcagcaccgtgatcgacacccccgccgccaactacctgagcaacggctgcgacagctacggcatgcaggaccccggcgtgagcttcgtgcccaagaccctgcccagcaaggaggacagcgtgaccgaggagaaggagatcgaggagagcaagagcgagtgctacagcaacatctacgagcagagaggcaacgaggccaccgagggcagcggcctgctgctgaacagcaccggcgacctgatgaagaagaactacctgcacaacttctgcagccaggtgcccagcgtgctgggccagagcagccccaaggtggtggccagcctgcccagcatcagcgtgcccttcggcggcgccagacccaagcagcccagcaacctgaagctgcagatccccaagcccctgagcgaccacctgcagaacgacttccccgccaacagcggcaacaacaccaagaacaagaacgacatcctgggcaaggccaagctgggcgagaacagcgccaccaacgtgtgcagccccagcctgggcaacatcagcaacgtggacaccaacggcgagcacctggagagctacgaggccgagatcagcaccagaccctgcctggccctggcccccgacagccccgacaacgacctgagagccggccagttcggcatcagcgccagaaagcccttcaccaccctgggcgaggtggcccccgtgtgggtgcccgacagccaggcccccaactgcatgaagtgcgaggccagattcaccttcaccaagagaagacaccactgcagagcctgcggcaaggtgttctgcgccagctgctgcagcctgaagtgcaagctgctgtacatggacagaaaggaggccagagtgtgcgtgatctgccacagcgtgctgatgaacgcccaggcctgggagaacatgatgagcgccagcagccagagccccaaccccaacaaccccgccgagtactgcagcaccatcccccccctgcagcaggcccaggccagcggcgccctgagcagccccccccccaccgtgatggtgcccgtgggcgtgctgaagcaccccggcgccgaggtggcccagcccagagagcagagaagagtgtggttcgccgacggcatcctgcccaacggcgaggtggccgacgccgccaagctgaccatgaacggcaccagcagcgccggcaccctggccgtgagccacgaccccgtgaagcccgtgaccaccagccccctgcccgccgagaccgacatctgcctgttcagcggcagcatcacccaggtgggcagccccgtgggcagcgccatgaacctgatccccgaggacggcctgccccccatcctgatcagcaccggcgtgaagggcgactacgccgtggaggagaagcccagccagatcagcgtgatgcagcagctggaggacggcggccccgaccccctggtgttcgtgctgaacgccaacctgctgagcatggtgaagatcgtgaactacgtgaacagaaagtgctggtgcttcaccaccaagggcatgcacgccgtgggccagagcgagatcgtgatcctgctgcagtgcctgcccgacgagaagtgcctgcccaaggacatcttcaaccacttcgtgcagctgtacagagacgccctggccggcaacgtggtgagcaacctgggccacagcttcttcagccagagcttcctgggcagcaaggagcacggcggcttcctgtacgtgaccagcacctaccagagcctgcaggacctggtgctgcccacccccccctacctgttcggcatcctgatccagaagtgggagaccccctgggccaaggtgttccccatcagactgatgctgagactgggcgccgagtacagactgtacccctgccccctgttcagcgtgagattcagaaagcccctgttcggcgagaccggccacaccatcatgaacctgctggccgacttcagaaactaccagtacaccctgcccgtggtgcagggcctggtggtggacatggaggtgagaaagaccagcatcaagatccccagcaacagatacaacgagatgatgaaggccatgaacaagagcaacgagcacgtgctggccggcggcgcctgcttcaacgagaaggccgacagccacctggtgtgcgtgcagaacgacgacggcaactaccagacccaggccatcagcatccacaaccagcccagaaaggtgaccggcgccagcttcttcgtgttcagcggcgccctgaagagcagcagcggctacctggccaagagcagcatcgtggaggacggcgtgatggtgcagatcaccgccgagaacatggacagcctgagacaggccctgagagagatgaaggacttcaccatcacctgcggcaaggccgacgccgaggagccccaggagcacatccacatccagtgggtggacgacgacaagaacgtgagcaagggcgtggtgagccccatcgacggcaagagcatggagaccatcaccaacgtgaagatcttccacggcagcgagtacaaggccaacggcaaggtgatcagatggaccgaggtgttcttcctggagaacgacgaccagcacaactgcctgagcgaccccgccgaccacagcagactgaccgagcacgtggccaaggccttctgcctggccctgtgcccccacctgaagctgctgaaggaggacggcatgaccaagctgggcctgagagtgaccctggacagcgaccaggtgggctaccaggccggcagcaacggccagcccctgcccagccagtacatgaacgacctggacagcgccctggtgcccgtgatccacggcggcgcctgccagctgagcgagggccccgtggtgatggagctgatcttctacatcctggagaacatcgtgtag

SEQ ID NO: 24111 - DNA, 4101 bp, Artificial Sequence
  Description of Artificial Sequence: Synthetic coding sequence
atggagaactacttccaggccgaggcctacaacctggacaaggtgctggacgagttcgagcagaacgaggacgagaccgtgagcagcaccctgctggacaccaagtggaacaagatcctggacccccccagccacagactgagcttcaaccccaccctggccagcgtgaacgagagcgccgtgagcaacgagagccagccccagctgaaggtgttcagcctggcccacagcgcccccctgaccaccgaggaggaggaccactgcgccaacggccaggactgcaacctgaaccccgagatcgccaccatgtggatcgacgagaacgccgtggccgaggaccagctgatcaagagaaactacagctgggacgaccagtgcagcgccgtggaggtgggcgagaagaagtgcggcaacctggcctgcctgcccgacgagaagaacgtgctggtggtggccgtgatgcacaactgcgacaagagaaccctgcagaacgacctgcaggactgcaacaactacaacagccagagcctgatggacgccttcagctgcagcctggacaacgagaacagacagaccgaccagttcagcttcagcatcaacgagagcaccgagaaggacatgaacagcgagaagcagatggaccccctgaacagacccaagaccgagggcagaagcgtgaaccacctgtgccccaccagcagcgacagcctggccagcgtgtgcagccccagccagctgaaggacgacggcagcatcggcagagaccccagcatgagcgccatcaccagcctgaccgtggacagcgtgatcagcagccagggcaccgacggctgccccgccgtgaagaagcaggagaactacatccccgacgaggacctgaccggcaagatcagcagccccagaaccgacctgggcagccccaacagcttcagccacatgagcgagggcatcctgatgaagaaggagcccgccgaggagagcaccaccgaggagagcctgagaagcggcctgcccctgctgctgaagcccgacatgcccaacggcagcggcagaaacaacgactgcgagagatgcagcgactgcctggtgcccaacgaggtgagagccgacgagaacgagggctacgagcacgaggagaccctgggcaccaccgagttcctgaacatgaccgagcacttcagcgagagccaggacatgaccaactggaagctgaccaagctgaacgagatgaacgacagccaggtgaacgaggagaaggagaagttcctgcagatcagccagcccgaggacaccaacggcgacagcggcggccagtgcgtgggcctggccgacgccggcctggacctgaagggcacctgcatcagcgagagcgaggagtgcgacttcagcaccgtgatcgacacccccgccgccaactacctgagcaacggctgcgacagctacggcatgcaggaccccggcgtgagcttcgtgcccaagaccctgcccagcaaggaggacagcgtgaccgaggagaaggagatcgaggagagcaagagcgagtgctacagcaacatctacgagcagagaggcaacgaggccaccgagggcagcggcctgctgctgaacagcaccggcgacctgatgaagaagaactacctgcacaacttctgcagccaggtgcccagcgtgctgggccagagcagccccaaggtggtggccagcctgcccagcatcagcgtgcccttcggcggcgccagacccaagcagcccagcaacctgaagctgcagatccccaagcccctgagcgaccacctgcagaacgacttccccgccaacagcggcaacaacaccaagaacaagaacgacatcctgggcaaggccaagctgggcgagaacagcgccaccaacgtgtgcagccccagcctgggcaacatcagcaacgtggacaccaacggcgagcacctggagagctacgaggccgagatcagcaccagaccctgcctggccctggcccccgacagccccgacaacgacctgagagccggccagttcggcatcagcgccagaaagcccttcaccaccctgggcgaggtggcccccgtgtgggtgcccgacagccaggcccccaactgcatgaagtgcgaggccagattcaccttcaccaagagaagacaccactgcagagcctgcggcaaggtgttctgcgccagctgctgcagcctgaagtgcaagctgctgtacatggacagaaaggaggccagagtgtgcgtgatctgccacagcgtgctgatgaacgtggcccagcccagagagcagagaagagtgtggttcgccgacggcatcctgcccaacggcgaggtggccgacgccgccaagctgaccatgaacggcaccagcagcgccggcaccctggccgtgagccacgaccccgtgaagcccgtgaccaccagccccctgcccgccgagaccgacatctgcctgttcagcggcagcatcacccaggtgggcagccccgtgggcagcgccatgaacctgatccccgaggacggcctgccccccatcctgatcagcaccggcgtgaagggcgactacgccgtggaggagaagcccagccagatcagcgtgatgcagcagctggaggacggcggccccgaccccctggtgttcgtgctgaacgccaacctgctgagcatggtgaagatcgtgaactacgtgaacagaaagtgctggtgcttcaccaccaagggcatgcacgccgtgggccagagcgagatcgtgatcctgctgcagtgcctgcccgacgagaagtgcctgcccaaggacatcttcaaccacttcgtgcagctgtacagagacgccctggccggcaacgtggtgagcaacctgggccacagcttcttcagccagagcttcctgggcagcaaggagcacggcggcttcctgtacgtgaccagcacctaccagagcctgcaggacctggtgctgcccacccccccctacctgttcggcatcctgatccagaagtgggagaccccctgggccaaggtgttccccatcagactgatgctgagactgggcgccgagtacagactgtacccctgccccctgttcagcgtgagattcagaaagcccctgttcggcgagaccggccacaccatcatgaacctgctggccgacttcagaaactaccagtacaccctgcccgtggtgcagggcctggtggtggacatggaggtgagaaagaccagcatcaagatccccagcaacagatacaacgagatgatgaaggccatgaacaagagcaacgagcacgtgctggccggcggcgcctgcttcaacgagaaggccgacagccacctggtgtgcgtgcagaacgacgacggcaactaccagacccaggccatcagcatccacaaccagcccagaaaggtgaccggcgccagcttcttcgtgttcagcggcgccctgaagagcagcagcggctacctggccaagagcagcatcgtggaggacggcgtgatggtgcagatcaccgccgagaacatggacagcctgagacaggccctgagagagatgaaggacttcaccatcacctgcggcaaggccgacgccgaggagccccaggagcacatccacatccagtgggtggacgacgacaagaacgtgagcaagggcgtggtgagccccatcgacggcaagagcatggagaccatcaccaacgtgaagatcttccacggcagcgagtacaaggccaacggcaaggtgatcagatggaccgaggtgttcttcctggagaacgacgaccagcacaactgcctgagcgaccccgccgaccacagcagactgaccgagcacgtggccaaggccttctgcctggccctgtgcccccacctgaagctgctgaaggaggacggcatgaccaagctgggcctgagagtgaccctggacagcgaccaggtgggctaccaggccggcagcaacggccagcccctgcccagccagtacatgaacgacctggacagcgccctggtgcccgtgatccacggcggcgcctgccagctgagcgagggccccgtggtgatggagctgatcttctacatcctggagaacatcgtgtag

SEQ ID NO: 24112 - DNA, 2289 bp, Artificial Sequence
  Description of Artificial Sequence: Synthetic coding sequence
atggagaactacttccaggccgaggcctacaacctggacaaggtgctggacgagttcgagcagaacgaggacgagaccgtgagcagcaccctgctggacaccaagtggaacaagatcctggacccccccagccacagactgagcttcaaccccaccctggccagcgtgaacgagagcgccgtgagcaacgagagccagccccagctgaaggtgttcagcctggcccacagcgcccccctgaccaccgaggaggaggaccactgcgccaacggccaggactgcaacctgaaccccgagatcgccaccatgtggatcgacgagaacgccgtggccgaggaccagctgatcaagagaaactacagctgggacgaccagtgcagcgccgtggaggtgggcgagaagaagtgcggcaacctggcctgcctgcccgacgagaagaacgtgctggtggtggccgtgatgcacaactgcgacaagagaaccctgcagaacgacctgcaggactgcaacaactacaacagccagagcctgatggacgccttcagctgcagcctggacaacgagaacagacagaccgaccagttcagcttcagcatcaacgagagcaccgagaaggacatgaacagcgagaagcagatggaccccctgaacagacccaagaccgagggcagaagcgtgaaccacctgtgccccaccagcagcgacagcctggccagcgtgtgcagccccagccagctgaaggacgacggcagcatcggcagagaccccagcatgagcgccatcaccagcctgaccgtggacagcgtgatcagcagccagggcaccgacggctgccccgccgtgaagaagcaggagaactacatccccgacgaggacctgaccggcaagatcagcagccccagaaccgacctgggcagccccaacagcttcagccacatgagcgagggcatcctgatgaagaaggagcccgccgaggagagcaccaccgaggagagcctgagaagcggcctgcccctgctgctgaagcccgacatgcccaacggcagcggcagaaacaacgactgcgagagatgcagcgactgcctggtgcccaacgaggtgagagccgacgagaacgagggctacgagcacgaggagaccctgggcaccaccgagttcctgaacatgaccgagcacttcagcgagagccaggacatgaccaactggaagctgaccaagctgaacgagatgaacgacagccaggtgaacgaggagaaggagaagttcctgcagatcagccagcccgaggacaccaacggcgacagcggcggccagtgcgtgggcctggccgacgccggcctggacctgaagggcacctgcatcagcgagagcgaggagtgcgacttcagcaccgtgatcgacacccccgccgccaactacctgagcaacggctgcgacagctacggcatgcaggaccccggcgtgagcttcgtgcccaagaccctgcccagcaaggaggacagcgtgaccgaggagaaggagatcgaggagagcaagagcgagtgctacagcaacatctacgagcagagaggcaacgaggccaccgagggcagcggcctgctgctgaacagcaccggcgacctgatgaagaagaactacctgcacaacttctgcagccaggtgcccagcgtgctgggccagagcagccccaaggtggtggccagcctgcccagcatcagcgtgcccttcggcggcgccagacccaagcagcccagcaacctgaagctgcagatccccaagcccctgagcgaccacctgcagaacgacttccccgccaacagcggcaacaacaccaagaacaagaacgacatcctgggcaaggccaagctgggcgagaacagcgccaccaacgtgtgcagccccagcctgggcaacatcagcaacgtggacaccaacggcgagcacctggagagctacgaggccgagatcagcaccagaccctgcctggccctggcccccgacagccccgacaacgacctgagagccggccagttcggcatcagcgccagaaagcccttcaccaccctgggcgaggtggcccccgtgtgggtgcccgacagccaggcccccaactgcatgaagtgcgaggccagattcaccttcaccaagagaagacaccactgcagagcctgcggcaaggtgttctgcgccagctgctgcagcctgaagtgcaagctgctgtacatggacagaaaggaggccagagtgtgcgtgatctgccacagcgtgctgatgaacggcaagtactag

SEQ ID NO: 24113 - DNA, 4278 bp, Artificial Sequence; identical to SEQ ID NO: 24110
  Description of Artificial Sequence: Synthetic coding sequence

SEQ ID NO: 24114 - DNA, 2514 bp, Artificial Sequence
  Description of Artificial Sequence: Synthetic coding sequence
atggccagcaagagaaagagcaccaccccctgcatggtgagaaccagccaggtggtggagcaggacgtgcccgaggaggtggacagagccaaggagaagggcatcggcaccccccagcccgacgtggccaaggacagctgggccgccgagctggagaacagcagcaaggagaacgaggtgatcgaggtgaagagcatgggcgagagccagagcaagaagctgcagggcggctacgagtgcaagtactgcccctacagcacccagaacctgaacgagttcaccgagcacgtggacatgcagcaccccaacgtgatcctgaaccccctgtacgtgtgcgccgagtgcaacttcaccaccaagaagtacgacagcctgagcgaccacaacagcaagttccaccccggcgaggccaacttcaagctgaagctgatcaagagaaacaaccagaccgtgctggagcagagcatcgagaccaccaaccacgtggtgagcatcaccaccagcggccccggcaccggcgacagcgacagcggcatcagcgtgagcaagacccccatcatgaagcccggcaagcccaaggccgacgccaagaaggtgcccaagaagcccgaggagatcacccccgagaaccacgtggagggcaccgccagactggtgaccgacaccgccgagatcctgagcagactgggcggcgtggagctgctgcaggacaccctgggccacgtgatgcccagcgtgcagctgccccccaacatcaacctggtgcccaaggtgcccgtgcccctgaacaccaccaagtacaacagcgccctggacaccaacgccaccatgatcaacagcttcaacaagttcccctaccccacccaggccgagctgagctggctgaccgccgccagcaagcaccccgaggagcacatcagaatctggttcgccacccagagactgaagcacggcatcagctggagccccgaggaggtggaggaggccagaaagaagatgttcaacggcaccatccagagcgtgccccccaccatcaccgtgctgcccgcccagctggcccccaccaaggtgacccagcccatcctgcagaccgccctgccctgccagatcctgggccagaccagcctggtgctgacccaggtgaccagcggcagcaccaccgtgagctgcagccccatcaccctggccgtggccggcgtgaccaaccacggccagaagagacccctggtgaccccccaggccgcccccgagcccaagagaccccacatcgcccaggtgcccgagcccccccccaaggtggccaacccccccctgacccccgccagcgacagaaagaagaccaaggagcagatcgcccacctgaaggccagcttcctgcagagccagttccccgacgacgccgaggtgtacagactgatcgaggtgaccggcctggccagaagcgagatcaagaagtggttcagcgaccacagatacagatgccagagaggcatcgtgcacatcaccagcgagagcctggccaaggaccagctggccatcgccgccagcagacacggcagaacctaccacgcctaccccgacttcgccccccagaagttcaaggagaagacccagggccaggtgaagatcctggaggacagcttcctgaagagcagcttccccacccaggccgagctggacagactgagagtggagaccaagctgagcagaagagagatcgacagctggttcagcgagagaagaaagctgagagacagcatggagcaggccgtgctggacagcatgggcagcggcaagaagggccaggacgtgggcgcccccaacggcgccctgagcagactggaccagctgagcggcgcccagctgaccagcagcctgcccagccccagccccgccatcgccaagagccaggagcaggtgcacctgctgagaagcaccttcgccagaacccagtggcccaccccccaggagtacgaccagctggccgccaagaccggcctggtgagaaccgagatcgtgagatggttcaaggagaacagatgcctgctgaagaccggcaccgtgaagtggatggagcagtaccagcaccagcccatggccgacgaccacggctacgacgccgtggccagaaaggccaccaagcccatggccgagagccccaagaacggcggcgacgtggtgccccagtactacaaggaccccaagaagctgtgcgaggaggacctggagaagctggtgaccagagtgaaggtgggcagcgagcccgccaaggactgcctgcccgccaagcccagcgaggccaccagcgacagaagcgagggcagcagcagagacggccagggcagcgacgagaacgaggagagcagcgtggtggactacgtggaggtgaccgtgggcgaggaggacgccatcagcgacagaagcgacagctggagccaggccgccgccgagggcgtgagcgagctggccgagagcgacagcgactgcgtgcccgccgaggccggccaggcctag

SEQ ID NO: 24115 - DNA, 501 bp, Artificial Sequence
  Description of Artificial Sequence: Synthetic coding sequence
atggccagcaagagaaagagcaccaccccctgcatggtgagaaccagccaggtggtggagcaggacgtgcccgaggaggtggacagagccaaggagaagggcatcggcaccccccagcccgacgtggccaaggacagctgggccgccgagctggagaacagcagcaaggagaacgaggtgatcgaggtgaagagcatgggcgagagccagagcaagaagctgcagggcggctacgagtgcaagtactgcccctacagcacccagaacctgaacgagttcaccgagcacgtggacatgcagcaccccaacgtgatcctgaaccccctgtacgtgtgcgccgagtgcaacttcaccaccaagaagtacgacagcctgagcgaccacaacagcaagttccaccccggcgaggccaacttcaagctgaagctgatcaagagaaacaaccagaccgtgctggagcagagcatcgagaccaccaaccacgtggtgagcatcacctag

SEQ ID NO: 24116 - DNA, 465 bp, Artificial Sequence
  Description of Artificial Sequence: Synthetic coding sequence
atggccctgctgctgagcgtgctgagagtgctgctgggcggcttcttcgccctggtgggcctggccaagctgagcgaggagatcagcgcccccgtgagcgagagaatgaacgccctgttcgtgcagttcgccgaggtgttccccctgaaggtgttcggctaccagcccgaccccctgaactaccagatcgccgtgggcttcctggagctgctggccggcctgctgctggtgatgggcccccccatgctgcaggagatcagcaacctgttcctgatcctgctgatgatgggcgccatcttcaccctggccgccctgaaggagagcctgagcacctgcatccccgccatcgtgtgcctgggcttcctgctgctgctgaacgtgggccagctgctggcccagaccaagaaggtggtgagacccaccagaaagaagaccctgagcaccttcaaggagagctggaagtag

SEQ ID NO: 24117 - DNA, 1296 bp, Artificial Sequence
  Description of Artificial Sequence: Synthetic coding sequence
atgatgctgagattcagcatgtgcagaggcaacgacgagggcttcgccatggagcagatctggctgctgctgctgctgaccatcagagtgctgcccggcagcgcccagttcaacggctacaactgcgacgccaacctgcacagcagattccccgccgagagagacatcagcgtgtactgcggcgtgcaggccatcaccatgaagatcaacttctgcaccgtgctgttcagcggctacagcgagaccgacctggccctgaacggcagacacggcgacagccactgcagaggcttcatcaacaacaacaccttccccgccgtggtgatcttcatcatcaacctgagcaccctggagggctgcggcaacaacctggtggtgagcaccatccccggcgtgagcgcctacggcaacgccaccagcgtgcaggtgggcaacatcagcggctacatcgacacccccgacccccccaccatcatcagctacctgcccggcctgctgtacaagttcagctgcagctaccccctggagtacctggtgaacaacacccagctggccagcagcagcgccgccatcagcgtgagagagaacaacggcaccttcgtgagcaccctgaacctgctgctgtacaacgacagcacctacaaccagcagctgatcatccccagcatcggcctgcccctgaagaccaaggtgttcgccgccgtgcaggccaccaacctggacggcagatggaacgtgctgatggactactgctacaccacccccagcggcaaccccaacgacgacatcagatacgacctgttcctgagctgcgacaaggacccccagaccaccgtgatcgagaacggcagaagccagagaggcagattcagcttcgaggtgttcagattcgtgaagcacaagaaccagaagatgagcaccgtgttcctgcactgcgtgaccaagctgtgcagagccgacgactgccccttcctgatgcccatctgcagccacagagagagaagagacgccggcagaagaaccacctggagcccccagagcagcagcggcagcgccgtgctgagcgccggccccatcatcaccagaagcgacgagacccccaccaacaacagccagctgggcagccccagcatgccccccttccagctgaacgccatcaccagcgccctgatcagcggcatggtgatcctgggcgtgaccagcttcagcctgctgctgtgcagcctggccctgctgcacagaaagggccccaccagcctggtgctgaacggcatcagaaaccccgtgttcgactag

SEQ ID NO: 24118 - DNA, 1248 bp, Artificial Sequence
  Description of Artificial Sequence: Synthetic coding sequence
atggagcagatctggctgctgctgctgctgaccatcagagtgctgcccggcagcgcccagttcaacggctacaactgcgacgccaacctgcacagcagattccccgccgagagagacatcagcgtgtactgcggcgtgcaggccatcaccatgaagatcaacttctgcaccgtgctgttcagcggctacagcgagaccgacctggccctgaacggcagacacggcgacagccactgcagaggcttcatcaacaacaacaccttccccgccgtggtgatcttcatcatcaacctgagcaccctggagggctgcggcaacaacctggtggtgagcaccatccccggcgtgagcgcctacggcaacgccaccagcgtgcaggtgggcaacatcagcggctacatcgacacccccgacccccccaccatcatcagctacctgcccggcctgctgtacaagttcagctgcagctaccccctggagtacctggtgaacaacacccagctggccagcagcagcgccgccatcagcgtgagagagaacaacggcaccttcgtgagcaccctgaacctgctgctgtacaacgacagcacctacaaccagcagctgatcatccccagcatcggcctgcccctgaagaccaaggtgttcgccgccgtgcaggccaccaacctggacggcagatggaacgtgctgatggactactgctacaccacccccagcggcaaccccaacgacgacatcagatacgacctgttcctgagctgcgacaaggacccccagaccaccgtgatcgagaacggcagaagccagagaggcagattcagcttcgaggtgttcagattcgtgaagcacaagaaccagaagatgagcaccgtgttcctgcactgcgtgaccaagctgtgcagagccgacgactgccccttcctgatgcccatctgcagccacagagagagaagagacgccggcagaagaaccacctggagcccccagagcagcagcggcagcgccgtgctgagcgccggccccatcatcaccagaagcgacgagacccccaccaacaacagccagctgggcagccccagcatgccccccttccagctgaacgccatcaccagcgccctgatcagcggcatggtgatcctgggcgtgaccagcttcagcctgctgctgtgcagcctggccctgctgcacagaaagggccccaccagcctggtgctgaacggcatcagaaaccccgtgttcgactag

SEQ ID NO: 24119 - DNA, 1248 bp, Artificial Sequence; identical to SEQ ID NO: 24118
  Description of Artificial Sequence: Synthetic coding sequence

SEQ ID NO: 24120 - DNA, 1131 bp, Artificial Sequence
  Description of Artificial Sequence: Synthetic coding sequence
atgggtttgctagcattcctgaagacacagttcgtcctacatttactggtgggattcgtgtttgtggtgtctggcctcgtaataaacttcgtccagctgtgcacattggccctgtggcccgtgtcaaaacagctgtatagaaggctcaattgtcggttagcgtatagcttgtggtctcagcttgtcatgcttcttgagtggtggtcctgcaccgagtgcacccttttcactgaccaggctacggtagaaaggtttgggaaggaacacgcagtgattatccttaaccacaacttcgaaattgattttctttgtgggtggacaatgtgcgaacggttcggtgtcttgggttctagcaaagtactggctaagaaggagcttctgtatgtacccttaatcggatggacctggtattttctggaaattgtgttctgtaagagaaaatgggaagaagatagggacaccgtggtggaggggctgcggagactgtcagattaccctgagtacatgtggtttctgctttactgtgaaggcacgcggttcaccgagactaaacatagagtctctatggaagttgcggccgcaaagggtttgccagtgctgaaatatcacttactgccgagaaccaaaggttttaccaccgccgtcaagtgccttagagggactgtggccgccgtctacgacgttacactgaatttcagagggaacaaaaacccctcactgctgggaatcttatatggtaagaaatatgaggcagacatgtgtgtgagacgctttcctctggaggacatacccctggacgagaaagaggccgctcagtggttacacaaactatatcaggagaaggacgccctccaagaaatctacaatcaaaaaggtatgttcccaggggagcaattcaaaccagctcgtcggccatggactctgctgaacttcctgtcctgggctaccatactgctatctccattgttttcatttgttctgggggtcttcgcttctggaagccccctgctgattctgacttttctcgggtttgtcggcgctgcttccttcggggttcgacgcctaatcggtgtgaccgagatcgagaaagggagtagttatgggaaccaggaatttaagaagaaggagtag

SEQ ID NO: 24121 - DNA, 1131 bp, Artificial Sequence
  Description of Artificial Sequence: Synthetic coding sequence
atggggctgttggcattcctgaaaactcagttcgtgcttcatctcctggttggcttcgtctttgtggtgtcaggcctggtgataaacttcgtgcaattatgtacactcgcactatggccagtcagcaaacaactctacagaaggctcaactgccgccttgcatactctttgtggtcacagctcgtaatgcttctggaatggtggtcttgcaccgagtgtaccctgttcactgaccaagctacagtggagagattcggaaaggaacatgccgtgattatactcaaccataacttcgagatcgatttcctgtgcggatggacaatgtgtgagcggttcggcgtgctggggtccagtaaagtgcttgccaaaaaggaactactttatgtgccgctgattggatggacctggtattttttggagatcgtgttttgtaagaggaagtgggaggaggaccgagacactgtcgttgagggcttgaggcgactaagtgactatcctgaatatatgtggttcttgctgtattgcgaaggtaccagattcaccgaaactaagcacagagtcagcatggaggtggccgcggccaagggcttaccagttcttaaatatcacctgttacctagaacaaagggcttcacaacagccgttaaatgcctacgcgggaccgtcgctgctgtctatgacgttacgctgaacttcaggggcaacaagaatcccagtttactgggaatcctgtacggcaagaaatatgaggcggacatgtgtgtacgcaggtttccgctggaggacattcctctcgatgagaaggaagccgcgcagtggttgcataagctatatcaggagaaggacgcgttgcaggaaatctacaatcaaaagggcatgttcccaggtgaacagttcaaaccagcaagaagaccctggacactattgaactttctctcatgggccacaattttgcttagccccttgttctcgtttgtcttaggggtgtttgcaagcggcagcccattactgatcctgacctttctgggtttcgtcggggctgcctcttttggggtacgccgcctgattggagttaccgagatagagaagggttcgtcttatgggaatcaggaatttaaaaagaaggaatag

SEQ ID NO: 24122 - DNA, 1131 bp, Artificial Sequence
  Description of Artificial Sequence: Synthetic coding sequence
atgggcctcctggcttttctgaagacgcaatttgttctgcacctccttgttggatttgtgttcgttgtgtcagggctcgttatcaactttgtgcagctgtgcacactcgccctctggccagttagcaagcagttgtacaggcgactcaactgcagactcgcgtatagcctttggtcccaactggtgatgctgctggaatggtggtcgtgcacagagtgcaccttattcactgatcaggcgactgtggagcgattcgggaaggagcacgcagttatcatcctgaatcataattttgagattgactttctctgcggctggactatgtgtgaaaggtttggcgtgctaggaagctccaaagtgcttgcaaaaaaggagttgttatatgttcctctgatcggatggacctggtacttcctggagattgttttttgtaagcgcaagtgggaggaggacagagatacagtggttgaaggcctcagacgattgtcggactatcctgaatacatgtggtttctgctgtattgtgagggcactagatttactgagacgaaacatcgtgtgtccatggaggtggcagccgctaagggtttgcctgtgctgaaatatcaccttctcccacgaactaaaggtttcacaactgccgtgaaatgccttcgcggcacagtcgccgccgtgtacgacgtgacgttgaattttcgcggcaacaaaaacccaagcctgctgggcattctttacggcaaaaaatatgaggctgatatgtgtgtccggcgctttcccctggaagatatccccctcgacgaaaaagaggctgcacaatggctgcataagttgtatcaagagaaggacgccctgcaggaaatttacaaccagaaaggtatgttccctggagagcagtttaagccagcacgtcgcccatggacactattaaacttcctgagctgggccacaattttactttcgccccttttcagttttgtgcttggggtattcgcaagtggcagtcctctcctgattctgaccttcttggggttcgtgggcgccgcttcttttggtgttcgccgccttatcggggtgacagaaattgagaagggaagcagctatgggaaccaggagttcaaaaagaaggagtag

SEQ ID NO: 24123 - DNA, 1131 bp, Artificial Sequence
  Description of Artificial Sequence: Synthetic coding sequence
atgggtcttctggctttccttaagacgcagttcgttctccacctcctggttggatttgtcttcgtggtttcaggtcttgttatcaattttgtgcagctttgcactctggccctgtggcccgtatccaagcaattataccgtcgtctgaattgccgtctggcctactctctgtggagccagctcgtcatgctcctggagtggtggagctgtactgagtgtacactgttcactgatcaggctactgtggaacgatttggcaaggagcatgcagtaatcatcttgaatcacaactttgaaattgacttcctgtgcggctggaccatgtgcgaacgcttcggcgtactgggcagcagcaaggttctggctaagaaggaactcctctacgtccccttgattgggtggacatggtacttcctggaaatcgttttctgcaagaggaaatgggaagaggacagggacaccgtggtggagggtcttcgccgcttgtctgattacccagagtacatgtggttcctactctactgcgaagggacacgtttcactgagactaaacaccgcgtcagtatggaggtggcagccgcgaaaggcctccccgtgctgaagtatcacctgctccccagaacaaagggattcactactgcggtcaagtgccttaggggcactgtggcagccgtgtacgacgtaacgctgaattttaggggaaataaaaacccctctttactgggaatactctacggcaagaaatacgaggccgacatgtgtgtacgaaggtttcctctcgaagacatccccttggatgaaaaggaagcagcccagtggttgcacaagctctaccaggaaaaggacgctctgcaagagatttacaaccagaaggggatgtttccaggggagcagttcaagcctgccagacgcccctggacgctgctgaatttcctctcctgggccaccatcctcttaagccccttgttcagctttgtcttgggcgtgttcgcgtctggctctcctttgctgatcttgacctttcttggcttcgtaggcgctgcctcattcggtgtcagacggctcataggagtgactgagatcgagaaagggagctcatacgggaaccaggagttcaaaaagaaggagtag

SEQ ID NO: 24124 - DNA, 1131 bp, Artificial Sequence
  Description of Artificial Sequence: Synthetic coding sequence
atggggttattagctttcttaaagacgcaatttgtgcttcacctgcttgtggggtttgtctttgtcgtttccggcctggtgatcaattttgtgcaactatgtactctagcactttggcctgtatcaaagcagctgtaccggagactaaattgccggctagcatactccctgtggtctcagttggtaatgctccttgaatggtggagctgtaccgaatgcaccttattcaccgaccaggcgaccgtggaaaggttcggcaaggagcacgctgtgattatcctaaaccacaattttgagattgattttctatgcggctggacaatgtgtgagcggttcggtgtactcggaagctccaaggtgctggcgaagaaggaactgctttacgtccctctgattggctggacctggtacttcctggagatcgtcttttgcaagcgaaaatgggaggaggatagagacacagttgtagaaggcctgagaaggttatccgattatcccgagtacatgtggttcctactgtactgcgaagggacacgcttcactgagacgaaacatcgtgtgtctatggaagttgctgcagccaagggactacctgtgctgaaataccacctcctgccaaggactaaaggatttacaactgcagtgaagtgtctgcggggcactgtggccgcagtgtatgatgtgaccctgaattttcgcggtaataagaatccgtccttactggggatactttacggcaagaaatacgaggccgacatgtgcgtaagaaggttccctctcgaggatatacccctggacgagaaggaggcagcccagtggttgcacaagctctaccaggagaaagacgctctgcaggagatttacaatcagaaggggatgttccctggtgaacagtttaaacccgcccgtagaccttggaccctcttaaacttcctcagctgggcaacgatcttgttatcaccactctttagtttcgtgctgggagtattcgctagtggctctccattacttattctcacctttctcggttttgtgggggccgcaagctttggcgtaaggaggctgatcggggttacagagatagagaagggttcgagttatggcaatcaagaatttaagaagaaggagtag

SEQ ID NO: 24125 - DNA, 768 bp, Artificial Sequence
  Description of Artificial Sequence: Synthetic coding sequence
atgggccttctggctttcctgaaaacgcaatttgtgctgcacttgttggttggcttcgtgttcgtggtgagcggcctagtaattaatttcgtacagctgtgtaccctggcactttggccagtttcaaaacagctttatagaagactgaactgcaggctggcctattccctgtggagtcaacttgttatgctcctcgagtggtggtcctgtacggagtgcaccttgttcaccgaccaagcgactgtcgagcggtttggaaaagagcatgctgttattattctgaaccacaactttgagatcgattttctctgtggatggactatgtgtgagcgtttcggtgtcctcggcagcagcaaggttctagcaaaaaaagagctgctctatgtgccgctgatcggttggacatggtactttctggagatagttttttgcaaacgcaagtgggaggaagaccgagacacagtggtggaaggactgaggagactatccgattatcctgaatatatgtggttccttctgtattgcgaggggacaaggtttactgaaactaagcacagagtctctatggaagtggcagctgcgaaaggtctgcctgtgctcaaataccacttgctgccccggacaaaaggtttcactaccgccgtcaaatgcctgagggggactgtggcagcagtgtacgatgtgaccctgaactttcgcggaaacaagaatcctagcctgctcggaattctctacggcaagaagtatgaggccgatatgtgcgtgtag

SEQ ID NO: 24126 - DNA, 1113 bp, Artificial Sequence
  Description of Artificial Sequence: Synthetic coding sequence
atgggactgctagcgttcttaaaaacccaattcgtgctacacttacttgtcgggttcgtgttcgtggtgtcagggctcgttattaatttcgttcaactttgtacactggcgttatggcccgtgtctaaacagctgtataggcggttaaattgccggttggcatatagtctctggagccagttggtcatgctcttggagtggtggtcatgcactgagtgtaccctgtttactgaccaggcaacggtcgagaggtttggaaaggaacacgccgttatcatcctgaatcataacttcgaaattgacttcctctgtggttggaccatgtgcgaaagattcggggtgctcggcagttccaaagtgctcgccaagaaggaactgctgtacgtgccactgatagggtggacttggtactttctggagatagtgttttgtaagcgcaaatgggaggaagacagagacaccgtggttgaaggactgcgcaggctgtcagattaccctgagtacatgtggttcttgttgtactgcgaaggtacacgctttacagagacaaagcaccgggtgtccatggaagtcgcagccgcaaagggactgcctgtgttaaaatatcatcttctgccgaggaccaagggtttcaccaccgcagtgaagtgcttaagaggcaccgtggctgctgtgtatgacgtgacactaaatttccgaggcaacaaaaacccctccctgctgggtatcctctacggaaaaaaatatgaggctgatatgtgtgtgcgccggttcccgctggaagacattccccttgatgagaaagagggacactgctggcccgtggctccggtgacgcatcccgagccaggtgcaaccctggaggccccccgccgtgagggccccggaccccccaccggtgtgtggcctgtaaaactgccagcctgggctgtggtatcttggggacggaggtggcccccatccctcgggcctggggcccggtgccatggggtgagttgccccagcagccaggggtgtcattgttgtctccaccggctgcctccttgcgagacgttagtggtgtggtattccgccaccgtctaccagacacggacgttgtgtgaagttctgtag

SEQ ID NO: 24127 - DNA, 387 bp, Artificial Sequence
  Description of Artificial Sequence: Synthetic coding sequence
atgggtctcctggcctttctcaaaacacagttcgtactacatcttcttgtcgggttcgtatttgtggtctccggactcgtgatcaactttgtgcaactgtgtacactcgccctttggccggtgtcaaaacagctgtaccggcggctaaactgtcgcctggcatattccctgtggtcccagctggtgatgttgctggaatggtggtcatgcaccgaatgtaccctgtttacggatcaggctactgtagaacgattcggaaaagagcacgcagtcattatcctaaaccacaacttcgagatcgatttcctgtgtgggtggactatgtgcgaaagatttggagtccttgggagcagcaaagtgctcgctaaaaaagagctgttgtactag

SEQ ID NO: 24128 - DNA, 240 bp, Artificial Sequence
  Description of Artificial Sequence: Synthetic coding sequence
atgggcctcctcgccttcctgaagacacaattcgtgcttcacctgctggtaggttttgtgtttgttgtgtccggactggtcatcaactttgtgcagctctgtacactggccctgtggcctgtttctaagcaactttatcgccggcttaattgccgactggcatactccttatggagccagctggtcatgctgctggagtggtggagctgtactgaatgcacactgttcacagaccagtag

SEQ ID NO: 24129 - DNA, 117 bp, Artificial Sequence
  Description of Artificial Sequence: Synthetic coding sequence
atgggcttattggcttttttgaagacccagtttgtgctgcatctcctggtgggatttgtctttgtggtctccgggctggtcatcaactttgtgcagctctgcacacttgccctctag

SEQ ID NO: 24130 - DNA, 768 bp, Artificial Sequence
  Description of Artificial Sequence: Synthetic coding sequence
atgggactgctagccttcttgaagacccaattcgtgctgcacctgctagtgggctttgtttttgtcgtaagtggtcttgtgattaattttgttcaactatgtacccttgccttgtggcctgtttcaaaacaactgtatagaaggctcaattgccgacttgcatacagtctctggtcacagttagtcatgctgctggagtggtggtcctgcacggagtgtaccttatttactgaccaggccacagtcgagagatttgggaaagaacatgcagttattattctcaaccacaatttcgagatcgatttcctttgcggatggacaatgtgcgaacggttcggcgttctcggcagtagtaaggttctggctaaaaaagagctgctatatgtgccgcttattgggtggacatggtacttcctggagatagtgttttgcaaacgcaagtgggaggaagacagggataccgtggtagaagggctgcgaagactgagcgattatcccgagtacatgtggtttctcttgtattgcgaggggacacggttcacagaaaccaaacatcgggtgtcaatggaagtggctgctgcaaagggattgccagtgctcaaataccacctcctgccgagaaccaagggctttacaactgctgtgaagtgcttacgcggaactgtggcagcggtgtacgacgtgactcttaattttaggggtaataagaacccttcccttttgggaattttgtatgggaagaagtacgaggcggacatgtgcgtctag

SEQ ID NO: 24131 - DNA, 1131 bp, Artificial Sequence
  Description of Artificial Sequence: Synthetic coding sequence
atgggtctgctggcttttttgaagacacagttcgtgctccaccttcttgtcgggttcgtttttgttgtgtcaggattggtaataaatttcgtccaactgtgtacactcgcactttggcccgtctccaagcagctgtacagacggctcaattgccgcctagcatacagtctttggagtcaattagtgatgctgcttgaatggtggagctgcacagagtgtacgttgtttaccgaccaggcaacagtcgaaagattcggcaaggagcatgctgtaattattttgaatcacaactttgagatcgattttctctgtgggtggactatgtgtgagagatttggggtgcttgggtcctcaaaggttctggccaagaaggaacttctgtacgtgcctctgataggctggacctggtacttcttagaaatcgtgttttgtaagcggaagtgggaagaggaccgggacactgtggtcgaaggactgcgtcgcttgtctgactacccggaatatatgtggtttctgctctactgtgagggcacaagatttacggaaacgaaacacagggtctcaatggaagttgcggcggcaaaaggactgcccgtcctcaagtatcatctgctcccgaggactaaaggttttaccaccgcggtcaagtgtctgcggggcaccgtggccgcagtctacgatgtgactctgaattttaggggaaacaaaaaccctagtttgctcggcattctatatggcaagaaatatgaagctgacatgtgcgtaagacgtttccccctggaggatattccacttgacgaaaaagaagcagctcagtggctgcacaaactgtatcaggaaaaagatgccctgcaggaaatctataaccagaagggcatgtttcctggagaacagtttaagcccgccaggaggccctggactctgctcaactttctctcgtgggcaacgatactcctcagtccactcttttctttcgtattaggggtctttgcttcggggagccccctgcttattttgaccttcctgggctttgtaggggccgcctcatttggagttaggcggctcatcggtgtcacagagattgaaaaaggttcatcctatggaaaccaggaatttaaaaagaaagagtag

SEQ ID NO: 24132 - DNA, 1137 bp, Artificial Sequence
  Description of Artificial Sequence: Synthetic coding sequence
atggacctggccggcctgttgaaatcccaatttctgtgccacttagtgttttgctacgtgtttatagccagcggtctgataatcaacaccatccagctatttactctcttgctgtggccaatcaacaagcaattgttccgtaaaatcaactgccgtctgagttattgtatctccagtcagctcgtgatgctccttgaatggtggagcgggaccgagtgcactatttttaccgaccctagggcttatctcaagtatggcaaggaaaacgccatcgtggtgctaaaccacaagttcgagattgattttctgtgcggctggagcctttctgagcggtttggcctgcttggcggcagcaaagttctggccaagaaggagctggcctatgtcccgattatcggatggatgtggtatttcaccgagatggtcttttgtagtcgtaagtgggaacaggaccgcaaaacagtcgccacttcgctccagcacctgcgcgactatcccgagaagtactttttcctgattcactgcgagggtacccgcttcacagaaaagaaacatgaaataagtatgcaggtggcccgagccaagggtctcccgcgtcttaagcatcatctcctgccccgaaccaaaggattcgcaattactgtccgaagcctccggaatgtggtgtcagccgtgtacgactgtactctgaatttccgaaataatgaaaacccgaccctgcttggtgtcctcaatgggaagaagtaccatgcggatttgtatgtgcgccggatcccacttgaggacattccagaggatgacgatgaatgttcagcttggctacataagctctatcaggagaaggacgcattccaagaagagtactacaggacaggcacattccctgagaccccgatggtgccaccgcgccggccatggaccctggtgaactggctgttttgggcaagcttggtcctctacccattcttccagtttctggtttctatgatccgctccgggtccagtcttactctagccagttttatcctggtctttttcgtcgccagtgtgggtgtccgctggatgataggtgtgaccgaaattgataaaggtagtgcatacggaaactcagactctaagcagaaacttaacgactag

SEQ ID NO: 24133 - DNA, 480 bp, Artificial Sequence
  Description of Artificial Sequence: Synthetic coding sequence
atggatctggcaggcctcctgaaatctcagttcttatgccacctcgtgttctgctatgtgtttatcgcctctgggctcattatcaataccattcagctgtttactttgcttctttggcccatcaacaaacaactgttccggaagattaactgcagactgtcttactgtatctctagccagttggtgatgcttttggaatggtggtcaggcacagaatgcaccattttcaccgatcctcgggcttacttgaagtatgggaaagaaaatgctattgtggttcttaatcataaattcgagatagactttctatgcgggtggagcctctccgagcgctttggattactgggggtatcgcagaaatgtattcccccttgtctgacccacttcagcggctcagccccgccgctagtgttcctgctcctggtcatacagaacttgcagaaaaaccagcagtctttctacctgatgaagtggagttag

SEQ ID NO: 24134 - DNA, 375 bp, Artificial Sequence
  Description of Artificial Sequence: Synthetic coding sequence
atgctgctggagtggtggagtggcacggaatgcacgatctttaccgatccacgagcctatcttaagtatggtaaggagaacgctattgtcgtgttgaaccacaagtttgaaatcgactttctgtgtggctggtccctgagcgagcgatttggcctcttgggaggatctaaagtgcttgctaagaaggagctagcatatgttccaatcatcggctggatgtggtactttacagagatggtcttctgtagtaggaagtgggagcaggaccggaagacagttgctacctcacttcagcacctccgagactaccctgaaaagtactttgtatgcaggcatcaatcaagctgcgtcccccgagctccagccgggctctag

SEQ ID NO: 24135 - DNA, 402 bp, Artificial Sequence
  Description of Artificial Sequence: Synthetic coding sequence
atggacttggctgggctcctcaaatcacagttcctatgccacctcgtcttctgctacgtgtttattgcttccggactaatcatcaacacaatccagctgtttaccctgctgttgtggcccatcaacaagcagttgtttcggaagatcaattgccggctttcttactgtataagcagccagctcgtgatgctcctcgaatggtggagtggcacggagtgcacaatctttacagaccctagggcatacctcaagtatgggaaggaaaacgccatcgtggtcctcaatcacaagttcgagattgactttctttgcggatggtccctgtctgagcgctttggcctgctggggtttgacttgctccacgtagcttgcatgcctttggaactgggcctgttctcttag

SEQ ID NO: 24136 - DNA, 357 bp, Artificial Sequence
  Description of Artificial Sequence: Synthetic coding sequence
atggatctagccggcctcctgaaatcgcagttcctgtgtcacttggtattctgttatgtgttcattgcgagtggattgattatcaatactatccaactgttcacgctgcttctgtggcctatcaacaaacagttgttcaggaaaataaactgtcgcctctcttattgtatcagttcaagactgcaggggcctggacaagagagggcaggcctgtgccccaattatcgcttagacgtagtgcttcacagggatggcctcctgttcgcacaagttggagctggtagtcaggatggttgccaccagtttgctgccccccccggcctccctcgagaggttttcttccccgatagtctttag

SEQ ID NO: 24137 - DNA, 318 bp, Artificial Sequence
  Description of Artificial Sequence: Synthetic coding sequence
taatccgccgtttatgactgtactctgaattttaggaataatgaaaatccaactctgctgggcgtgcttaacgggaagaaataccacgctgacctctacgtgagacgcataccactggaagatattcctgaggatgatgatgagtgctctgcctggttacacaagctttaccaggagaagggttggggcgacacggaattttccaaacaatatgtctccgtctcccggcctgggagattagcactgtgtcctagtgaaaaaatagccgaacaacaggttgaggtcgttcacgggtttagcaagcagtcaggcgagtag

SEQ ID NO: 24138 - DNA, 651 bp, Artificial Sequence
  Description of Artificial Sequence: Synthetic coding sequence
atggatctcgcaggtctcttaaagagccaattcctctgccacttggtgttctgttacgtttttattgcatcaggcctgattattaacaccatccaactgtttactcttctgctttggccaatcaacaaacagctgttccggaaaatcaactgtaggctgagctattgtataagctctctgagcgccgtgtacgattgtaccctcaatttccggaataatgaaaatcctacgctacttggtgttctcaacggcaaaaaataccatgctgacttgtacgtacggcgcattcccctcgaagacattccagaagatgacgatgaatgcagcgcttggctgcacaaactgtatcaggagaaggatgctttccaggaggagtactaccggacgggaacctttcccgagacacccatggttcctcctcggaggccctggaccctggttaattggctgttttgggcgtccctggttttatatccattcttccagttcctagtgagcatgatacgcagcggctcgtctctgaccctggcatcttttattctggtgttctttgtcgctagtgtgggcgtaagatggatgattggagtcaccgagattgacaagggctccgcctacggtaatagtgatagcaagcagaagttgaacgactag

SEQ ID NO: 24139 - DNA, 1095 bp, Artificial Sequence
  Description of Artificial Sequence: Synthetic coding sequence
atgcttctatctctcgtgctgcacacctattccatgcgctatctcctcccgtctgtcgtgctattgggaacggccccgacttacgtgctcgcctggggggtctggcggctgctcagcgcatttttgcctgcgcggttctaccaggccctagatgatcgcctgtactgcgtgtaccagagcatggtcttattcttctttgagaattacaccggcgtgcagatccttctatatggcgatctgccgaagaacaaagagaatattatttacctggctaatcatcagtctacggtggattggatcgttgcggatatcctggccatccgccagaatgcccttggacatgtacggtacgtgttgaaggaaggactgaagtggctgcctctctatggatgctattttgctcagcacggcggtatttatgtcaagaggtctgctaagtttaatgagaaagagatgcgcaacaagctgcagagctatgttgacgccggcacccctatgtacctcgtgattttccccgagggaacaaggtacaaccctgaacagaccaaggtcttgtccgctagccaggcctttgctgcacaaagagggttggctgtgcttaagcacgttctgacaccgagaatcaaggccactcatgtcgccttcgactgcatgaagaactacctcgatgcgatttatgacgtgacggtcgtctacgaaggcaaggatgatggtggacaacgacgcgaaagccctaccatgacggaattcctgtgcaaagagtgtcctaagattcacattcacatcgatcgaattgacaagaaggatgtgcctgaagaacaagagcacatgcggcggtggctccacgagcgattcgaaattaaagataaaatgttgattgagttttatgagtctccagatccggagaggcggaaaaggtttccggggaaatctgttaatagtaaactcagcatcaagaagaccctcccatcgatgttgattctgtctggattgaccgcgggcatgctgatgactgacgctggccgcaagttatacgtcaacacatggatctatgggaccctgctgggctgcctttgggttacaatcaaagcgtag

SEQ ID NO: 24140 - DNA, 564 bp, Artificial Sequence
  Description of Artificial Sequence: Synthetic coding sequence
atggggggactgttttggcggtctgctcttaggggcctacggtgtgggccaagagcaccaggtcctagcttgctcgtgcgtcatggatccggcgggcccagctggacaagggagagaacgcttgtggctgttaagcctgatggcgttcagagacgcctggtaggcgacgtcatacagcgcttcgaacgtagggggttcacgctcgtcggaatgaagatgctccaagcgcctgagtctgtgctggctgagcactaccaggacctcagaagaaagcctttttaccccgctcttatccgatacatgtcaagcgggccagtggtggctatggtgtgggaggggtacaatgtggttagggcatcacgggcgatgattggtcatacagactccgcggaggccgccccgggcacaatccggggtgatttcagcgtgcatatctccagaaatgtgattcacgcgagcgactccgtggagggggcccagagagaaattcagctttggtttcagtcatcggaactcgtctcgtgggccgacgggggtcagcatagctctatacaccccgcgtag

SEQ ID NO: 24141 - DNA, 636 bp, Artificial Sequence
  Description of Artificial Sequence: Synthetic coding sequence
atggcccagcctccccccgacgttgaaggtgatgactgtctgccagcataccggcacctgttttgccctgatcttttgcgcgacaaggttgcattcatcactggaggaggcagtggaattgggtttaggatcgctgaaatcttcatgcgtgcctcggaggatcagatgggtcactgtagctcaagtggaacttgcctcgcgggcgtggccacctttatggtgattgtcgggaagcaaccacccaatcaaaagagtcgagagaccaaggagcagggacgccaaatcccctttgtctgtgtacgccatggttgccataccgtgatcgcctccagatcactgcctcgagtgcttacggctgcccgaaaactggctggcgctaccgggaggcgatgcttgcctctgagtatggacgtcagggccccaccagccgtgatggctgcagttgaccaagcgctgaaggagttcggacggatcgatatcctaattaactgctcttcctctagttgtgggctcccattctgcaggtgtgggagggagctccctgttcccagatggaggctggtgttacaaagacttcaggatagggacgggcatcggtatcaacggcacttgcaatgcgttagttgcgctctgtag

SEQ ID NO: 24142 - DNA, 813 bp, Artificial Sequence
  Description of Artificial Sequence: Synthetic coding sequence
atgccaagagacaacatggctagcctgattcagcgtatcgcaagacaggcttgcctgaccttcagaggctccgggggaggcagaggggccagcgatcgggacgcagcttctggaccagaggccccaatgcagccagggttccctgagaacctgtctaagttgaaaagtctgctgacacagctgagagccgaagatttgaacattgctcctcgcaaagcaactctccagcctttaccccctaatcttcccccagtcacatacatgcacatttacgagaccgatggctttagtttaggcgtgttcttgctgaagagcgggacctcaatcccgctccacgatcatcccggaatgcacggcatgcttaaagtactttacggaaccgtgcgtatatcatgcatggacaaactcgacgcgggaggaggtcagcgtcctagagcactgccacctgagcagcagttcgaaccacctctacagcctcgagagagggaggcagtgcgccccggggttctgcgctccagagctgagtataccgaggcctcggggccttgcatcctaacaccacatagagacaacctgcaccagatagacgctgtggaggggcctgctgcgtttctggacatactggcccccccttatgaccctgacgacgggagagattgccattattatcgggtgttggaaccggtcaggccaaaggaggcgtcctcaagtgcttgcgatttgcctagagaggtgtggctactcgaaaccccacaggctgacgacttttggtgcgagggggagccctatccaggacctaaagtattcccttag

SEQ ID NO: 24143 - DNA, 1032 bp, Artificial Sequence
  Description of Artificial Sequence: Synthetic coding sequence
atgttggctaccagactgagccgacccctcagtcgtctgccaggcaaaactctgtcagcctgtgatcgagagaacggtgcacgcaggccgctgctcctcgggtcaacttccttcatccccatcggaagacggacatatgctagcgctgcagagcccgtaggcagcaaggccgtgctggttactggatgcgactcaggttttggattcagtttagccaaacacttgcactctaagggcttcctggtattcgctggctgcctgatgaaggataaaggccatgatggtgtgaaggaactggactctctaaacagcgatcggctgagaaccgtacaacttaacgtctgctcaagcgaagaggtggagaaagttgtggaaatagtccggtcctctctaaaggaccccgagaaaggtatgtggggtctggtgaataacgcggggatcagcacgttcggagaggtggagttcaccagcctagaaacttataagcaggtggctgaagttaatctgtggggtactgtgcgtatgaccaagagctttctccctctgataagacgcgccaaaggcagggttgtaaatataagttccatgctcggaaggatggcgaacccagccaggtccccctattgtatcactaaatttggcgtggaagccttctctgattgcctgcgctacgaaatgtatcctcttggggtcaaagtttccgttgtggagccgggcaatttcatagcagccacatccctctattctcccgagagcattcaggcaattgcgaaaaagatgtgggaggaattacccgaggtggtgagaaaagattacggaaaaaagtacttcgacgagaagattgctaagatggaaacatattgtagctcgggcagtacagatacctctcctgtgattgacgccgtcactcatgcactgacggcaacaactccttacacccgatatcacccaatggactactactggtggctgcgcatgcagatcatgactcaccttccgggagcaatttctgacatgatttacattagatag

SEQ ID NO: 24144 - DNA, 1032 bp, Artificial Sequence
  Description of Artificial Sequence: Synthetic coding sequence
atgttggctactaggctttcccggcccctctccagactgcccgggaagaccctttcagcctgtgatagagagaatggcgctcgacgccctcttctgctgggtagtacatccttcataccaattggtcgtaggacttatgcatcggcagccgaaccggtgggctctaaggctgtactggtcaccggttgtgattccggctttgggttctcactggctaagcatcttcactccaagggattcttagtgtttgccggttgtttgatgaaggacaaaggccacgacggagtgaaggagcttgactcactgaactctgatcgactcaggactgtgcagcttaatgtatgctcttcagaggaggtcgagaaagttgtggaaattgtaagaagtagtttgaaggatcctgaaaagggaatgtggggccttgtgaataacgccggtatttccacctttggcgaggtagagtttacttccctggagacttacaaacaagtcgcggaagtgaatctgtggggcaccgtacgcatgacgaaaagcttccttccgctgatcagaagagccaaggggcgagtagttaacatctccagtatgctgggccgcatggccaatcctgctaggtccccatactgtataaccaagttcggagttgaggccttctctgattgtctgagatacgagatgtacccactaggcgtgaaagtgagcgtagttgaaccaggaaactttatcgccgccacaagcctgtactcccctgagagcattcaggccatagccaaaaaaatgtgggaagaacttccagaagtcgtgaggaaggattatggaaagaagtactttgacgagaaaatcgctaagatggagacctactgtagctccggctcaacagacacttcccctgttatagacgctgtgacccatgcactgaccgccacaaccccctacactagataccacccaatggactattactggtggctgcggatgcagatcatgactcatctgcctggcgcaatttcagacatgatttacatccgatag

SEQ ID NO: 24145 - DNA, 1032 bp, Artificial Sequence
  Description of Artificial Sequence: Synthetic coding sequence
atgctggcaaccaggctctctagaccgctgagccgtctgccaggtaaaacactttctgcctgcgaccgcgaaaatggtgctaggagacccctcctgctcggctcgacctccttcatccccatcggccggagaacatatgcgagcgccgccgaaccagtggggtctaaggctgtgcttgttacaggttgcgacagcggcttcgggttttccctggccaagcacctacactctaagggattcctggtgtttgcaggttgtctaatgaaggataaagggcatgacggcgtgaaggaactggattccctgaattccgacagactcagaactgttcaacttaacgtttgtagttcagaagaagtcgaaaaggtagttgagatcgtcaggagtagtttaaaagatcccgaaaaaggaatgtggggactggtgaataacgccggtatcagcacgtttggagaagtggagttcacaagtcttgaaacctataagcaggttgccgaggtgaacttatggggcactgtgcgcatgactaaatcatttctgcccttgatccgacgggccaaaggaagagtggtgaatatttcctcaatgttaggtcgtatggctaatccagcccgaagtccctactgcatcaccaagtttggggtcgaggccttctccgattgcctccgctacgagatgtatccactgggggttaaggtgagcgtggtagaaccaggaaattttattgcagccacatcgctgtacagccctgagtcaatacaggccattgccaagaagatgtgggaagagctgcctgaggtcgtacgcaaggactatggtaaaaaatattttgatgagaagattgccaaaatggaaacttattgttcctcgggctccactgacacctccccggtgatcgatgctgtcacccacgcattgaccgcaactactccttatacccgttaccaccctatggattattactggtggcttagaatgcaaatcatgactcacttgcctggcgccatatctgatatgatctacataaggtag

SEQ ID NO: 24146 - DNA, 270 bp, Artificial Sequence
  Description of Artificial Sequence: Synthetic coding sequence
atgctggcaacacgccttagccgtcccttgagccgcttaccaggaaaaacattgtccgcctgcgacagagaaaatggcgcaaggcggcctttgctcctgggaagtacctctttcatcccaatagggcggaggacatacgccagcgccgccgagccagtggggagcaaggcggtcttggtgacgggttgcgactcggggttcggcttttccctggccaagcaccttcatagtaagggttttctggtgtttgcaggatgtctgatgaagtag

SEQ ID NO: 24147 - DNA, 771 bp, Artificial Sequence
  Description of Artificial Sequence: Synthetic coding sequence
atgaaggacaagggccatgatggagtcaaagaactggattcccttaatagcgaccgacttcggaccgttcagttgaatgtgtgttctagcgaagaggtggagaaggtcgtggaaatcgttaggtcctccctcaaagatcccgagaagggcatgtggggcctggtgaataatgcaggcattagcacattcggagaggttgaattcacgtctctcgaaacatataagcaagttgccgaggtaaacctttggggtaccgtccgcatgacgaaatccttcctgccccttattaggcgcgctaaaggtcgggtggtgaatatctcttccatgctcggacggatggccaaccccgcccggtcaccttactgcatcaccaagttcggtgttgaggcattcagtgactgcttaagatatgaaatgtacccattgggcgtgaaagtctcggtggtggagcccggcaactttattgcagccaccagcttatatagtcccgaatcaatacaggctatcgcaaagaaaatgtgggaggagctacccgaagtggtacggaaggactacggcaaaaaatatttcgacgagaagatcgcgaagatggaaacatactgctcatccggttccactgacacctcccccgtgattgacgctgtcactcacgcactgacggcaaccaccccttatacccgctatcacccgatggactactactggtggctgaggatgcagataatgacgcatttgcccggtgccattagcgatatgatatatatcaggtag

SEQ ID NO: 24148 - DNA, 153 bp, Artificial Sequence
  Description of Artificial Sequence: Synthetic coding sequence
atgctcgccacccggctctctcgtccacttagccgactgcccgggaaaaccctgtccgcctgtgaccgagagaatggggcccgcagacccctgctgttagggtccacctctttcattcctatcggaaggcggacttacgcctcggcggcttag

SEQ ID NO: 24149 - DNA, 1011 bp, Artificial Sequence
  Description of Artificial Sequence: Synthetic coding sequence
atggccgcctcactccggcttctgggtgctgcctccggactgcgatactggtcccggaggctccggccagctgctgggtcctttgctgccgtgtgttctcgctctgtagcttccaagacgcctgttggcttcattggtttggggaatatgggcaatccgatggcgaaaaatctcatgaaacatggctacccactgattatctatgatgtgttccctgatgcttgcaaagagttccaggacgccggagaacaggtggtcagctcaccagctgatgtggccgaaaaggccgataggattattactatgctgccaacatcaatcaacgctatcgaagcgtacagcggcgcgaatggtattctcaaaaaggtgaaaaagggcagcttactcattgattccagcactattgaccccgcggtctccaaagaactggcaaaggaggtggagaaaatgggggctgttttcatggatgcccccgtgagtggcggcgtaggagcggcccggtccggcaacctcacattcatggttggcggagtggaagatgagttcgcagcagcccaggagctgctgggctgcatggggtctaacgtagtgtattgtggtgctgttgggaccggtcaggccgcaaagatttgcaacaacatgttgttagcaataagtatgatcgggacggcggaggccatgaacctaggaattaggcttggcctcgaccccaaactcctcgccaaaatactgaacatgtcaagcggcagatgttggtcgtcagatacctacaatcctgtgcctggagtaatggacggagtgccatccgcaaataactaccagggtggctttggtacaacactgatggcaaaggacttaggtctcgcccaggatagcgctacaagcactaagtcccctattctgctgggcagtctggcacaccagatctatagaatgatgtgcgctaagggttatagcaagaaggatttttcctccgtattccaattcttgagggaagaagaaacattctag

SEQ ID NO: 24150 - DNA, 1554 bp, Artificial Sequence
  Description of Artificial Sequence: Synthetic coding sequence
atggccgccctgaggctcctggcctccgtcctgggacgcggagtaccagcaggaggatccggtctggcactcagccaagggtgcgccaggtgttttgcaacctcaccccgcctgcgggccaagttttacgcagatccagtggagatggtgaaggatatctccgatggcgccactgtgatgatcggcggttttggattatgtggcatccctgaaaacctcatagccgctctgctgaggacaagagtgaaggatttacaggtggtgagttcgaacgttggagtggaagatttcgggttgggtctgttgctcgccgcccgccaggtgcgtaggattgtttgctcttacgtcggggagaacaccttgtgtgagagccagtatcttgcgggcgaactcgagctggagctgacaccacaggggaccctggccgagaggatccgcgccggaggtgctggggtgccagctttctatacgcccacaggctacggcactctggtccaggaaggcggagcacccatcaggtacactcctgatggccatttggccctgatgtctcagcctagagaagtgagagaattcaacggagaccactttctgcttgaaagagccatccgagccgactttgctctagttaaggggtggaaggctgaccgcgctgggaacgtagttttcagacggtccgcccggaatttcaatgttcccatgtgtaaggctgctgacgttactgccgttgaggtcgaggaaatcgtagaggtgggcgctttccctccagaagatatacacgtgcctaatatctacgtggatcgggtaattaagggccagaagtacgaaaagcgaatcgagcggctgacaatacttaaagaggaagatggcgatgccggaaaggaagaggatgcccggacgcgtattattcggagggccgcgctggagtttgaagatggaatgtatgctaaccttgggataggcattcctctgctggctagcaactttatctcacccagcatgacagtgcaccttcattcagagaacgggatacttggactcggtccattccctacggaggacgaggtcgacgctgatctgatcaacgcagggaaacagaccgtgacagtgttacccggcggatgcttttttgcaagcgatgatagcttcgcaatgatccgaggtggccacattcagctcacgatgctgggagccatgcaagtgagcaagtacggcgacctagccaactggatgatccctgggaagaaagtcaagggcatgggaggcgccatggatctggtctcttctcagaagacacgtgtggtggtcacgatgcagcattgtacaaaagataacactcctaagattatggaaaagtgcacaatgcccctaaccggcaaacgctgcgtggaccgcatcatcactgagaaagccgtctttgatgttcatagaaagaaagaacttaccctgcgggagctttgggagggcctgacagtagacgatattaagaaatcaaccggctgcgcctttgccgtgagccctaatctcagacccatgcagcaggtcgccccctag

SEQ ID NO: 24151 - DNA, 798 bp, Artificial Sequence
  Description of Artificial Sequence: Synthetic coding sequence
atggcagccttgagattgctagcgtccgtcctcggtcggggcgtcccagctggcggttccggcctagccctgagtcagggttgcgctcggtgtttcgccacttctccgcggcttagggcaaaattctatgctgacccagtggaaatggtgaaggacatctccgatggcgcaaccgtgatgattggagggtttggcctatgcggtataccagagaacctgatcgccgcattactccggacacgtgtgaaggacttgcaggtggtgagctcaaacgtgggagtggaagatttcgggcttggactgcttctggccgctcgacaggttagacgcatagtttgcagttacgtcggcgaaaacacgctttgtgaaagccaatatcttgcaggcgagctggaactggaattgaccccccaggggactttggccgagaggattagagccgggggtgctggggtaccagcgttctacacaccaacgggctacggaactctagtgcaagaaggaggagcacccatccggtatacaccagacggccacctggccctgatgagtcaacctcgcgaggtcagagagttcaatggagaccattttttgctggagagggcaattcgcgccgactttgcgttggtcaagggttggaaggccgatcgtgctggaaacgtggtgtttagaagaagcgctcgcaattttaacgtcccaatgtgtaaagcagccgacgtgacagcagtggaagtggaggagattgtggaagttggagcatccccacaaaagaccagtactttcctgacattcatgtag

SEQ ID NO: 24152 - DNA, 984 bp, Artificial Sequence
  Description of Artificial Sequence: Synthetic coding sequence
atgttaggaccgcaggtgtggagtagtgtcagacagggtctgtcgaggtctctgtctagaaatgtgggagtgtgggccagtggcgagggtaagaaggtcgacattgctggtatctaccctccagtgaccacaccctttaccgcgaccgccgaagtcgactacggcaagcttgaggagaacctccataaactaggcacattcccatttagaggttttgtagtgcagggatcaaatggtgaatttccatttctgacaagctcggagcgcctagaagtcgtgagtcgcgtcagacaggcaatgccgaaaaatagactgttgttggccgggagcgggtgcgagagtacccaagccacagtggagatgacagtgagtatggcgcaggtcggggcagacgccgctatggttgtgacaccgtgctactataggggccgtatgagctccgctgcactcattcaccattatactaaagtcgcagacttgtctcccattccggtggttctatatagtgtgccggccaatacaggacttgacctgcccgtcgacgcagtcgtaacattgtcacagcacccaaatattgttgggatgaaggacagcgggggagatgttacacgcataggtctcatcgtgcacaaaactcgcaagcaggactttcaggtgctcgccggcagcgctggtttcctgatggcttcctacgcactgggtgctgtcggcggtgtgtgcgccttagccaatgtgctgggggcgcaggtgtgtcagctggagcgcttatgctgtacggggcaatgggaggatgcccagaaactacaacatcgattgatcgaacctaatgcagccgttactcgacggtttgggatccctggtttgaagaaaatcatggattggttcggctactacggaggtccatgtagggctcctttgcaggaattgtcgcctgccgaagaggaggctctgcgcatggattttaccagcaatggatggctctag

SEQ ID NO: 24153 - DNA, 495 bp, Artificial Sequence
  Description of Artificial Sequence: Synthetic coding sequence
atgctggggccccaggtgtggagttcggtacgccagggattgtcgagatccctctccagaaacgtgggcgtatgggcctcaggggaaggcaagaaggtcgatatcgccgggatctatccaccagtgacaactccattcaccgctacagccgaagttgactatggcaaattagaggaaaacctccacaagctaggaacattccccttccggggtgccgtgggcggggtgtgcgccttagccaacgtcctcggcgcccaggtctgtcagctggaacggctctgctgcaccggccagtgggaagacgctcagaagctgcagcataggctgatcgaaccaaacgcggccgtgacccgtcgctttgggattccaggcctgaagaagatcatggattggttcggatattacggcggtccatgtcgcgccccgcttcaggagctctcgcctgctgaagaagaggccctgcggatggatttcaccagtaacggatggctatag

SEQ ID NO: 24154 - DNA, 612 bp, Artificial Sequence
  Description of Artificial Sequence: Synthetic coding sequence
atggccgccgcagccgtgtcttccgcaaaacgatccctgcgtggggagctcaagcagaggttgagggctatgagcgccgaagagcgtctgagacagtcccgagtcctatctcagaaggtcattgctcattcagagtaccagaaatcgaaaaggatcagcatatttctgtcaatgcaggatgagattgaaaccgaggaaattatcaaggacatcttccagcgggggaagatctgtttcattccacgataccgcttccagagtaatcacatggatatggtgagaattgagtctcccgaagaaatcagtctcctgcccaaaacgtcctggaacattccacagccgggggagggagatgtgagagaggaggccttgagtactggtggcctcgacttgattttcatgccagggctaggcttcgacaaacacggcaataggttgggccgtggaaaaggatattacgatgcctatttgaagcgatgcctgcagcatcaagaagtgaaaccatacaccctcgccttggctttcaaagagcagatctgcttgcaggtgccggtgaacgagaatgacatgaaagtggacgaagtcctatatgaagactcatcaacggcatag

SEQ ID NO: 24155 - DNA, 1392 bp, Artificial Sequence
  Description of Artificial Sequence: Synthetic coding sequence
atgcacaggagtttcctccaggcccggcgctctcgcaacaccacgagacctgccctgctgcggctgagcgattacctgttgacaaattaccgcaagggggtgcgccccgttcgcgactggcggaagccaacgacagtgtccatcgatgtgattgtgtatgcgatactcaacgtggacgagaagaatcaggtcctgactacctacatctggtaccggcagtattggactgacgagttcttgcagtggaacccagaggacttcgataacattaccaagctgtccatacccacagactctatttgggtgcccgatattttgattaacgagttcgtggacgtcggaaaatcgcccaatatcccatatgtttatatcaggcatcaaggggaggtacagaattacaagcctctgcaggtagtcacagcctgttcactcgacatatacaactttcctttcgatgtgcagaactgtagtcttacctttacttcctggcttcacactatccaggacataaacattagtctctggagattacccgaaaaggtcaagtcagaccgctcagtcttcatgaatcagggggagtgggaactcttaggcgtgcttccctatttcagggagttttccatggaatcgagcaattactacgctgaaatgaaattctatgtagttatcaggagacgacctctattttatgtcgtaagcctgctgctgccatccatctttctgatggtgatggacatcgtcggattctacctcccccccaactctggcgagcgagtgtcctttaaaattacattactccttggctacagcgtattcttgatcatcgtatcggacaccttacccgccacagccattgggacaccgcttattggagtctactttgtcgtatgcatggccctactagtaatcagtctggctgagacaatctttattgtaagattggtgcacaagcaagacttgcagcagcccgtgcccgcatggcttaggcacttagtgctggagaggatcgcttggttgctgtgcctccgggagcaaagcacttcccagcgcccccccgctacaagccaggcaactaaaactgacgattgctctgccatggggaatcactgttctcatatggggggcccacaggactttgaaaagtctcctcgcgatcgctgcagtccccctcctcccccccgggaagcttccttggctgtgtgcgggctgttgcaggagttgtcaagcataagacagttcctggaaaagcgcgatgaaatcagggaggtggcccgggattggctacgtgtcggcagcgtcttggataaactcctcttccacatctacctgttggcggtccttgcgtactcaattacactggtcatgctctggagcatttggcagtacgcttag

SEQ ID NO: 24156 - DNA, 1551 bp, Artificial Sequence
  Description of Artificial Sequence: Synthetic coding sequence
atgcttgggaagctggctatgctactgtgggtacagcaagccctcttggccctcttgctccctacactgttggcgcaaggagaagcgcgacgctctcggaataccacacgaccagctcttcttagactctctgactatctacttaccaactataggaagggggtacggcctgtgagggattggcggaagcctactacagtctccattgatgtaatagtctacgcaattctgaacgttgatgagaaaaaccaggtcctcacaacatacatttggtacagacaatactggaccgacgaattcctccagtggaacccagaagacttcgataacattacgaagctttcaatccccaccgattctatttgggtgcccgatatactgataaacgagtttgtggatgtggggaagtctcctaacattccgtatgtttacattaggcatcaaggggaagtgcaaaactacaaacccctgcaggtcgtgactgcatgtagtcttgacatttacaacttcccctttgatgtacagaattgctcactgacctttacatcatggctccacaccatccaggatatcaacatctcactctggaggttgcctgagaaagtgaagtctgatagaagtgtctttatgaaccagggcgaatgggaattactgggcgtgttgccttactttcgggagttctcaatggaaagctccaattactatgcggaaatgaagttttatgtggtgataagacgacgaccactcttttatgtggtaagtctgctgctgcctagtatctttctcatggtgatggacattgtcggattttatctccctcccaacagtggagagagggtcagcttcaagatcactctgttgctgggctactcagtgttcctcattatcgtaagtgatacattacccgctaccgccataggaacgcctctcattgggaaagcacccccgggctcaagggctcagtcaggcgaaaaacctgctccctcacacctgctgcacgtaagtcttgcaagcgccctcgggtgcaccggagtgtatttcgtagtgtgtatggccttactggttatctctttggccgaaactatctttattgttcgtcttgtgcacaaacaggatctccaacagcctgtgccagcatggcttcgccacttggtgctcgaaagaatagcatggcttctgtgtcttcgggaacaaagtacaagccagaggcctccagcaacgtcccaagcaaccaaaacggacgattgtagtgcgatgggtaaccattgttctcacatgggaggaccccaagacttcgaaaaatctcctagggatcgttgctccccgccgccacccccccgcgaggccagtctcgccgtgtgtggccttctgcaagagctctctagcatccgccagttcttagagaagagagatgagatccgtgaagtggcccgggactggctccgtgtggggtctgttttggataagctgctgtttcatatctacctgttagccgtgttagcgtatagtataactcttgttatgctgtggagtatctggcagtacgcttag

SEQ ID NO: 24157 - DNA, 1455 bp, Artificial Sequence
  Description of Artificial Sequence: Synthetic coding sequence
atgctgggcaagctggcaatgctcctctgggttcagcaggccctgctggccctgcttctccctacactactggcgcagggagaggccagacgttcacggaatacaacgcgacccgcactgttaaggctgtctgactacctgctgacaaattacagaaaaggggtccgcccggttagagattggcgaaagcccaccaccgtaagcatagatgtgatcgtgtatgccatcctgaacgtggacgaaaagaaccaggtgcttaccacctatatctggtacaggcagtactggacagatgagttcctgcagtggaatcctgaagattttgacaacattactaagctctcaatccctacagactccatctgggtcccggacatacttatcaacgagtttgtggacgttggtaagagccctaacatcccatatgtgtacatcagacatcagggggaggtgcagaattacaagcccttacaggttgttaccgcgtgcagtctcgatatttataatttcccctttgacgtccagaattgctctttgacctttaccagttggctgcacaccatacaggacataaacattagtttatggcgcctcccggaaaaggtcaagagcgacaggtccgtattcatgaaccagggcgaatgggagctactgggagtgctgccttactttcgggagttctctatggaatcctctaactactacgcagagatgaaattttacgtggtaattcgccggcgcccccttttttatgtcgtgtctttgcttttgccttccatattccttatggtaatggacattgtggggttttacctgcctccgaactctggggagcgcgtaagctttaagatcaccctgctgcttggctacagtgtgttcctcattatcgtatctgacacactgcccgccactgcaatagggactcctctcataggcgtgtactttgttgtttgtatggcattgctggtgatcagtcttgcggaaacaatcttcattgttaggcttgtacacaagcaggacctgcaacagcctgtcccagcctggctgcggcacctggtgctggagcggatagcttggctgctatgcctccgcgagcaaagcacctctcaaaggccacctgcgactagccaggcgaccaaaactgatgactgtagcgcaatgggaaatcactgttcccacatgggcggaccccaggactttgagaaatctccccgcgacaggtgctcccctcctccaccacccagagaagcaagccttgctgtttgcggactattacaggaactgagctccatccgtcagttcttagaaaagagggacgagattagggaagtggcacgagactggttacgtgtggggtctgtcctggacaagttattgttccacatctatctgctggcagtgttggcttactcaataacgctggtgatgctctggagtatctggcagtatgcctag

SEQ ID NO: 24158 - DNA, 1437 bp, Artificial Sequence
  Description of Artificial Sequence: Synthetic coding sequence
atgcttctgtgggtgcagcaggctctgcttgccctacttttgcccacactcttggcccagggagaagcccgacgctccaggaacactactaggcctgccttactgcgcctgtccgattacttgttgaccaactataggaagggagtgcgaccagtcagggactggcgcaaaccaaccaccgtcagcatcgacgttattgtgtacgcgatactgaatgtggacgaaaaaaaccaagttctcactacatatatttggtacagacagtactggacagatgagtttctgcagtggaaccctgaggattttgacaacatcacaaaactctcaatcccaaccgattcaatttgggtgccggatatcctgataaatgagttcgtggatgtcgggaaatcgccaaatatcccgtatgtgtacattcgacatcagggcgaagtgcagaattacaaacccttgcaggtggtcacagcttgcagcctggatatatacaacttcccctttgacgtgcagaattgctccctgaccttcacctcatggctgcacacgatccaggacataaatatctccctgtggaggcttcctgagaaggtgaagtctgacaggtctgtgtttatgaaccagggggaatgggagttactcggggtactgccttacttcagggagttcagtatggaatcatctaactactacgccgagatgaagttttacgtggtcatccgtagacgacccctgttctacgttgtttccctgctgttgccctctatattcttgatggtgatggatattgttgggttctacctcccccctaattcgggtgaaagagtctccttcaagatcacattgttgctgggatatagcgtctttttaatcattgtctccgatacactgcccgctactgctatcggtaccccactcatcggcgtctatttcgtcgtgtgtatggctttgctcgtaatctcactggccgagacgatattcatcgtgcgacttgtgcacaagcaggatttacagcagcccgttcctgcctggcttcgccatctcgtgttggaacgaattgcgtggttgctgtgtcttcgggaacagagtacttcgcaacgacccccagctactagccaggccacgaaaaccgacgactgcagtgccatgggaaatcactgctcccacatgggagggcctcaggatttcgagaagagcccccgagaccgctgcagcccaccaccccccccaagggaggcttcactggcagtgtgcggcctgttacaggagctcagtagtatccgccaattcctggagaagcgggatgagatccgcgaagtagcacgcgattggctgcgcgtaggctctgtcttggacaagctcctgtttcacatctacctgctggcagtgctcgcctattctatcaccttggtaatgctttggtcaatctggcagtacgcttag

SEQ ID NO: 24159 - DNA, 1533 bp, Artificial Sequence
  Description of Artificial Sequence: Synthetic coding sequence
atgttgctgtgggttcagcaggcactcctggcacttttgttgcctactctgctggctcagggggaggcacgacgctccagaaacacaactcgccctgccctgctgcgactgagcgactaccttctcaccaattaccgcaagggggtgaggcccgtgcgagattggaggaaacccaccacagtctctatcgatgttatagtttacgccattctgaatgtggatgagaagaaccaggtattgacaacgtatatttggtaccgccaatactggactgatgagtttctgcagtggaaccctgaggattttgacaacatcaccaagctaagcattcccacagacagcatctgggtgccagatattctgatcaacgaattcgtcgatgttggtaagtcaccaaacatcccttatgtgtacattcgccaccaaggcgaggtacagaactataagccactgcaggttgtcaccgcctgttctttggacatctacaactttcccttcgacgtccagaattgctcattaacttttacctcctggctgcacactatacaggatatcaatatcagcctctggcgcctgcccgaaaaggtcaagtccgatcggtccgtctttatgaaccagggggagtgggaactgctgggagttttaccctactttagagagttttctatggagtcttctaactactacgctgagatgaagttttacgttgtaattcggaggcgaccccttttctacgtggtgtctctgttactgcccagcatctttttaatggtgatggatatagtcgggttttaccttccaccaaactctggagagcgcgtctctttcaagattacactgctgctaggatatagcgtctttttaatcatcgtttctgacacgctcccggcaaccgctattggaactcctcttatcggcaaagcgcctcctggatccagggctcagtccggagaaaagcctgcgcccagccacctcctccacgtctctctcgcatcggcactgggttgcactggtgtgtattttgtggtgtgtatggccttgctggtgattagcttagctgagacaatcttcattgtacgtctggttcacaaacaagatctccagcagccagttcccgcttggttacgccatctggtccttgaaaggattgcctggctgttgtgcttgcgggagcagtcaacttcgcagcgtccacccgcaaccagtcaggctactaaaaccgatgattgctctgcaatgggaaaccattgcagtcacatggggggcccccaggactttgagaagagtcctagggaccgatgttccccccccccccccccacgggaggcgagtctggccgtgtgtggattgcttcaggagcttagctctatccgccagttcctcgagaaaagagacgagattcgggaggtcgcacgcgactggctgcgtgtgggttctgttctggataagctactgtttcacatctacctactcgccgtcctggcctacagtattacactcgtaatgctttggtccatttggcaatatgcctag

SEQ ID NO: 24160 - DNA, 717 bp, Artificial Sequence
  Description of Artificial Sequence: Synthetic coding sequence
atgctactgtgggtgcagcaggctttgcttgcactgctgcttcctacccttcttgcccaaggtgaggccaggcgcagccggaacaccacgcgcccagcactgctacgtctgtctgactatttgctcactaattatcggaagggcgtcaggcctgtccgggactggcgcaagcccacaaccgtgagtattgatgtcatagtttatgcaattttgaatgtggacgaaaagaaccaggtgctgacgacatacatctggtaccggcaatattggacagacgagttcctgcagtggaacccagaggactttgacaacatcacaaaactctctatccccaccgactcaatttgggttccagatattctgattaacgagtttgttgacgtcggcaaatcgccaaatatcccctatgtatatataagacatcagggggaggtccagaactacaagccactgcaggtggtgacagcctgctctctggacatttataatttcccattcgacgttcaaaactgttccctgacattcacctcatggctgcacacatccggacatccccccgccgctccacttctttgcggccagcctgcaacggcccagcacctcccccacggccatggtcacagaggactgctaccagcgccacagcaatggcgtgaggggttgttccaggactataccccccctggacttttgggcctgccagatcataggttctag

SEQ ID NO: 24161 - DNA, 669 bp, Artificial Sequence
  Description of Artificial Sequence: Synthetic coding sequence
atggtgatggatatcgtggggttttatctcccccccaactcaggagaaagggtgagctttaaaatcaccctgctgctgggctacagtgtgtttctgattattgtgtccgatacactcccagccaccgccattggtactccgctcattggggtgtatttcgtcgtatgcatggccctgcttgtgataagccttgccgaaacaattttcattgtgagactggttcataaacaagatcttcagcagccggttcccgcctggctcaggcatcttgtcctggaaaggattgcctggctgctgtgtctaagggaacagtctacctcccagagaccgcctgccacttctcaggctactaagaccgacgactgctcagcaatgggtaatcattgtagccacatggggggaccacaagacttcgaaaaatcccccagagaccgctgtagcccccctccaccgcctcgcgaggcttcactggctgtttgcggcctgctgcaggagctgtctagcatccggcagtttttggagaagagagatgagataagggaggtggcccgcgattggctgagggtggggtcagttctcgataaactgcttttccatatctacctgctagccgtgctggcatactccattacactagtaatgctgtggtccatttggcagtacgcgtag

SEQ ID NO: 24162 - DNA, 5349 bp, Artificial Sequence
  Description of Artificial Sequence: Synthetic coding sequence
atgggtgctgggagttccaccgaacagcgctccccagagcagcccccagaggggtcttccacgcccgccgaacctgaacccagcggaggcggtccaagcgcagaagccgcccccgatactacggcagaccctgccattgctgcctccgatcccgcaacaaagctactgcaaaaaaacggacagctgtctacaattaatggggtagcggaacaggatgaattatctctgcaagagggggatctgaacggccagaagggcgctctcaacggccagggagctctgaattcacaggaagaagaggaggtcatagttacggaggtcgggcagagagactcagaggacgtctctaagagggacagtgataaggagatggccacaaaatccgcagtggtgcacgatataaccgatgatggccaggaggaaacgccagaaatcatcgaacagattcctagctcggagagtaatttggaagaattgactcaaccaactgagagccaagcgaacgatatcgggtttaagaaggtgttcaagttcgtgggattcaagttcacagtcaagaaggacaaaaccgaaaagccagataccgtgcagctattaacggtgaagaaggacgagggagaaggggccgccggagcaggagaccataaggacccttctctgggcgccggtgaggctgccagcaaggagtccgagcccaaacagagcacagagaagccagaggaaaccttgaagagggaacaaagccacgccgaaatctctccacccgccgagagcgggcaggccgttgaggaatgtaaagaagagggcgaggagaagcaggagaaagaaccaagcaaaagtgcggaatcgcccaccagtcccgtgacatcggagaccggctctacatttaaaaagttcttcacccaagggtgggccgggtggaggaagaagaccagcttccggaaacctaaagaagacgaagtggaggccagtgaaaagaaaaaagagcaggaaccggaaaaggtggacacagaggaagacggtaaagctgaggtggcgtccgaaaagctgaccgcctccgagcaggctcatcctcaggagcccgccgagtcggcgcatgaaccaagactctctgccgagtacgaaaaggtagaattgccatccgaagaacaggtttccggtagtcaggggccgtccgaggagaaaccagcccccctcgctaccgaagtgttcgacgagaagatcgaggttcatcaggaggaggtcgtcgcagaagtgcatgtcagcaccgtggaagagcggaccgaggaacagaagaccgaggttgaggagaccgcgggctctgtccccgccgaagagctcgtggaaatggatgctgagcctcaggaggccgagcccgcaaaagagctggtaaagctgaaagagacttgtgtttccggcgaagacccaacacagggcgccgacctctccccagacgagaaggtcttatccaagcccccagagggcgtcgtgagcgaggtagagatgctgagcagtcaggaacgaatgaaggtgcagggatctcccctaaagaaactgttcacatccactgggctcaaaaagctgtcgggcaaaaagcagaagggtaaacgcggcggcggcgatgaggaatctggcgaacatactcaggtgcctgctgatagtcccgattctcaggaggagcaaaaaggggaatcgtcagccagcagccctgaggaaccagaagagatcacttgtttagaaaagggtctggcagaagtccaacaggacggtgaagctgaggagggtgccacatctgatggggagaaaaaaagagagggggtaaccccatgggcatccttcaagaagatggttactcccaagaagagggtcaggaggccaagtgagtcagacaaggaagatgaactagataaggtgaagagtgctacactcagctcaacagagtctaccgctagtgaaatgcaagaggagatgaaaggttcagtggaagagcccaagccggaggaacctaagagaaaagtcgatacctcagtatcatgggaggccctcatctgtgtcgggagttcaaagaagagggcacggagaggcagtagttcagacgaggaaggggggccgaaagccatgggcggagatcaccagaaggcagatgaagccggcaaggataaggaaaccggcacagacgggattctcgccggctcacaggagcatgaccccggccaaggatctagctcacctgagcaggccgggtccccgaccgaaggggagggtgtgtcaacctgggaaagtttcaagaggctcgtgaccccaagaaaaaagagcaagtccaaattagaggagaagagcgaggattccatcgcagggtcgggcgtggaacactcaacaccggacacggagccaggaaaagaggagtcctgggtctccattaaaaaatttatccccggccgcaggaaaaaaagacccgatggaaaacaggagcaagcacctgttgaggacgccgggcccacgggagcgaacgaggatgattccgatgtccccgccgtggtgcccctctcagagtacgacgcggtggagagagaaaaaatggaagcacagcaagcacaaaagagcgccgagcagccagagcagaaagcagccaccgaggtgtctaaagagctgagtgagtctcaggtccatatgatggccgccgccgtggcagacggaacccgggccgccaccattatagaggaacgatctccttcatggatctccgcatccgtgacagagcctctggaacaggtggaagcagaggcggccttactcacggaagaagtcctggagcgcgaggtcattgctgaggaagagcctcccaccgtgacagaaccgctgcctgaaaaccgggaagctcgcggtgataccgtcgtctccgaggccgagctcacccctgaggccgtgacggccgccgagaccgccggtcccctgggggcggaagaggggacggaggcctccgcggccgaggaaaccacagaaatggtgagcgcagtgagtcagttgacagactctcctgacaccacggaagaagccactccagtgcaggaagtggaaggcggtgtgccagacatcgaagagcaggagcggagaacacaggaggtgctgcaggcagtcgcggaaaaggtgaaagaagagagtcagctgcccggcaccgggggaccggaggacgttctccagcccgtgcaacgggccgaggctgaacgacccgaagagcaagctgaagccagtgggctgaagaaggagactgacgtcgtcctcaaggtggacgcccaggaagcaaaaaccgagccctttacgcaagggaaagtggtcggacagactacccctgagtccttcgagaaggccccccaggttactgagtcaatagagtcctccgagctggtgactacatgtcaggcagagacgttggctggggtcaaaagccaggaaatggtaatggagcaagcaatccccccggacagtgttgagacgcctaccgactcagagaccgatggttccacacccgtggccgatttcgatgcaccaggtaccactcagaaggacgaaatagtggagatccacgaggaaaacgaggtagcatctgggacccagtcaggtgggaccgaagccgaggccgtgcccgcacagaaggagcgacctcctgccccgtcctctttcgtgtttcaggaagaaactaaggaacagagcaagatggaggatacgctggagcatactgacaaagaagtaagcgtggagactgtgtccatactctccaagactgaaggtacccaagaggcagatcagtatgcggatgagaaaactaaagacgttcctttcttcgaagggcttgaaggttccatagacacaggcattacggtgagccgcgaaaaagtgaccgaagttgctctgaaaggggaagggacagaggaggcagagtgtaaaaaagatgatgcccttgaactccagtctcatgccaaatcccctccttcgcccgttgagagagagatggtggtccaggtcgaaagagagaagactgaggccgagcctactcacgtgaacgaggaaaagctagaacatgagacagctgttaccgtgagtgaagaagtttccaaacagttgctccagactgtcaacgtcccgattattgatggggctaaggaagtgtcttccctggagggctccccaccaccatgcctcgggcaggaagaggctgtttgcaccaaaatccaggtgcagagctcagaagcgtcattcactctaacagcggctgccgaagaggagaaggtgctaggggagaccgctaacatcctggagacgggcgagacccttgagcctgctggggctcacctagtgttagaagaaaagtcctctgaaaaaaatgaagattttgctgctcatcctggggaagacgccgtacccactggccctgattgccaggcaaagagcacaccggtaattgttagtgcgacaacgaagaaaggactgagctcagacctggagggcgaaaaaaccacgtccctcaagtggaagagcgatgaggtcgatgaacaggtcgcctgccaggaagttaaggtatctgtagccattgaggatctggagcctgagaacggtattctcgaactggaaacgaagtcgagcaagctcgtgcagaacattatccagacagccgtggaccagtttgtgcggaccgaggaaacagcgaccgaaatgctgaccagtgagcttcagactcaggcgcatgtgatcaaggctgattctcaggatgcagggcaggagacagaaaaagagggggaggagcctcaagctagcgcccaggatgagactcctattacttccgctaaggaggaatccgaatcgacagctgtgggacaggcccacagtgacatttccaaggatatgtcggaagccagcgaaaagacaatgacggtcgaggtggagggatccactgtgaatgatcagcagttggaagaagtagtcctgccttctgaggaggagggtggtggcgccggaactaaatccgtgccggaagacgacggtcacgctttactagctgagcggatcgagaaaagtctggtagaacccaaggaggatgagaaaggcgacgacgttgacgacccagaaaatcagaacagcgccctggcagacaccgatgcctcgggagggctgaccaaggagtcacccgatacaaacggccccaaacaaaaggaaaaggaggacgcacaggaggtcgagcttcaggaagggaaggtgcattccgaaagcgacaaagcaatcaccccgcaggcccaagaggaactgcagaagcaggaaagggagtccgccaaatccgagctcaccgaatcttag

SEQ ID NO: 24163 - DNA, 5055 bp, Artificial Sequence
  Description of Artificial Sequence: Synthetic coding sequence
atgctcggaactattaccataacagtgggacagagagatagcgaggatgtgtctaaacgggactccgataaagagatggccaccaagtctgccgtcgtgcacgatattacagacgacggacaggaggaaaccccggaaattatcgagcagattccatctagcgaaagcaacctggaggaattgacacaaccgacagaaagccaagccaatgacatcggattcaaaaaggtgtttaagttcgtggggttcaagtttacagtcaagaaagacaaaacagagaagccagataccgtccagctgctgaccgttaagaaggacgaaggagaaggcgccgccggagcaggggaccataaggaccccagcttaggagccggcgaagcggcttctaaggaatcggagcccaagcagagtactgagaagcccgaagaaactctcaaaagggaacaaagtcatgccgagataagcccgccagccgagtccgggcaggccgtcgaggaatgcaaggaggaaggagaagaaaagcaggaaaaagagccaagtaagagcgcagagtcacccacctcccctgtcaccagcgagaccggatcaaccttcaaaaaattttttacacagggctgggcaggttggagaaagaaaacatctttcagaaagccaaaagaggacgaggttgaggctagcgaaaagaagaaggagcaagagcccgaaaaggttgacaccgaggaagacgggaaggctgaagtggcgtccgagaaattgaccgcttctgagcaggcccatccacaagaaccagccgaatcagcccacgagccacgcctctcagccgaatatgagaaggtagagctcccgtctgaagaacaggtcagtggaagccagggcccaagcgaagaaaaacctgcccctcttgccacagaagtatttgacgagaagatagaggtgcatcaggaagaagttgtggccgaggtgcacgtcagtacggttgaggagagaactgaggagcaaaaaaccgaggtggaagagaccgcggggagcgtgccagcggaggaacttgtcgaaatggacgcggagccccaggaagctgaaccggcaaaggagctagtaaagcttaaagaaacttgtgtctccggggaggacccaacacaaggagcagacctgagccctgacgaaaaggtgctgtcaaaaccccctgagggcgtggtctcggaagtggagatgttgagctcacaagagaggatgaaagttcaggggagtcccctcaaaaaactcttcacctccacggggcttaagaagctttctggaaaaaagcagaaaggcaagaggggcggtggcgacgaggaaagtggagagcacacgcaggtgcctgctgactcgccggacagccaggaggagcaaaaaggggagtccagtgcaagcagcccagaggagcctgaagaaattacgtgcttggagaaaggcttggcagaggtgcaacaggatggcgaagccgaagaaggggcaacatcggatggagaaaaaaagcgggagggtgtgactccctgggcttcattcaaaaaaatggtgaccccaaaaaagagggtccgcaggccctcagagagtgataaggaagatgaactcgataaggtgaaatcggcaaccctttcttccaccgagagcactgcttctgaaatgcaagaggagatgaagggcagcgttgaggagcccaagccagaagagcccaagagaaaggttgacacctcagtctcttgggaagcactaatctgcgtgggcagttccaaaaagcgcgccaggaggggaagcagttcggacgaggaagggggaccaaaagctatgggtggggaccaccagaaggcagacgaggcaggtaaggacaaggagactggcactgacggcatcctggccggatctcaggagcacgacccggggcagggttcaagctcccctgagcaagcaggatcgcctacggaaggtgagggagtgagtacctgggagagctttaaacgcctcgtcacccctaggaagaagagtaaaagtaaactggaagagaaatctgaggactcgattgctgggtctggggtggagcactctacccctgatacggaacccggcaaggaggagtcatgggtctcaataaagaaattcatccccggccggcggaagaaaaggcctgacgggaagcaggaacaagcccctgtggaagatgccggccctactggagccaatgaagacgattccgatgtgcccgctgtggtcccactgtctgaatatgacgccgtcgagagagaaaagatggaagcccaacaggcacagaagtcagctgaacagccagagcagaaggcagctacagaagtgtctaaggaactgtcagagagccaggtgcacatgatggcggctgcagtggccgacggaacccgggccgcaactataatagaggagagaagcccatcctggatcagcgccagtgttactgagcccctggagcaggtggaggctgaagcagccctcctgaccgaagaggtgctggagagggaagttatcgcagaggaggagcctccaacggtcaccgagcctctccctgagaaccgagaggctcgaggtgacactgtggtcagcgaggccgaattaacccccgaggctgttaccgctgccgagactgccggtccattgggcgctgaggaggggaccgaggctagcgcggcagaggaaaccacagagatggtgtcagcagtgtcccagctcactgactctcctgatacgaccgaagaagccacacctgtacaggaggtggaaggaggcgtgcctgatatagaagagcaggaacgcagaacacaagaggtgctgcaggctgtggcagaaaaggtgaaagaagaatctcagctcccaggaacagggggtccggaggacgtcctgcagcccgtgcagagagccgaggctgaacggcccgaagagcaggctgaagccagcgggctcaaaaaagagacggacgtggtcctgaaagtggatgcgcaagaagcaaagacagagccgttcactcaagggaaagtcgtgggtcagacaacccccgaatccttcgaaaaggccccccaggtcactgaatcaatcgaaagctccgagttggttaccacatgtcaggccgagaccctggctggggtcaagagtcaggagatggttatggagcaagcaattcctcctgatagcgtcgaaacccctacagactcagaaactgacggatctactcccgtcgccgactttgatgccccgggaaccacacaaaaagatgagatcgtcgagatccacgaggagaatgaagtggccagtggaacccagagtggtggaacagaggccgaggccgtgcctgctcagaaggagagacctccggctccatcatcctttgtattccaggaggaaacaaaggagcaatcgaagatggaagatactctcgagcacaccgacaaagaggtttccgtggaaaccgtatcgatactctcaaaaacagaggggacccaagaggcggaccaatacgccgacgagaaaaccaaggacgtgcctttcttcgaaggactagagggatccatcgacacaggcattactgtaagtcgggagaaggtgactgaagtggctttgaagggtgaaggcacggaggaagctgagtgtaagaaggacgacgccttagagctgcagtctcatgctaagtcaccaccaagccccgttgaacgggagatggttgttcaggtggagcgagagaaaacagaggctgagcccacccatgtgaacgaggaaaaattagaacacgagaccgccgtcacggtctccgaagaggtgtcaaagcaactgttacaaacagtcaatgttcccatcatcgatggggccaaagaagtttctagcctcgaggggagcccccccccatgtctcggacaggaagaggccgtgtgcaccaaaatccaggtgcaatcttcagaggcttccttcactctgaccgccgcagcagaagaggaaaaggtgctgggagagactgccaacatcctggagaccggagagactctcgagccagcgggggcccatctggtcttggaagaaaaatccagtgagaaaaatgaggactttgcggcccacccaggcgaggatgctgtaccaacaggcccggattgccaagctaaaagtacacctgtgattgtgagtgccactaccaagaagggcctgagtagtgatctagagggagaaaaaaccacgtccctcaagtggaaaagcgacgaggtggatgagcaggtagcgtgccaggaggtcaaagtgtcggtcgctatcgaggacctggagcccgagaatggaattctagagctcgaaactaagtcctccaagctcgttcaaaacataattcagacggcggttgatcaattcgtgagaactgaggagacagctaccgaaatgctgaccagcgaactgcagacccaggcacatgtgattaaagccgattcccaggacgccggtcaggagacagaaaaggaaggagaggaacctcaggcctctgcgcaggatgaaactccaatcacaagcgctaaagaagaatcagagtctacggcggtaggtcaggcccattctgacatctctaaagacatgtcagaggctagcgagaaaactatgaccgtggaggtcgagggttctaccgttaacgaccagcagctcgaggaggtggtactgccatcagaagaagaggggggtggcgccgggaccaaaagtgtccccgaggacgatgggcatgccttactcgctgagagaatcgaaaagtctctggtcgaacccaaggaggacgagaagggagatgatgtggatgacccagaaaaccagaatagtgcccttgccgatacggatgcgagcggcggacttacgaaggaatcacccgacacaaacggccccaaacagaaggaaaaggaagacgctcaggaagtcgagctgcaggagggtaaggttcactccgaatcagacaaagccattaccccccaggcacaagaggaacttcaaaagcaggagcgggagtctgccaaaagcgaattgaccgagtcttag

SEQ ID NO: 24164 - DNA, 5034 bp, Artificial Sequence
  Description of Artificial Sequence: Synthetic coding sequence
atggtcggtcagagagatagtgaagatgtgagcaaacgcgatagtgataaggaaatggctacaaaatctgctgtagtgcatgatatcacagatgatgggcaggaagagacccccgaaataatagaacagattccgtcgtccgagagcaacttagaagaactgactcagcccaccgagtcccaggccaatgacattggtttcaagaaagtgtttaagttcgttggtttcaagttcacagtcaagaaggacaagactgagaaaccggacacagtccagctactaactgtcaagaaagacgaaggcgagggcgccgcgggagccggggaccataaggatccatcccttggtgccggtgaggccgctagcaaagagtcagaacccaagcaatctacagagaaaccggaagagaccttaaagagggagcagtcccacgccgagattagcccccccgccgaaagcggtcaggctgtggaagagtgcaaggaagagggcgaggaaaaacaggaaaaggagccatcaaagtcagccgaatcacctaccagccccgtgacgagtgaaacgggatcaaccttcaagaaattttttacccagggttgggctggatggagaaagaaaacatcctttaggaaaccgaaagaggatgaagttgaagcgtccgagaagaagaaggaacaggagccagagaaagtggacacagaagaagacggcaaggctgaggtggcttcggaaaagctcacagcaagtgaacaggcgcatccgcaggagcctgccgagtctgctcacgaacccagactgtctgcagagtatgaaaaagtcgagctcccttcggaagaacaggtgagtggtagtcaaggaccatcggaggagaagccagcccctcttgctaccgaggtcttcgatgaaaaaatcgaagtgcatcaggaagaggtggtcgctgaggttcacgtatccacagttgaggaaaggacagaggagcagaaaaccgaggtagaggaaacagcaggtagcgtcccagctgaggagctggtcgagatggacgccgagccccaagaggccgagccggccaaagaactcgtaaagttaaaggagacgtgtgtatccggtgaagatcccacccagggggcagacctcagtcccgatgaaaaggttctgtctaaaccaccagaaggtgtcgtatcggaggtcgagatgctttcctcccaggaaagaatgaaagtccagggatccccactgaagaagcttttcacttcaaccggcctgaagaagctcagcggtaagaagcaaaaggggaagcggggaggcggcgacgaggagtctggagaacacacacaggtccctgcagattcccccgactcccaggaggagcaaaagggtgagagttctgcgtcttcgcccgaggagccagaggaaataacttgtctggagaagggcctggccgaggttcagcaggacggggaagcagaggagggtgccaccagcgatggtgaaaagaagcgtgagggagtcacgccttgggctagttttaaaaaaatggtcacaccaaagaagagggtgcgccgcccttccgaatcggataaggaggacgagctggataaagtgaaatccgctaccctgtcgtccacagaatctactgcctcggaaatgcaggaggaaatgaaaggcagcgtcgaagaacctaagccagaagagccgaagcgcaaagtcgatacatctgtctcttgggaagctctaatctgcgtaggcagctccaagaagcgagcccgacgcggttcctcctccgacgaggaaggggggcctaaagccatgggcggcgatcaccagaaggcagacgaggcagggaaggataaagaaacgggcactgacggaattttggcagggagtcaggaacacgatccaggccagggtagcagttcacccgaacaagcgggtagccctacagagggtgagggggtgtccacgtgggaatccttcaaacggttagtcactccccggaaaaaaagcaaatctaaattagaagagaaaagcgaagattccattgctggctccggcgtagaacactccacccccgatactgaacctggtaaggaagagagctgggtgtccatcaagaaattcataccaggacggaggaagaagcgtccagatggcaagcaggagcaggccccggtggaggacgccggcccaacaggtgccaacgaggatgactcggacgtgccagccgtggtcccgctgagcgagtatgacgccgttgaaagggagaagatggaggcccagcaagcgcaaaaatctgccgagcagccagagcaaaaggccgcgactgaggtgagcaaagaactgtctgagtcccaggtgcatatgatggctgctgctgtcgctgatgggacaagagcggcgacaattattgaggagcgctccccctcatggatctcagcctccgtgacagagcccctggagcaggtggaagccgaagctgcactgttaacggaggaggtactggagcgcgaagtcatcgcagaggaggagccacccacagtgactgaacctctgcccgagaatcgcgaggcaagaggggatactgttgtgtctgaggctgaactcacccccgaggccgtgaccgcggccgagaccgccggacctcttggcgcagaggagggcacggaggctagcgctgccgaagagaccaccgaaatggtgtcggccgtgtcccagcttaccgattccccagacactacagaggaggcgacaccagtgcaggaggtcgaggggggggtgcccgacatcgaggagcaagagcggcggacacaagaagtcctgcaagccgttgccgaaaaggtgaaagaggagagccagctgccaggcactgggggacccgaggacgttctacagccggtgcagcgcgccgaggctgaacgaccagaagagcaggcggaagcttctggcctgaagaaggaaacagatgtcgtgctgaaagtcgacgctcaagaggctaaaaccgaaccttttacccagggcaaagtggtcggccagactacaccggagtcattcgagaaggccccacaggtgaccgagagcatcgagagctcagaactggtgactacctgtcaggcagagaccctggctggcgtgaagtctcaagagatggtcatggaacaagccattccccctgactcggtcgaaactcctacggacagcgaaaccgacgggagtactcccgtggcggattttgatgcacccggcacaacccagaaagatgagattgtggagatccatgaggaaaacgaggtggcttctggcacacagtccgggggaaccgaggctgaagccgtacctgcgcagaaggagcgacccccggcgccctcctccttcgtgtttcaggaggaaactaaagaacagtccaaaatggaggatactctggagcacacggataaggaagtgtctgttgagactgtgtctatcctaagtaagacagaaggtacacaggaggccgatcagtacgcagacgaaaagactaaggacgttcctttttttgagggactggaaggttctatagatacaggcattaccgtcagccgggagaaggttacagaggtcgctctgaagggtgagggcactgaagaggccgaatgcaaaaaggacgatgccctagaattacagagtcatgctaagtctccgccaagtccagtggagcgggaaatggtcgtccaggtagaacgggagaaaacagaggcagagcctacacacgtgaacgaagagaagttagagcacgaaaccgcagtgaccgtatccgaagaggtctcaaaacagctgctgcagaccgttaatgttcccattattgacggagcgaaagaagtgtcctcactcgaggggtcccctccaccgtgtctgggtcaagaagaggcagtctgcactaagattcaggttcagtcgtcagaagccagtttcaccctgacagctgctgctgaagaagagaaagtactcggagagaccgctaatatacttgaaactggggaaaccctggagccagcaggtgctcatttggtccttgaggaaaaaagtagcgagaagaatgaagacttcgctgcgcacccaggcgaggatgccgtgccaacaggacctgactgccaggcaaaaagcaccccagtcatcgtgagcgcaaccacaaagaaggggctctcttcagatctggagggtgaaaagacaacctcattaaagtggaagagcgacgaagtagatgagcaagtcgcgtgccaagaggtgaaggtgtcagtcgcaatcgaagacctcgagcccgaaaatggcattctggagctagagacaaaaagttctaagctcgtgcaaaacataatacaaacggccgtcgatcagtttgtgagaacggaggaaactgcgacggagatgctgactagtgagttgcagactcaggcgcacgttattaaggcagacagccaggacgccggtcaagaaaccgagaaggaaggggaagagccgcaagcctccgcacaggatgagacacccatcacaagcgccaaggaggaaagcgagtccactgctgtgggccaggcccactcagacatcagtaaggatatgtccgaggccagcgaaaagactatgacagtggaagtcgaaggcagcaccgttaacgaccagcaattggaggaagtcgtcctcccgtctgaggaggagggaggtggcgccggaacgaagtccgtgcccgaagatgatggtcatgctcttttagccgagagaatagagaaatcactagttgagcctaaagaagacgagaagggggacgatgtggacgaccccgaaaatcagaattctgctttggccgatacagatgccagcgggggcctgaccaaggaaagtcccgacacaaatggacccaagcaaaaggagaaggaagatgcacaggaggttgagctacaagagggaaaagtacattctgagagtgacaaagctatcactcctcaagctcaagaggagttacaaaaacaggagagagagtccgccaaatccgaactcacagagtcttag

SEQ ID NO: 24165 - DNA, 5349 bp, Artificial Sequence
  Description of Artificial Sequence: Synthetic coding sequence
atgggggcaggaagcagcacggagcaaagatctcccgagcagccccccgaggggtcctccacacctgccgaacctgaacccagtggcgggggtcccagtgccgaagctgcccccgacacgactgcagatcctgccatcgccgctagcgatcctgctaccaaactgcttcagaaaaacggacagctgagcactatcaatggagtggcagaacaggatgaactcagtttacaggaaggcgacttgaacgggcagaaaggcgctttaaacgggcaaggagccctcaattcacaggaggaggaggaagtaatcgtgacagaggtcgggcagcgcgatagcgaagatgtgtcaaaaagggactctgataaagaaatggctaccaagagcgccgttgtccacgacatcaccgacgatggccaggaagagacacctgagataatagagcagatcccaagttccgagagtaacctggaagagttaacccaacctactgagtcccaggccaacgatattggttttaaaaaggtatttaaattcgttgggttcaagttcacagtaaagaaagataagacggagaagcctgacactgtgcagctcctaacggtcaaaaaagatgagggcgaaggcgctgctggggctggcgatcataaggatccaagcttaggggctggcgaggcagccagtaaggagtcggaacccaaacagagcactgagaagcctgaggagacactgaaaagggaacagagccacgccgagatctccccccctgcagagagcggtcaggccgtcgaagaatgcaaagaggagggagaagagaagcaggagaaagagccctccaagagcgccgagtctcccacgagtccagtgacctctgagacaggatcaacatttaagaaatttttcacccagggatgggctggatggcggaagaaaaccagttttcggaagccaaaagaagatgaggtggaggccagtgagaagaagaaagaacaagagccggaaaaggtggataccgaagaggacggcaaagcggaagtggcctccgagaagctgacagctagcgagcaggcacacccccaagagcccgccgagagcgctcacgagccaaggcttagcgctgaatatgagaaagtggaattgccaagtgaggaacaggtgagcggctctcagggtccctcagaggaaaagcccgctcctttagctacagaagtatttgatgaaaagattgaggtccaccaggaagaagtggttgcagaagtgcacgtttctacagtcgaagaaagaactgaggagcagaaaacggaggtggaggagacagccggcagcgtccctgcagaagagttggttgaaatggacgctgagccacaagaagctgagcctgcgaaggaactcgtcaagttgaaggaaacttgcgtgagcggcgaagatccaactcagggggcagacctgagcccggatgagaaggtcctgagcaagcctcccgaaggggtagtatccgaagtagagatgctctcaagtcaggagcgcatgaaagtacaggggtcccctctgaagaaactgtttacatctaccggcctcaagaagctctccggtaagaagcaaaaagggaagcgtgggggtggggatgaagaatccggcgaacacacccaggttcccgcggacagtcctgattctcaggaggagcagaagggcgagtccagtgccagcagccccgaggaacccgaggagatcacctgtctggagaagggactagctgaggtccaacaggatggtgaggctgaggaaggagcaacttcagatggagaaaagaaaagagagggggtcaccccttgggcttcctttaaaaagatggttactcccaagaagcgagttaggcggcctagtgagtctgataaggaggatgaactcgataaggtgaagtccgccactctgagtagcactgagtccacagcctccgaaatgcaggaagagatgaaaggaagtgtggaagaacctaaacccgaggaacccaagcgcaaggtggatacatcagtttcctgggaggccctgatctgcgttggaagctcgaagaagagagcacgccgaggaagctcttcagacgaggaggggggcccaaaggcgatggggggcgaccatcagaaagctgacgaagcaggaaaggataaggagactgggacagacgggattctggccggcagccaggaacacgacccaggccagggaagctcatcacctgaacaggctggcagtcctacggagggtgagggagtgagcacttgggagagcttcaagaggctggtgacccccagaaagaaaagcaagtctaaactcgaggaaaagagcgaggactcaatcgcaggcagcggcgtggagcacagcacgccagatacagagcctggaaaagaggagtcctgggttagcatcaaaaagtttatccccgggcgccgaaagaaaagaccggatggaaaacaggagcaggcacctgttgaagacgccggacctacgggagccaacgaagatgactcagatgtgccggcagtagttcccctctccgaatatgatgcagttgagcgggaaaaaatggaggcacagcaggcacagaagagcgccgagcagcccgagcagaaggccgccaccgaggtgagtaaggaactatctgagtcacaagtgcatatgatggcggctgcagtggccgacgggacacgggcagcaactatcattgaggagaggtcgccctcctggatctcggcctccgtgacagagccattagagcaagttgaagcagaagccgctctactgactgaggaggttttggagcgtgaggttattgcagaagaggaaccacccaccgtcactgaaccacttcctgaaaaccgggaagcacgaggcgacaccgtagtgtccgaggccgagctcactccagaggccgtgactgcagcggaaacagcaggccctctgggggcagaagaagggaccgaagcctcagcggcagaggaaaccacagaaatggtgtccgccgtgtcacagctgactgattcacccgacacgacggaggaggctactccggtgcaggaagtcgagggaggggtgcccgatatagaggagcaggaaaggagaacccaggaggtgctgcaagcagtggctgagaaggttaaagaagagtcccagctaccagggactggcgggccagaagacgtgcttcagccagttcagagggccgaggctgagcgccccgaggagcaagctgaagctagcggcctgaaaaaggagaccgacgtggttttaaaggtagatgcccaagaagctaagacggaacccttcacgcaagggaaagttgtcggacaaaccacacccgagagcttcgaaaaggcccctcaagttaccgagtcaatagagagcagtgaactagtgactacctgccaggcagagaccctggccggagtaaagagtcaagaaatggtgatggaacaggcaatacctccagacagcgtggagactcccaccgacagcgaaacagacggatcaacacccgttgcggactttgacgcccctggcaccacacagaaggatgaaattgtggagatacatgaagagaatgaggtcgccagcggtacccagagtgggggcactgaggctgaggctgttccagctcagaaggaacgcccacctgccccttcttcttttgtgtttcaggaggagacaaaggagcagtcaaagatggaagacacgcttgagcacactgacaaggaggtgagcgtggagactgtgtcaatcctctccaaaactgagggaacccaggaggcagaccagtacgcggatgagaagactaaggacgtgccattcttcgagggactggaaggctctatcgataccggcatcacagtgtcccgcgagaaagtcaccgaggtggcgctcaaaggagagggaaccgaggaggccgagtgcaaaaaagatgatgctttagagcttcagagccacgccaaaagtcctcccagtcccgtggaacgcgaaatggttgtccaggttgaaagagagaagactgaggctgagcccactcacgtcaacgaagaaaaactggaacatgagactgccgtcaccgtgagtgaagaggtcagcaaacagctgctgcagactgtgaacgtaccgatcattgacggggctaaagaggtgtcaagtttggaaggctccccaccaccctgcctgggacaggaagaggcagtgtgtaccaaaatccaggtgcagtcgagcgaggctagcttcaccctcacagccgccgctgaagaggagaaagtactgggcgagacagccaacattcttgagaccggagagactctagagccggccggggcgcatcttgtattggaggagaaatcctccgagaagaacgaggactttgccgcccatcccggcgaggatgcagtgcccaccgggcctgattgtcaggcgaagagcactccggttatcgtctcggcaacaaccaaaaagggtctgtcatctgatctggagggagagaagactacatccctaaagtggaagtctgacgaggtggacgagcaggtggcctgccaggaagtgaaggtgtccgtagcaattgaggacctggagcctgaaaacggcatcctggaattggagaccaaatcctccaaactcgttcaaaacattatccagacagccgttgaccagttcgtaagaaccgaggagaccgccaccgagatgctgacctccgagctgcagacccaggctcatgtcatcaaggccgactctcaggatgcaggccaggaaacagaaaaggaaggggaggagccacaagcgtctgcacaggacgagacgcccatcaccagcgcaaaggaggaaagcgaatctacggcagtgggccaggcacatagcgatattagcaaggatatgtcagaggccagtgaaaagacaatgactgttgaagtcgaggggtccaccgtaaatgaccaacagctggaggaggtggtgctgccctccgaagaggagggagggggggctggcaccaaaagcgttccagaagatgacggccatgccttgttggcggaacgcatcgagaagtccctggtcgaaccaaaggaagatgaaaaaggagacgatgtcgatgatccggagaatcaaaacagtgccctggccgacacagacgcctccggtggactgacgaaagaatcccctgataccaacggacccaaacagaaggaaaaagaggacgcccaggaagtggagctgcaagaagggaaggtacactctgagtcggataaagctattactccccaggcccaggaagaactgcaaaagcaagaaagagaatctgcaaaatcagagttgaccgaatcctag

SEQ ID NO: 24166 - DNA, 1284 bp, Artificial Sequence
  Description of Artificial Sequence: Synthetic coding sequence
atggagaccacgatcagcgagattcacgtggagaacaaagacgaaaagcgctctgcagagggtagccccggagctgagagacagaaggagaaggcttcaatgctgtgttttaagaggcggaagaaggccgccaaagcacttaaaccaaaagcagggtctgaggcagcggacgtcgcccggaaatgcccccaggaagctggtgcaagcgaccagccagagccaacccggggcgcatgggcatctcttaaacgcttagtgacacgcagaaaacggagcgagtcatccaagcagcagaaaccgctcgagggcgaaatgcaacctgcaattaatgcagaagatgccgacctctcgaaaaagaaggccaaatcgcgacttaagatcccctgtatcaaatttccacggggccccaaaaggtccaatcattccaagataatcgaggacagtgattgctcaattaaggtccaggaggaagcagaaattctcgacattcaaacccagacacccttgaatgaccaggccaccaaagcgaagtccactcaggatctgagtgaaggaatttcgcgcaaagacggagacgaggtttgcgagagtaacgtgagcaattccaccaccagcggcgaaaaagtgatcagcgtggagctcggattagacaatggccactccgccattcaaactggcacactgattctggaggagatagaaactatcaaagagaagcaagatgttcagccccagcaggctagccctctggagacctccgaaaccgaccaccagcagcctgtcctcagcgacgtaccgcccctgccagcaatacccgatcagcagattgtggaggaggcttccaacagtaccctggagtctgcacccaacggtaaggattacgaatccaccgagatcgtagctgaggaaacgaagcctaaagacacagagctcagccaggagtctgacttcaaagagaacgggataaccgaagagaagtccaagtctgaagagtccaagcggatggagccaatcgccattataataacagacaccgagatcagcgagttcgatgtgaccaagtccaagaatgtgcccaagcagtttctgatcagcgcagaaaatgagcaggtcggcgttttcgctaatgataatggattcgaggaccgtaccagcgaacaatacgagacactcctgattgaaactgcatcctcactggttaaaaatgcaattcagctctcgattgaacaactggtaaatgagatggcgtctgacgataacaaaatcaacaatcttcttcagtag

SEQ ID NO: 24167 - DNA, 1284 bp, Artificial Sequence
  Description of Artificial Sequence: Synthetic coding sequence
atggaaaccacaatcagcgaaatccacgtcgaaaataaggacgaaaaaagaagcgccgagggtagtcctggtgccgagcggcaaaaggagaaggcctccatgctgtgttttaaaaggagaaaaaaggccgctaaggcattaaaacctaaagccggttccgaagcagccgacgtggcaagaaagtgtccccaggaagcgggagcctctgatcagcctgagccaacccgtggcgcctgggccagcctcaaacggctggtgacccgaaggaagcggtcggagagctctaagcagcagaagcctctcgagggtgagatgcagcccgctatcaatgcagaggatgccgacttgtcaaagaagaaagccaaatctcgcctgaagatcccatgcattaagtttccccgagggcccaaacggagcaaccactccaagattatagaagattccgattgcagtataaaagttcaggaagaggcggagattctcgatattcagactcaaaccccattaaatgaccaggcgaccaaggcaaaaagtacccaggatctcagcgaggggatttcccgcaaggatggcgacgaggtgtgcgagtccaatgtgtctaattccacaacttccggcgagaaggtgattagcgtcgaacttggtctggataacggacacagtgctatccaaactggcaccctgattttagaagaaattgaaacaattaaggagaaacaagatgtgcaaccacagcaagcgtcacccttagaaacttctgagacggatcaccagcaaccagtactctccgacgtgccaccactgccagctattcctgaccagcagatagtcgaagaggcgtcaaacagcacgttagaatcagctcctaacggcaaagactatgagagcacggagattgtggccgaggaaacaaagcccaaagacaccgagctttcgcaggaaagcgattttaaagagaatggtattactgaggaaaaaagcaagagcgaggagagcaaaaggatggaaccgattgctataattatcacagacaccgagatttcagagtttgacgtgactaagtccaagaacgtgcctaagcaatttctgattagcgcagagaacgaacaggttggcgtgttcgccaatgacaacggctttgaggatagaacatctgagcagtacgaaaccctactgattgagaccgctagttccctggtaaaaaacgccattcagctgtctattgaacagcttgttaatgagatggcttcagacgataacaaaatcaataacttgctgcagtag

SEQ ID NO: 24168 - DNA, 6960 bp, Artificial Sequence
  Description of Artificial Sequence: Synthetic coding sequence
atgttgactatgtctgtgactctctccccattaagatctcaggacctagatcccatggctacggatgccagccccatggcaatcaatatgacgccaaccgtggagcagggtgaaggtgaagaagctatgaaggacatggactccgaccaacagtatgagaagcctcccccactacacacaggcgctgactggaaaattgtattacacctgccggaaattgagacatggctccgcatgactagtgagcgggttcgcgacctgacctattcagtgcagcaagactccgactctaagcatgtcgatgtacacctcgtccaactgaaagacatttgcgaagatatttcagatcacgtggaacagattcacgccttgctggagaccgaattctccctgaaactgctttcatactctgttaatgtaattgtggatatccacgctgtgcagctgctctggcaccagctacgggtgtcggtcttagtcctgcgggagcgaatacttcagggactgcaggacgcgaacgggaattacactcggcaaactgacatcctgcaggccttcagtgaggaaaccaaagaaggtcgcttagattcattgacagaggttgatgattcaggtcaactcacaattaagtgcagtcagaattatttatcattagattgtggcataaccgcctttgaactttccgactacagtccttcagaggatcttttgtcagggctgggagacatgacatcatcccaggtgaaaaccaaacctttcgattcatggagctactctgagatggaaaaagaatttccagagctgatccgatctgtagggcttctgactgttgccgcggacagcatcagcaccaatggttccgaggccgtgacggaggaggtgagccaagtcagcttgtccgtagacgataaaggaggttgcgaggaggacaatgcctcagctgtagaagagcagcctggactcactctgggagtgagctcttcatcaggggaagcccttactaacgccgcgcaaccatcatcagagaccgtccaacaggagagtagcagttcatctcatcatgatgccaagaatcagcagccagtgccatgcgagaatgccactcccaagcgtaccatccgggattgcttcaattataacgaagactctcccacacagcctaccctcccaaagcgcggcctgttcctgaaggaagaaacgttcaagaacgatcttaagggaaacgggggtaagaggcagatggtagacctcaaacctgagatgtccagatccacccccagcctggttgatccccctgataggtcaaagctgtgcttggtcctgcagagctcctatcctaactccccttcagcagcaagtcagtcatatgaatgtcttcataaggtaggcaacggaaatttagaaaataccgtgaagttccacatcaaggagattagctctagtctaggacggttaaacgattgctacaaggagaagagccgcttgaagaaaccccacaaaaccagtgaggaggtgccaccctgtagaacccccaagcgtggtacaggatctggtaagcaggctaagaatactaaatctagcgctgtgccaaatggtgaactgtcctatacctctaaggctattgaaggaccccagactaattccgcatcgacttctagcctcgagccctgcaaccagcggtcctggaatgcgaaacttcagcttcagtctgagacatcgtcttctcctgcatttacccagagttctgagagtagcgttggctctgataatattatgagccctgtgcctctgctgtccaaacacaagagcaaaaagggccaggcatcatccccatcccatgtgacgagaaacggagaggtggttgaggcttggtatggcagtgacgaatatttagctctccccagccacctgaaacagactgaagttctggcgttaaagctggagaatctgacaaagcttctgccccagaaacctagaggggaaacaatacaaaatatcgatgattgggagctgtctgaaatgaactccgactccgagatttaccccacctatcacgtcaagaaaaaacacactcggctgggcagggtgtccccatcatcttcgagcgacatcgcctcctccctgggtgaatcgatagagtccggcccgttgagcgacatcctttcggacgaggaaagttccatgccactcgcgggaatgaagaagtacgcagacgaaaagagcgaacgcgcctcttcttccgagaaaaatgagtctcattccgcaacaaaatctgccctgattcagaaactgatgcaggacattcagcatcaggacaattatgaggctatctgggagaaaattgaaggattcgtcaacaaacttgacgagtttattcagtggttgaacgaggctatggagactacggagaattggaccccaccaaaggcggagatggacgacctgaagctttacctggaaacacatttgagctttaaattgaacgttgatagtcactgcgccctaaaagaggctgtcgaagaggaaggtcaccaattactagagctcatcgcctcacataaggcaggtctgaaggacatgctgaggatgattgcctcacagtggaaggagctgcagcggcagataaagcggcagcattcctggattctgagggcactagacactattaaagccgaaattttggctacagacgtttcggtggaggacgaagaggggaccggaagtcccaaggcagaagttcaactgtgctatttagaagcccagagggatgcagtggaacagatgagccttaaactgtatagcgaacagtatacctccagttctaagagaaaggaagagttcgctgatatgtccaaagtacacagtgtaggctcgaacgggctgctcgacttcgactccgagtaccaggaactctgggattggttaattgacatggaatcacttgtgatggatagtcacgacctgatgatgagcgaggagcagcagcaacatctgtacaagcggtattctgtagaaatgtcgatccgccacttgaaaaagactgagctgctcagtaaagtggaggcactgaagaaggggggtgtcctacttcccaatgatctcctggaaaaagtggatagtatcaacgaaaaatgggagctgctgggaaaaacactcggcgaaaagatccaggacaccatggccggacactcaggctcaagcccaagggatctcttgtctccggagagtggaagcctagttagacaattggaggtccgcattaaggagctcaaagggtggctacgtgacacggaactgttcatattcaattcttgtctacggcaagagaaggagggtaccatgaatacagaaaagcaattgcagtacttcaaatccctctgtcgtgaaataaagcagcggcggcgtggggtcgcctctatcctgcggctgtgtcagcatctgcttgatgacagggagacatgcaatctcaacgcagatcaccagcctatgcagttaataattgtcaaccttgagcgacggtgggaagccatcgttatgcaggccgttcagtggcagacaaggctgcaaaaaaagatggggaaggaaagcgagaccctgaatgtcatcgatcctggcttaatggacttaaacggcatgtctgaagatgccttggagtgggatgagatggatatcagcaacaaactgatctccctgaacgaagagtcaaatgacttggaccaggagttgcagccggtaataccttccttaaagcttggtgaaacctctaatgaggacccggggtacgacgaagaggcagataaccacggcggctcccagtacgccagcaatataacagcgccctcttctcctcacatttaccaagtctattcactccacaacgtagagctgtacgaagataatcacatgccctttctgaaaaacaatccaaaagttactggaatgacacaaccgaatgtgctgaccaagtctttgtctaaggactcaagttttagttcaacgaaaagcctccctgacctgctgggcggctccaatctcgttaaaccttgtgcgtgtcatggtggcgacatgtctcagaattcaggaagcgagagtggcatagtgagtgagggagacaccgaaaccactaccaactctgagatgtgtcttctgaacgcagtcgacggatccccaagcaacctggagacggaacatctcgacccccaaatgggcgacgccgtgaacgtccttaaacagaagtttacagacgaaggcgagtccatcaaactgcccaactccagtcagtcttcaataagtcctgtggggtgcgtgaacggcaaggttggcgaccttaattccattacaaagcacactccagactgcctgggcgaggagcttcaggggaagcatgacgtgttcaccttctatgactacagctacctgcagggctccaaactaaagctgcctatgatcatgaagcagagtcagagcgaaaaagctcatgtcgaggaccctttgctgcgaggcttttatttcgataagaaaagctgcaagtccaagcaccaaaccaccgaactgcagccagatgtgcccccacatgaaaggatcctcgcctccgcctcccacgaaatggatcggatttcatataagtcaggaaacatcgagaaaactttcaccgggatgcaaaacgccaaacagctctccctcctgagccacagtagcagcatcgaatccctctccccaggaggggaccttttcggactcggaatctttaagaatgggagtgattctctacaacgctcaacctctttggagtcgtggctgaccagttacaagagtaatgaggaccttttcagctgccactcaagcggcgatatatccgttagctctggatccgtgggcgagctctcaaagcgtacccttgacttgctgaatcgcctagagaatatacagtctccatctgagcagaagattaaacggtcggtgagtgatatcaccctgcagtcctcaagccagaagatgtcttttactggacaaatgtctctagatatcgcatcttcgattaacgaggattcagcagccagcctgactgaactttctagcagtgacgagctcagcttatgttccgaggacatcgtgctccataagaataaaatcccggaatccaacgcttccttcaggaagcggctgactcggtccgtcgccgatgaatcagatgtcaacgtaagcatgattgtgaacgtatcctgtaccagtgcttgtacagatgacgaggacgatagcgacctgttgagcagctctacccttacactgaccgaagaggagctttgtataaaagatgaggatgacgactccagcatcgccacagacgacgagatctatgaagactgcaccttaatgtccgggctggactacattaagaatgaactgcaaacatggatccgcccaaagcttagtctgacgagggacaagaagcgctgcaacgtctcagacgagatgaaggggagcaaagacatctcttcctcagagatgacaaatcctagcgacacactgaatattgaaactttgctcaacggatcagtaaaaagggtgtctgagaacaacggaaacgggaaaaattcttcccacacacatgaattgggaactaagcgggagaacaaaaaaaccattttcaaggtgaacaaagacccctatgttgctgacatggagaatggaaacatagagggtatccccgagcggcagaaaggcaagcccaatgtcaccagcaaggtcagtgaaaacctaggatcgcatggcaaggagataagcgagtcagaacattgtaagtgcaaagcactgatggactccctcgatgactctaacacagctggcaaagagttcgtaagtcaagatgtaaggcaccttcccaagaagtgcccaaatcaccaccacttcgaaaaccagagtacagcctctacccccacagagaagagttttagcgagctggcactggaaacaaggtttaacaacaggcaggactccgacgctctgaagagcagcgacgatgccccatcaatggcaggcaagtcggctgggtgctgcctcgcgcttgaacagaacggcacggaagagaacgcgtcaattagcaacatcagttgctgtaattgcgaaccggacgtgttccatcagaaggatgccgaagactgttccgttcataattttgtcaaggagattattgacatggccagtaccgccttgaagtctaaaagtcagcctgagaacgaggttgcagcacctacaagtctcacccagataaaagaaaaagtcctcgagcactcacacaggccgatacagctgcgaaagggggacttctatagctacctctccctttcctcacacgattctgactgtggcgaagtcactaactacatcgaggagaagagtagtacccccctaccactcgacactacagactcgggccttgatgataaggaagacatagagtgcttttttgaagcctgtgtagagggagactctgatggggaggagccctgtttcagtagcgccccccccaacgaaagcgccgtgcctagcgaggccgcgatgcctttgcaggcgaccgcgtgctctagtgagttcagcgactcgagcttatccgcggacgacgccgatactgtggcccttagcagtccctcttcacaggagcgcgctgaagtcggaaaggaggtgaatggactgccgcagacatcaagcggatgtgctgaaaatctggaattcactccctccaagcttgatagcgaaaaggagagtagcgggaagccaggcgagtcagggatgcccgaagaacacaatgctgcctcagcaaagtccaaggtgcaagatttatcgcttaaggcgaaccagcccaccgacaaagccgctctacacccatccccaaaaaccctgacttgtgaggagaatctgctcaacctgcatgaaaaacgtcacagaaatatgcatagatag

SEQ ID NO: 24169 - DNA, 327 bp, Artificial Sequence
  Description of Artificial Sequence: Synthetic coding sequence
atgctcacgatgtctgtgacccttagccctctgcgctcacaagatctggaccctatggcgacagatgcctctcccatggccattaacatgacacccacagtcgagcagggagaaggcgaagaggccatgaaagatatggatagtgatcagcagtatgaaaagccacctcccctgcacacaggcgctgactggaagattgtgttgcaccttccagagatcgagacctggcttaggatgacctctgagagagtgcgggacctgacgtattccgtgcagcaggattcagatagcaaacatgtggatgtccacttggtacaactgaagtag

SEQ ID NO: 24170 - DNA, 246 bp, Artificial Sequence
  Description of Artificial Sequence: Synthetic coding sequence
atgggccagctctgctgtttcccattttctagagatgaaggaaagatttcagagaagaacggcggggagccagatgatgcagagttagttcgcctcagcaaaaggctggtggaaaacgcggtgctgaaggctgtccaacagtatctcgaagaaacccagaataaaaataaaccaggagaagggtcatcggttaagactgaggcagccgatcagaatgggaatgacaacgagaataataggaagtag

SEQ ID NO: 24171 - DNA, 981 bp, Artificial Sequence
  Description of Artificial Sequence: Synthetic coding sequence
atgagcgaggaattcgaggctaacactatggattctctggtggacatgccctttgctacggttgacatccaggacgattgcggtattaccgatgagccccaaattaatctgaagagaagccaggaaaacgagtgggtcaagtccgaccaggttaaaaagcggaagaagaagcggaaagactaccagcctaactatttcctttcaatcccgatcacaaacaaggagattatcaaaggaattaaaatactgcaaaacgccatcatacagcaggatgaaagacttgccaaggctatggtgtcagacggctcgttccacattaccctgctggtgatgcaactgctaaacgaggatgaagtcaatattgggatcgatgcccttcttgagcttaaacccttcatcgaggagctcctgcagggcaagcacctcacacttcccttccaaggtataggaacatttggaaatcaggtgggcttcgtgaagctggctgaaggcgatcacgttaacagcctcctggagattgccgagaccgcaaacagaacgttccaggaaaagggaatcttagttggagagagccgtagttttaagccacaccttactttcatgaagctctcgaagtcgccctggctgcgtaagaatggtgtgaaaaaaatcgatcccgacttgtacgaaaaattcatatcccacaggttcggcgaagagatactgtataggattgatctctgttcaatgctgaaaaagaaacaatccaacggatattatcactgtgagagcagtattgtcatcggggagaaaaacggcggcgagcccgatgacgccgaattagtgcggctttcaaaacgactggtagaaaatgcggtgctcaaggctgttcagcagtacttagaggaaacgcagaacaaaaacaaaccaggcgaaggatcgagcgtcaaaaccgaagcggccgatcagaatggcaatgacaatgagaataataggaagtag

SEQ ID NO: 24172 - DNA, 1047 bp, Artificial Sequence
  Description of Artificial Sequence: Synthetic coding sequence
atggaaagaccagaagcagggggaatcaattcaaacgaatgcgagaacgtttcccgtaagaaaaagatgtctgaggaatttgaagccaacacaatggacagcctagtcgacatgcccttcgccacggtcgacattcaggacgattgcggcatcacagacgagccccagattaacctgaagcgttcccaggagaacgagtgggtgaagtccgatcaggtgaagaagagaaagaagaaaaggaaagattatcagccaaattatttcctgtccattcctatcactaacaaggagattatcaaaggaatcaagatactccaaaacgcaatcattcaacaggatgagcgtcttgccaaagccatggtttctgatggttcatttcacatcactcttttggtgatgcagcttttaaacgaggacgaggtgaacatcggcatagatgccctgcttgaattgaaaccgttcatagaggaactgctgcaggggaagcatctcacactgccatttcaaggaatcggtacatttggcaaccaggtgggtttcgtgaaactggcagaaggggatcacgttaatagtttgcttgagatcgccgagacagccaatagaaccttccaggaaaagggaattttagtcggtgagagccggagtttcaagccacaccttacctttatgaagttatcaaaaagcccctggctacgcaagaacggcgtgaagaaaatcgatcctgatctatacgaaaaattcattagtcatcggttcggcgaggagattctctatcgcatcgatctttgcagcatgctgaaaaagaaacagtccaacgggtattaccattgcgagtcgagtatcgtaattggcgaaaaaaacggtggtgagcccgatgacgccgagctcgttcgcttgtcaaagagacttgtggagaatgcagttttaaaggctgtgcagcaatacttggaggaaactcaaaacaagaataaacccggagagggatcttcagtcaaaaccgaggctgcagatcagaatggtaatgataacgaaaacaaccgcaagtag

SEQ ID NO: 24173 - DNA, 315 bp, Artificial Sequence
  Description of Artificial Sequence: Synthetic coding sequence
atgggtcagctgtgttgtttccccttctctcgcgacgaggggaagatttccgagttagaatccagttctagtgcagtcctccaaaggtatagcaaggacatcccatcatggtcttcaggcgagaagaacggaggcgagccagacgacgcagaattggtccgcctctccaagaggttagtggaaaacgcagtgctgaaagcagtgcagcaatacctcgaggaaacccaaaacaaaaacaaacctggagaagggtcttcagtgaagaccgaggccgcagaccagaacggcaatgataacgagaacaatcggaagtag

SEQ ID NO: 24174 - DNA, 684 bp, Artificial Sequence
  Description of Artificial Sequence: Synthetic coding sequence
atggctccagactatggggtcatgggaatgcaaggcgcaggaggatatgattccacaatgccgtacgggtgcgggcggtcccagcctcgcatgcgtgatcgcgatcgaccaaagcgaagggggtttgatagattcggccccgacggcaccggccgcaagagaaaacagttccagttatacgaagaaccagacacaaaacttgccagagtagacagtgagggggacttcagtgagaacgacgacgctgctggcgacttcagatctggagacgaagagtttaagggggaggacgaactgtgcgactccggacgtcagaggggagaaaaggaggacgaggatgaagacgtgaagaaacgccgcgagaaacagcggcggcgggaccgtaccagggatcgggcggccgatcggatacagttcgcctgttccgtttgcaagtttcggtctttcgacgatgaggaaatacagaagcatcttcagtccaaatttcacaaagagacgctgcgctttatctccaccaagctgccagataagaccgtagaatttctgcaggagtatattgtgaatcgaaataagaaaatcgagaagcgccggcaagaactgatggagaaggagactgccaagcccaaacccgatccctttaagggcgagctgtctagtcaggacgaatgctttcctggctggtag

SEQ ID NO: 24175 - DNA, 2079 bp, Artificial Sequence
  Description of Artificial Sequence: Synthetic coding sequence
atggatcaaggatacggtgggtacggagcttggtccgcagggcccgccaacacccagggggcatacggaacaggcgtggcttcttggcagggatatgagaattacaattattacggtgcccagaatacttctgtgacaaccggcgctacttacagctatgggccagcatcctgggaggctgccaaggccaatgacggcggcttggccgccggagctcccgccatgcacatggccagttacgggcctgagccctgtacagataactctgacagcctgatagcaaaaatcaatcagcggttggacatgatgagtaaggagggcggacggggtggaagtggcggcggtggtgagggcatacaggatcgggagagttcttttaggtttcaaccttttgaatcctatgactccaggccatgtttacccgaacataacccctatcggccaagctacagctacgactacgagttcgaccttggaagcgatcgcaacggcagctttggcgggcaatactcagagtgtcgcgaccctgcaagagagcggggcagtctagatggattcatgagagggcggggacaggggcgctttcaggatcgcagtaacccgggtactttcatgcgctccgacccctttgtgccacctgctgcgagctcagagccgctatctactccttggaatgaattaaattatgtcggaggcagggggttgggcgggcctagccccagtcggccaccaccttctcttttctctcagagcatggccccagattacggggttatgggaatgcagggtgccggcggctatgactccaccatgccttatgggtgcggcaggtcccagccacggatgagagaccgagaccggcctaaacgacggggatttgaccggtttggtcccgatggaacaggtcgaaagcggaaacaattccagctttacgaggaacctgatacaaaattagcccgcgtcgactctgaaggcgacttcagcgagaatgacgacgccgccggggattttagatccggagacgaagaattcaaaggagaagatgagttgtgtgactcaggcagacagcggggggagaaggaagatgaggacgaggatgtgaagaagcggagagaaaagcagagaaggagagataggacccgcgatagggctgccgatcggattcagtttgcctgcagcgtgtgtaaattcagatccttcgacgacgaggaaattcaaaagcacctacagagcaagtttcacaaggagacccttagatttatctcaacaaagctgccagacaagacagtagaatttttgcaagagtacatcgttaaccggaataagaagatcgaaaaacgccggcaggagcttatggagaaggagactgctaagcctaaacccgatccatttaaaggcattggccaggagcacttctttaagaaaatcgaggccgcccactgtctagcctgtgatatgctgatacctgctcagccccagctgctgcagagacacttacactccgttgaccacaatcataaccgacgactggccgccgagcaatttaaaaagacatcactccacgtcgccaagtcggtgcttaacaaccgccacatcgtgaaaatgttggagaagtatctgaagggtgaggacccttttacttccgaaaccgtcgatccggagatggagggtgacgacaacctgggaggggaagacaagaaagaaacgcccgaagaggtggcagccgacgtcttggcggaggtgattaccgctgccgtgcgcgccgtcgacggggagggagcgcccgcaccagagagcagcggcgagccagcagaagacgagggccccacagacacggcggaagccggcagcgatccccaagcagaacagctgctggaggagcaagtcccttgtggaactgcccatgagaaaggcgtacctaaggctcgcagcgaagcagccgaagccgggaacggggccgagacgatggcggccgaagctgagagtgcccagacgagggtcgcgcctgctcccgcagccgccgacgctgaggtggagcagacagacgccgaatccaaggacgctgtccccaccgagtag

SEQ ID NO: 24176 - DNA, 1881 bp, Artificial Sequence
  Description of Artificial Sequence: Synthetic coding sequence
atggttgcgccctggcgggtcagtgtgcgagtctgtctatctcacttgaggtgtttcgagctgcggcagggactgagtttgctgcgaccatctgagtgcccaagagacgctaggctctgctggctgctgctgggaaccttgccaaaggtcgtcagcttgtgcggtgacgtgggcgagggggcacccgacgtgctgtcccgtcgacgtgtgcggtgctcaggggctgctggcgctgggcctgcagaaagccttccacgcgccggcccgctgggtggcgtgtttctccatttgcgcctctggctgcgagcaggcgccctgctcgtcaagttttttccgctgttgctgttgtaccctctgacatacctggcccccagcgttagcacactttggctgcacctcctgttgaaggctaccgagacgagcggtcctacatacatcaaactgggccagtgggcaagtacgcggcgagatttattctccgaggccttctgcgctcagttcagtaagctgcacgtcagggtgaccccccacccatggacacatacggagagattcttgcggcaagcatttggcgacgactggggttccatcctctctttcgagaatcgcgagccagtcggcagcggctgtgtggcacaagtgtataaggcctatgcgaatactgcattcctcgaaacggactcagttcagagacttggaagggcaagctgtctccctccgttttcccatactggtgccgttggcggtttacgggagctcttcggttatttaggcaacggcagaaagcccccagaaaacctggccgaccaatccttccttgagaggctgctgttgccaaaggccgatctggtagggagcaacgcaggcgtgtcgcgggctcaggttcccggacaccagcctgaggcgaccaaccttatttccgtggctgtgaaggtcctgcacccaggtctgctggctcaagtgcacatggatctactcctgatgaaaatcggatctcgtgtactcggtgtgttacctggaatcaagtggctgtctttgccggagattgtggaggagttcgagaaactgatggtccagcagatcgaccttaggtatgaagcccagaatctggagcacttccaagttaactttcgaaatgtcaaggctgtgaaattccctacacccctgcgccccttcgtgacgagggaggtgctggtggaaacctatgaggagtcagtgcctgtaagcagttaccagcaggcgggaatccccgtcgacctgaagcggaagatcgctcggctgggaatcaacatgctgttaaagatgattttcgtggacaactttgttcatgccgacttacaccccggcaatatcctggtgcagggagccaatgggctgtctagcagtcaggaggcccagcttcagcaagcagatatctgtgatacccttgttgttgccgtcccttccagcctgtgcccactccgcttggtcttgctggacgctggcattgtcgccgagctgcaggctccagatctgcgcaattttcgagccgtcttcatggccgttgtcatgggacagggccaacgtgtggcagagttaattctgcaccacgcaagagcatccgagtgccgggacgtcgaaggattcaaaactgagatggctatgctggtcactcaagcccggaagaacactataacattggaaaaattgcacgttagcagtttattgtcttctgttttcaaattgctaatgacacacaaggtcaagctagagagtaacttcgcgagtattgttttcgctataatggttttagaagggctgggcaggagtttagatccaaaactcgacattctggaggcagcccggccatttctcctgactggaccagtctgcccaccgtag

SEQ ID NO: 24177 - DNA, 1512 bp, Artificial Sequence
  Description of Artificial Sequence: Synthetic coding sequence
atgtggcttaaagtaggagggctgcttagggggaccgggggccagctggggcagaccgtgggttggccatgtggcgctctgggcccaggaccacatagatggggtccttgcggcgggagctgggcccaaaagttctaccaggacggcccaggtaggggattgggcgaagaagacatccgtagggctcgcgaagcgcgccctcggaagacgccgcggccacaactcagtgaccgtagccgtgaacgaaaggtgcccgcttctcgcatttctagactggcaaatttcggcggactggctgtgggcctcggactgggcgtgctggccgaaatggcgaagaaatctatgcccggaggaagactgcagtcagacaactcattcataagtccccagttgcagcatatcttcgagcgcgtcaggcagagcgccgatttcatgccacggtggcagatgctacgggtgctggaagaagagctcggcagggattggcaagcaaaggtagcatcactcgaagaagtgccattcgcggctgccagtattggacaagtgcaccaagggctgttaagagacggcaccgaggttgcagtgaaaatccagtaccctgggatagctcagtccatacaatccgatgtacagaacctcctcgcagtgttgaagatgtccgcggccctgcccgctggcctttttgctgaacagagcctccaagccctgcaacaggaactggcttgggagtgtgattaccggcgggaggctgcttgtgcacagaactttcgtcagctgctggctaacgatcccttctttagagttcctgcggttgttaaggagctttgcactacaagggtgctgggaatggagctggctggtggggtgccacttgatcagtgtcaagggctttctcaggatctccggaatcagatttgctttcagctcttgactctgtgtcttagggaactgtttgagttccgatttatgcagaccgaccctaattgggcaaactttctatatgatgcttcgtcgcatcaggtgactctgctggatttcggagcaagccgcgagttcggcactgagttcaccgatcattacatcgaggttgttaaggctgcagcagatggtgaccgggactgcgttctacaaaaaagcagggatcttaagttcctaactgggttcgagaccaaggcctttagcgacgcacacgtggaggcagtcatgatcctgggcgagccgttcgccacacaaggaccgtacgactttggaagcggggaaaccgcacggcgaatccaagacttgattcccgttctcctccgtcatcgcctatgtcctccgcccgaggagacctacgcccttcaccgcaaactggcaggcgcctttctggcatgcgctcacttgagggctcacattgcctgtcgtgaccttttccaagacacttaccatagatactgggccagcaggcagccggacgcagccacggccggctctttgccaactaaaggtgatagctgggtggatccgtcgtag

SEQ ID NO: 24178 - DNA, 1635 bp, Artificial Sequence
  Description of Artificial Sequence: Synthetic coding sequence
atgtggctgaaggtcggaggcttattaaggggaacgggcgggcagttaggacaaactgttggatggccttgtggggctctgggccctggccctcaccgatggggtccttgtggaggcagctgggcacagaaattttaccaggacgggcctgggagggggctgggagaagaagatattcgacgggcaagagaggcccgtcccagaaagacaccaaggccacaattatcagacagatctagagagcggaaggttcctgcttcccgcatcagccggctcgctaactttggcggcttagccgtgggcctgggactcggcgttctagcagagatggctaagaagtcgatgcctggaggacgcctgcagtctgagggggggagcggtctggacagttcaccgtttctctcagaggcaaacgccgaacgcattgtgcaaaccctttgcacagtgagaggagctgcactgaaggtcggacagatgttatcaatacaggataatagtttcatatcaccacagctacaacacatattcgaacgagtccgtcagagtgcagattttatgcctaggtggcaaatgctgcgcgtcttagaagaggaactgggtcgggattggcaggcaaaagtcgcctctctcgaggaagtccccttcgccgcagcctcgattggacaggtgcatcaagggctcctgcgggacggcacggaggtcgcggtcaagattcagtacccaggcatagcgcagtctattcaaagcgatgtgcagaacctgttggccgtgttgaagatgtctgccgccttaccggcaggcttgttcgccgagcagtccctccaagcattgcagcaggaactcgcatgggagtgcgattacaggcgggaggccgcttgtgctcaaaactttagacagcttctggcaaatgaccctttctttcgcgtccctgcagtcgtgaaagaactttgcaccactcgggtgcttggtatggagttagcggggggagtgcccctggaccagtgccagggcttgagccaagacctgcgcaaccagatctgcttccaactgctcactctgtgcttaagggagctgttcgagtttaggtttatgcaaactgacccaaactgggccaacttcttgtacgacgccagctcccaccaggtcacgctattagactttggggccagcagagagtttggcaccgagtttacagaccactacatcgaagtcgtcaaagcagcagcagatggtgaccgggattgtgtattgcagaagtcccgagacctcaagttcctgaccggatttgagaccaaggccttcagcgatgcacacgtggaagccgtgatgattcttggggaaccttttgctacgcagggcccctatgactttgggtctggggagactgcgagaagaatccaggacttgattcccgtactgctcagacataggctctgcccccctccagaggagacgtatgccctgcatcgcaaattagctggggctttcctcgcttgtgctcacttgcgcgcacacatagcctgtcgcgacctttttcaggatacttatcacagatactgggcgtccagacagcccgatgccgcaaccgcagggagcctaccgactaagggcgattcatgggtggacccgtcatag

SEQ ID NO: 24179 - DNA, 1512 bp, Artificial Sequence
  Description of Artificial Sequence: Synthetic coding sequence
atgtggctcaaggtgggcggtctgttgcgcggcacgggcggccaactaggacagacagttgggtggccctgcggggccttaggtcccggtccccaccgctggggaccatgcggaggctcttgggctcagaagttctaccaggatggcccgggtagaggtctcggtgaggaggacattagacgggccagggaggctaggcctcgcaaaaccccccggccccagttgtcggaccgctctagagaaagaaaagtgcccgctagccgcatatctcggctcgccaatttcggggggctagctgtcggattaggactgggggtacttgctgagatggccaaaaagtccatgccgggaggtcgcctgcaatccgataatagtttcatttctccacagttacagcatattttcgagagagtccgccagagtgccgacttcatgcccaggtggcaaatgctgcgagttctcgaggaagaactgggtcgggactggcaagccaaggtcgcatccttagaggaggtcccttttgcggccgcttccatcggacaagttcaccagggacttctgagggacggcacagaagtagcggttaagatacagtacccgggaattgcgcaaagcatccaaagcgacgttcagaatctcctcgccgtgctgaaaatgtcagccgcccttcctgcgggcttattcgccgaacaaagtttacaggctctgcaacaggagttggcttgggagtgcgattatagacgcgaggctgcttgcgcccagaactttcggcagctgttagctaacgatccattttttcgggtgcctgcggtcgtgaaagaactctgtacgactagggtcctcggcatggagctcgcgggaggcgtccctcttgaccagtgccagggtctatctcaagacctaaggaaccagatctgctttcagttgctgacactgtgcctgcgcgagctctttgaattccggttcatgcaaaccgatcccaattgggcgaattttctgtacgacgcaagttcacatcaggtcactctacttgatttcggcgccagccgggagttcggcaccgaattcacagaccactacattgaagtcgtcaaggctgccgctgatggggatagggactgcgttcttcagaaatcacgcgatctgaagtttttgaccgggtttgagacaaaagcttttagcgacgcccacgtcgaggcagtgatgatcctaggggaacctttcgccacacaaggtccatatgactttggttccggtgagaccgcaaggcggatccaggaccttatccctgtgttgctgagacacaggttgtgcccaccgccagaggagacatacgctctacatcgcaaactggccggggctttcctagcctgtgcccaccttagggctcacattgcatgtagggacctttttcaggatacatatcaccgctactgggcatcaaggcagccagatgcggcgaccgcagggtcattacctactaagggtgactcatgggttgacccctcttag

SEQ ID NO: 24180 - DNA, 1743 bp, Artificial Sequence
  Description of Artificial Sequence: Synthetic coding sequence
atgtggagaccagtgcagctctgccactttcactctgcactgctgcataggagacagaaaccttggccttctccagcagtctttttccgccgaaatgtacggggtctgcccccaagatttagctcaccaacccctttgtggaggaaggtcctttccactgccgtggtgggggcacctctactgttaggcgcgcggtacgtgatggcagaggcgagggagaagaggcgcatgcggctggttgttgacggaatgggcaggttcgggcggtctctgaaagttgggttgcagatctcgctcgactactggtggtgcaccaacgtggtcctccgaggcgtggaggagaactctccaggatacctggaggtaatgtctgcctgccatcagagggccgcagatgccctggtagccggcgccatctcaaacggcgggttatacgtcaagctggggcagggactgtgtagttttaatcacttgctgcccccagaatacacacggacacttagagtgctggaggatcgggccttaaagcggggctttcaagaagtggacgaactgtttttggaggacttccaggcccttccccacgagttattccaggaattcgattatcaaccaatcgccgctgcctcgctggctcaggtccaccgcgcaaagctgcacgacggaacttcagtagcggtgaaggtgcagtatatcgatctaagggatcgattcgatggggacatccataccctggagctactgctgaggctggtagaagtgatgcaccctagctttggcttttcttgggttttacaggatctcaagggaaccttagctcaagaactggattttgaaaacgaggggcggaacgcagagaggtgcgcaagggaattagcccacttcccgtacgttgttgtgccccgcgttcactgggacaagtcctccaagagggtcctgacagccgatttctgcgccggatgtaaggtaaacgatgtcgaggctatcaggtcacagggcctagctgtccacgacattgccgagaaactgatcaaggccttcgccgagcaaatcttctatactgggtttattcacagtgacccccatcctggcaatgtgctggttcggaaggggcctgacgggaaagctgaactggttctgctggaccacgggttgtatcagttcctggaggagaaggatagagccgccttgtgccagctttggcgcgccatcatactgcgggacgatgcagccatgcgggcacacgcagctgccctgggtgtgcaggactatttgttatttgctgagatgctgatgcagcgccctgtcagactgggacagctgtgggggtctcacctgctctcccgggaggaggctgcatatatggtggacatggctcgagaacggttcgaggccgtgatggccgtactccgggaactgcctcggcctatgctgctcgtgttgcggaacattaataccgtacgcgctatcaacgtagctttgggagcccctgtggacagatatttcctcatggcaaagcgagcggttagaggttggagtcgcctagcaggggccacataccgcggcgtttatggaacaagcctcttaagacacgccaaagtggtctgggagatgctgaaatttgaggtggctctgcgtctcgaaacactggccatgcggctgaccgcgttgctagccagagctctggtacacttgagtctggtaccccccgcagaagaactctaccaatacttagaaacctag

SEQ ID NO: 24181 - DNA, 921 bp, Artificial Sequence
  Description of Artificial Sequence: Synthetic coding sequence
atggccgtcgccaggctggctgctgtagctgcttgggtgccctgcaggagctggggctgggctgcggtccccttcggccctcatcggggtctgtccgttttacttgcccgcattccccaacgcgctccgcgctggctgccagcatgtcggcagaagaccagcctgtcattcttgaaccgtcctgacctgcccaatttggcctacaagaagttaaagggtaaatctcctggtattatctttatacccggctacctgtcctatatgaatggaaccaaagccctggccatagaggagttctgtaagtccttaggacacgcctgtatccggttcgactatagtggtgtcggatccagtgacggaaatagcgaggaaagcactctcggaaagtggcgtaaggatgtgcttagcattatcgacgaccttgccgatggcccccagatcctcgtcgggtcatctctcgggggctggttgatgctgcacgcagctatagctaggcccgagaaagtcgtagctctaatcggagtcgccactgcagccgatacccttgtgacgaaattcaaccaactccccgtggagttgaagaaagaagtggaaatgaaaggtgtctggagcatgccctccaagtacagtgaagaaggggtgtacaacgtccagtattcctttattaaagaggccgagcatcattgtctgttgcactcccccatcccagtcaactgccctattcggctgctgcacggaatgaaagacgacattgttccatggcacactagcatgcaggtcgccgaccgggtgctgagcactgatgtggatgtcatcctgcggaagcatagcgatcataggatgagggaaaaggcagacattcagctgctcgtgtatacaatagatgacctaatcgataaactcagcaccattgttaactag

SEQ ID NO: 24182 - DNA, 450 bp, Artificial Sequence
  Description of Artificial Sequence: Synthetic coding sequence
atgctgcatgcagctatcgcacgacctgagaaagtggtcgccctcataggggtggctactgccgcggacaccctggtgactaagtttaatcagctgcctgtggaactcaagaaagaggtagagatgaaaggggtatggtcgatgcccagcaagtactctgaagagggggtgtacaacgtgcaatatagcttcattaaagaagcagagcatcattgtcttctccactcgccaattcccgtaaattgcccgatcagactgctgcacggaatgaaagacgatatagtgccctggcacaccagcatgcaggtggctgacagggtgctgtccactgatgttgacgttatactgagaaagcactccgatcatcgaatgagagagaaagccgatattcaactgctggtgtatacgatcgatgatctgattgacaagttgagtactattgtgaactag

SEQ ID NO: 24183 - DNA, 1407 bp, Artificial Sequence
  Description of Artificial Sequence: Synthetic coding sequence
atggccgcgtccagcaatagttcacttagcggttccagtgtgtctagcgacgctgaggaataccagccgccgatttggaaatcctacctttaccagctgcagcaggaggcccctaggccgaaaagaattatttgcccgagagaggtggaaaaccggcccaagtattatgggcgtgagtttcatggcatcatctctcgtgaacaagccgacgagctcctgggcggagttgagggtgcatacatcctgcgcgagtcccagcggcagcccggttgctatacccttgcattacggttcgggaatcagacactcaactaccgcctcttccacgatgggaaacattttgtgggagaaaaacggtttgaaagcattcacgatcttgtgaccgacggactcattactctctatatcgagaccaaagctgccgagtacatctccaaaatgacaaccaatccgatctatgagcacatcgggtacgctactttgttgagagaaaaggtgtctcgccgtctctctcgatcgaaaaatgagcctaggaaaaccaatgtaactcacgaagaacatactgctgtcgaaaaaatcagttccctggttcgaagggcagctttgactcataacgataaccacttcaactatgagaagacgcataatttcaaggtgcacaccttccgcggaccacattggtgtgaatactgcgcaaatttcatgtggggcctgattgcacagggcgtccgctgcagtgattgcggtctcaatgtgcataagcagtgttccaaacatgtgcccaacgactgccagccagacttgaaacggattaaaaaagtgtattgctgcgacctgacgacgcttgtaaaagcccacaacacacagcgaccgatggtggtggatatttgcatccgggagatagaggcgcgcgggctgaagtctgagggactatacagggtctccgggttcaccgagcatatcgaagatgtgaaaatggcattcgatcgagatggagaaaaagcagatatctcagccaacgtctatcccgatataaatatcatcactggcgctttaaagctatattttcgggacctccctatcccagtcattacctacgacacatactcaaagttcattgatgctgccaagatctccaatgctgatgaacgccttgaagcagttcatgaggtcttgatgcttcttcctccagcccattatgaaaccctacgatatctcatgatccacctgaagaaagtcacgatgaacgagaaggacaactttatgaacgctgaaaatctcggaattgttttcggaccgacgctcatgcggccgcctgaggactcaactcttaccaccttgcacgacatgcgataccaaaagctgatagtgcaaattctgatagaaaacgaggacgtccttttctag

SEQ ID NO: 24184 - DNA, 438 bp, Artificial Sequence
  Description of Artificial Sequence: Synthetic coding sequence
atgagggctgggcagcagctggcgtcaatgttgcgctggactagggcttggagacttccacgggaggggttgggcccgcacggtcctagctttgcacgagtgcccgtggccccttcaagctcaagcggcggacgaggcggcgcagaacctaggctgttggatggcgaagctgctcttccggccgtggtgtttctccatggcctgtttggctctaagacgaatttcaactcaatagccaaaatattggcccagcaaacagggagaagagtgttgactgtcgatgcaaggaaccatggtgattcaccgcattctccggatatgtcttatgagatcatgtcacaagacttacagcctgctcctcacctggggaccgagggcctgaggcaggccctatgcgggcacgaagtgctgcagggctggtctgacctgcggctgtag

SEQ ID NO: 24185 - DNA, 777 bp, Artificial Sequence
  Description of Artificial Sequence: Synthetic coding sequence
atgagggccgggcaacaacttgcttctatgcttcgatggactagggcctggaggttgcccagggaggggctgggcccccacggaccttctttcgctcgcgtgccagtggccccctctagctcctccggcggccgggggggagctgaaccccgacctctccccctctcctatcggctgctggatggggaggccgccttgcccgcggttgtgttcctccacggccttttcggatccaagacaaacttcaactccatagccaagatattagcccagcaaacaggacggagggtcctgacagtagacgccagaaatcacggtgacagcccacacagccccgacatgtcatatgagataatgtctcaggatctgcaggacctgctgccgcaactgggattagtgccgtgtgtcgtcgtcggccatagcatggggggaaagacagccatgcttctcgcactgcagcgcgacatggctgtaaggcagcatctactgacaaacctggtggaggtggatgggagatttgtgtggagggtcaacctcgacgcactaacacagcacttggacaagatcttagcatttccacagagacaggagagttacctcggacctactctgtttctactggggggaaattcccagtttgtccatccaagtcaccaccctgaaatcatgcgcctgttccccagagcccagatgcaaaccgtgcctaatgccggtcactggatccacgcagatcggcctcaggattttattgctgcaattagagggtttctcgtgtag

SEQ ID NO: 24186 - DNA, 927 bp, Artificial Sequence
  Description of Artificial Sequence: Synthetic coding sequence
atgagagcaggacagcaactcgcttctatgttgcgctggactcgggcttggcgtctgcctcgagagggtctcggcccacacggaccatctttcgcccgcgtgcctgtggcccctagctcatccagtggaggacgaggcggcgcggagccccgcctgctggacggagaggctgctctaccagccgtggtctttcttcatggactgtttggaagcaagacgaactttaattcaatagcaaaaatcctggcccaacagacgggcagacgggttttaactgtagacgcgcgaaaccacggcgatagtccccatagcccggacatgagttacgagatcatgtcacaggatcttcaggacctcttacctcagctagggctagtcccctgcgtggtggtgggtcattcgatgggtggcaaaacagctatgcttttggctttacaacggcctgagttggtagaaagattaattgccgtggatatctcccctgtggaaagcaccggtgtgtctcacttcgcaacatatgttgccgccatgcgggcaattaacattgctgacgagctgccgcgatcgcgggccagaaaactggcagatgaacagctgtctagtgtgatacaggacatggccgtgaggcaacacctcctaacaaatcttgtggaggttgacggaagattcgtgtggagagtgaatcttgacgcgttgacccaacatctggataaaattctggcgtttccacaacggcaggaatcttatctgggccctacactttttctgttgggtgggaactcgcaatttgtccacccaagccaccaccctgaaattatgcggctctttcctcgagctcagatgcagacagtccctaatgctggccattggatacatgcggataggccacaggatttcatcgcagcgattcgaggattcttagtgtag

SEQ ID NO: 24187 - DNA, 1014 bp, Artificial Sequence
  Description of Artificial Sequence: Synthetic coding sequence
atggaaaagagttggatgctttggaatttcgtagagcgttggctaatagctctggcttcatggagctgggccctctgccggattagcctgctgccgctgattgtgacgtttcacttgtatggcggcatcatcctgctgctcctaatcttcatttcaatcgctggcatcctgtataagttccaggatgtactcctatacttccccgagcaaccgagcagttccaggctttacgtcccaatgcccactggaatcccccacgagaatatcttcatacgcacaaaagacggcattaggctcaatctcatcctgatacggtacaccggggacaacagcccatactctcctaccattatctatttccacggcaacgctgggaatattggacataggctgccaaatgcactcctaatgctcgtgaacttaaaggttaacctgctcctagttgactatcgcggctatggcaagtcagagggcgaagccagtgaggagggactttacctggattccgaggcagttttagattacgtgatgacgcggcccgacctggacaagacaaaaatctttctttttggtcgctccctggggggggccgtggccatacacctggcaagcgagaacagccacaggattagtgctattatggtggagaacacctttctatccattccccacatggcctcgaccctctttagctttttccccatgagatatctacccctatggtgctataagaacaaatttctctcttaccgaaaaataagtcagtgcagaatgcctagtttatttattagtggcttgagcgaccaattgatccctccagtgatgatgaaacagttgtatgaactgagccctagtaggaccaagcgcctcgctatcttccctgacgggactcacaatgatacctggcagtgccagggctacttcaccgccctagagcagttcatcaaggaggttgtgaaaagtcacagccccgaagagatggccaaaaccagtagcaacgtgaccatcatttag

SEQ ID NO: 24188 - DNA, 816 bp, Artificial Sequence
  Description of Artificial Sequence: Synthetic coding sequence
atggtgggtgccctgtgtggctgttggtttcgactgggcggggccagaccactgattcctcttgggcccacagtggtccagaccagcatgtcgcggagccaggtcgccttgttaggtctatctctgttactcatgctcctgctgtatgtggggctccccgggcctcctgagcagactagttgcctgtggggggatcccaatgtgaccgtgctggcaggtcttactccagggaacagtccaattttttaccgcgaagttctgccactgaaccaggcccatcgagtcgaggtggtgctgttgcacggaaaggccttcaactcgcacacttgggagcaattgggaacgctgcagctgctgagccagcgaggatacagggcggtggccctagacctacccgggttcggcaattccgccccttcgaaagaagcgtctacggaggccggccgcgcagccttactggagcgcgccctccgagatctcgaggttcaaaacgctgtactagttagcccctcccttagcggccattacgcccttccgtttttgatgcggggccaccatcagctgcacgggttcgtgcctatcgcgcccacctctacgcagaattacacgcaggagcagttttgggcggtgaaaacccccacattgatcctgtacggcgaacttgaccacattctggctcgggagtccctaaggcagctgcggcacctgcctaaccattccgtcgtcaaactcagaaacgccgggcacgcctgttatcttcacaagccacaggatttccaccttgtacttctggcattcttagaccatttgccttag

SEQ ID NO: 24189 - DNA, 690 bp, Artificial Sequence
  Description of Artificial Sequence: Synthetic coding sequence
atgctgttactgtatgtgggcttgcccggccctcccgagcagactagctgtctgtggggcgatcctaacgtgactgtattagcaggcctcacaccagggaatagtcccatcttttatcgcgaagtgctgccactgaatcaggcgcaccgcgtggaagtggtactcttgcatggcaaggccttcaattcacatacatgggaacaactggggacacttcagttgctgtcccagaggggatatagggctgtggccttagacctgcccgttccaggtagctctaacagccctgcttcagctagtcccgtcgcagaaatcactgagaactccttctgggccgttttagtgcgcgacctggaagttcagaacgccgttttggtctctcccagtttatccggccactacgctctgcccttcttgatgagggggcaccaccaactacacggatttgtcccaatcgctccaaccagcacccagaattatacccaggagcagttctgggcggtaaagaccccgactctgattttgtacggcgagttggatcatattttggcccgtgaatctctcaggcagctccggcacctgcctaaccacagtgttgtaaaactgagaaacgccgggcacgcttgctacctacataagccccaggactttcatctggtgctactggcctttcttgaccatttgccttag

SEQ ID NO: 24190 - DNA, 618 bp, Artificial Sequence
  Description of Artificial Sequence: Synthetic coding sequence
atgctcctgctgtacgtggggcttcccgggccacccgagcagacatcctgtctgtggggggatcccaatgtaacagtcctcgctggactcaccccagggaattctccgattttttaccgggaggtgctgcccctgaaccaagcccaccgcgttgaggtagttctgctgcacggcaaggccttcaactctcacacttgggagcagctcgggactcttcagttgctatcacaaagggggtatcgagcagttgccttagatctacctgttcccggctcctccaactcccctgcatccgcctctcctgtggctgaaataaccggattcgtattcttaatgtgcgcgtcagcttccggaccgcagctgttcccacccttgtggccaatcgcacccaccagtacacagaattatactcaagagcagttttgggcggtgaagacacccaccctgatcttgtatggggagcttgaccacatcctggcgagggagagcctgcgccaactgcgacacctgccaaatcacagtgtggtgaagttgaggaatgccggacacgcctgttatctgcacaagccccaagattttcacctggtgcttctcgcgtttttggatcatctgccatag

SEQ ID NO: 24191 - DNA, 465 bp, Artificial Sequence
  Description of Artificial Sequence: Synthetic coding sequence
atgctgctgctgtacgtcggtcttcccggtccaccagagcagacttcttgcctgtggggcgaccccaacgtgacagttttggcagggttgacacccgggaacagcccaatattttaccgtgaagtcttgcctttgaaccaggcccacagagtcgaagtggttctgctgcacggaaaggcttttaattcacatacatgggaacaactgggcaccctccagctacttagtcagcggggatatagggcagtggcactagacctgccagtgctaggatttggcaatagcgcccctagtaaggaagcttcaaccgaggctggtcgtgccgccctcctggaaagggctctgcgggatctcgaagtgcagaatgccgtactagtgtcccctagccttagcggtcactatgctcttccattcctgatgaggggacaccatcagctgcacggctttgtgcccattgccccatag

SEQ ID NO: 24192 - DNA, 1014 bp, Artificial Sequence
  Description of Artificial Sequence: Synthetic coding sequence
atggaccttgacgttgtgaacatgtttgtgatcgctggcggaaccctggccattcctattctggcgttcgtcgccagttttctcctgtggccctcagccctgattcgaatctattactggtactggcggaggaccctcgggatgcaagtgaggtacgtacatcacgaggattaccaattttgttacagcttcagggggcgccctggacacaagccaagcatcctcatgctccacggtttttctgcccataaggacatgtggctgtctgttgttaagttcctacctaaaaacctccacttggtttgcgtagacatgcccggccacgaggggactacccggtccagcttggatgacctgagcattgacggacaagtcaagagaattcatcagtttgtggaatgcttaaaacttaacaaaaaacctttccatctggtagggacatcgatggggggacaggtagctggcgtgtatgcggcttactacccatccgacgtctcaagtctgtgtctagtatgtcctgcaggcctacagtatagcactgataatcagtttgtgcagcgtctgaaggaactgcagggaagcgccgccgttgaaaagatccctctgattccaagtacacctgaagaaatgagcgagatgcttcagctgtgctcatacgtccgcttcaaggtgccgcagcagatcctgcaggggcttgtagatgttcggatccctcacaacaacttctatcgcaagctttttctggagatcgtctctgaaaaaagtagatactccctccaccaaaacatggacaagattaaggttccgactcagatcatttgggggaagcaggatcaggttctcgacgtgtccggagccgatatgctcgccaagtctattgccaactgccaggtcgaactactggaaaattgcggacattctgtggtcatggagcgcccgagaaaaaccgctaagttaattattgattttttagcttcagtccataacactgataataataaaaagcttgactag

SEQ ID NO: 24193 - DNA, 678 bp, Artificial Sequence
  Description of Artificial Sequence: Synthetic coding sequence
atggatttagacgtggtgaacatgttcgtgatcgccgggggcaccctcgccattcccatattggcctttgttgcatctttcctgctctggcctagtgcactcatccgcatttattattggtactggcggaggacacttggcatgcaggttcggtacgtccatcacgaggattaccagttttgttattccttcaggggacgacccggacacaagccgagtatcctgatgctgcacggattctctgcacacaaggacatgtggttgtccgtggtgaaattcctgccaaagaatcttcacctggtgtgcgtcgacatgcctggtcacgaaggcacgacccgaagctcactggacgatctgtcaatagatggacaggtgaaaaggatacatcagtttgttgagtgcctgaaactcaacaaaaagccatttcatctggtaggaacatctatgggaggccaggtggccggggtgtacgctgcctactatcccagcgatgtctcctcgctctgcctcgtgtgcccagccgggctgcagtacagcactgataaccagttcgtgcagcggcttaaggaactgcagggtagtgcagccgtcgagaagattcccctcatccccagtacacccgaggaaatgtccgaaatgctccagttgtgttcctatgtaaggttcaaagttccctag

SEQ ID NO: 24194 - DNA, 1014 bp, Artificial Sequence
  Description of Artificial Sequence: Synthetic coding sequence
atggatctggatgtggtgaatatgtttgtgatcgcaggtggcacattagcgattcctattctggcatttgtcgcatcctttcttctttggcctagcgcgttgattcgtatttattactggtattggcgtagaacactgggcatgcaagtgaggtacgtgcatcacgaggattaccagttttgctattcttttcgaggtagacccggacataagccatctattctgatgctacacggcttctccgcacacaaagatatgtggctgtcggttgttaagtttctgccaaagaatttacatctggtctgcgtggacatgcccgggcatgaggggactactaggtcgagtctggacgacctgtccattgatgggcaggttaaaaggatccaccagtttgtagagtgcctgaagctaaacaagaagccatttcacttagttggcacttctatgggcggccaggtggcaggagtgtacgcggcctactacccttccgatgtgtcatcactttgtctggtctgccccgctggcctccagtacagcactgataatcagttcgtccagagactgaaagagctgcaaggatctgcggcagtcgagaagatccctctgattcccagcactcccgaggaaatgagtgaaatgctgcagctgtgttcctatgtgaggtttaaagtgccccagcaaattctacaggggctcgttgatgtacgaatccctcataataatttttataggaagctatttttggaaattgtcagtgaaaaatctaggtactctctgcaccagaatatggataagattaaggtaccaactcagatcatttggggtaagcaggaccaggtgctggatgtgagcggagctgatatgttagctaaatccatcgcaaattgtcaagttgaactgttagagaactgtgggcatagcgtggtcatggaacgtccccgaaagacagcaaagcttataatcgatttcttagcgagcgtgcacaacacagacaataacaagaagcttgactag

SEQ ID NO: 24195 - DNA, 522 bp, Artificial Sequence
  Description of Artificial Sequence: Synthetic coding sequence
atggacctggacgttgtaaatatgttcgtcatcgctggtggaactttagccattcctatattggctttcgtggctagcttcctgctatggcccagtgcccttattaggatttattactggtattggcggagaacgctaggcatgcaggtccgatacgtgcaccatgaagactaccagttttgctactccttccgaggaagaccgggccataaaccaagcattttgatgctgcacggcttctcagcccataaggatatgtggttatcagttgttaagttcctgcccaaaaacttacacctggtttgcgtcgatatgcccgggcatgagggcactacccgttcttcactggatgatctgagtatagatgggcaggtgaagcggattcatcagttcgtagaatgcttgaaattaaacaagaaaccttttcacttggtgggtactagcatgggcgggcaagtggccggggtctatgctgcctattatccaagcgacgtgtccagcctctgcctggtttgtccgtag

SEQ ID NO: 24196 - DNA, 957 bp, Artificial Sequence
  Description of Artificial Sequence: Synthetic coding sequence
atggacctggacgttgtcaatatgtttgtgatcgccgggggcactctggcaatccctatccttgcattcgttgcatcctttcttctgtggccatcggctctgattagaatctactactggtattggaggcgcacacttggaatgcaggtgcgctacgtgcaccacgaggattatcaattctgctatagctttagggggagaccggggcataaaccctcaattttaatgctgcatggctttagcgcccataaagatatgtggctttcagtcgtgaagttcctccccaagaacctgcacctggtgtgcgtcgatatgccaggtcatgaaggcacgacgcgctccagccttgatgacctttcaatcgacgggcaggtaaagagaatacaccaattcgtggaatgcctaaaactgaataagaagccttttcatctggtgggtaccagtatgggtggccaggtggcaggagtgtatgctgcgtactacccttcagacgtatcctctctgtgtctggtgtgccccgcagggctccaatacagtacagataatcagttcgtgcagcgcctaaaggagcttcaggggagcgccgccgtcgaaaagattccactcatcccaagcacccccgaagaaatgtccgagatgctccagttgtgttcatacgtccgattcaaggtgccccaacagatactccagggactggtggacgttagaatacctcacaataacttctaccggaagctattcctggagatcgtgtcagaaaagtcccgatatagcttgcaccagaacatggataaaattaaggttccaacccaaatcatttggggcaagcaagaccaagttctggatgtgagcggcgccgacgtaggccaggtgaattgccagctgccgggaggcgccagtggtaagttgtgggccctctcctctgacggtaaaccaggccgacagccctcctcttag

SEQ ID NO: 24197 - DNA, 1194 bp, Artificial Sequence
  Description of Artificial Sequence: Synthetic coding sequence
atggctctacttagaggtgtattcgtggtcgccgccaaacgaacacccttcggggcatatggcggcttgctgaaagatttcacagctacagacctaagtgaatttgccgctaaggccgccctgtccgcaggcaaggtctcaccagagactgtggatagcgtgatcatgggaaacgtactacaatcttcctccgacgctatttatttagccagacacgttgggttgcgcgtgggtattcctaaagaaacacccgcattgaccataaacagactatgtggtagcggttttcaatcaattgtcaatggatgccaggagatttgcgtgaaggaggctgaagtcgtgttatgtggcggaacagagagcatgagtcaggcgccttactgtgtgaggaacgtgcgcttcgggacaaaattagggtcagatatcaagctcgaagacagtctctgggtgtctctgacagaccaacacgtacagctgccaatggcgatgacggccgaaaacttggcagtgaaacataagattagccgcgaggaatgtgacaagtatgccctgcagagccagcagaggtggaaggctgctaacgacgccggatactttaacgacgaaatggctccgatcgaggtgaaaactaaaaagggcaagcagacaatgcaggtcgatgaacatgccaggccgcagaccaccctggagcagctgcagaaactacccccggtgttcaagaaggatgggaccgttactgccggaaacgcgtcgggcgtggccgatggggccggggccgtgattatagcatccgaggacgctgtgaaaaaacacaatttcacacctctggctcgaatcgtaggctattttgtctctggatgcgatcctagcatcatgggaattgggccggtacccgctatcagtggtgcgttaaaaaaggctggactgtctctcaaggacatggacctggtggaggtaaacgaggcattcgctcctcaataccttgccgtcgaacgaagcttagacttggacatttcaaagaccaatgtgaatgggggcgcaattgcactgggacacccacttgggggctccggaagtcgcattacggctcatttggtgcatgaactgcggagacggggcggcaagtacgccgtcggttcggcgtgtatcggcgggggccagggcattgccgtcattatccaaagtaccgcctag

SEQ ID NO: 24198 - DNA, 378 bp, Artificial Sequence
  Description of Artificial Sequence: Synthetic coding sequence
atgcccggacggcacgtgagtagagttagggccttgtataagagagtgctgcaactacaccgggtcctgccacccgatttaaagtccttgggcgatcagtacgtgaaagacgagttccgccgtcataaaacggtaggcagcgatgaagcccagagattcctgcaagagtgggaggtgtacgcgaccgcattgcttcagcaggcgaatgaaaatagacagaacagtactggaaaggcctgctttggtactttcctaccagaagagaagctgaacgatttcagggatgagcaaatcggccagctccaggagcttatgcaggaggctacaaaaccaaatcgacaattttccatttcggagtccatgaagcccaagttttag

SEQ ID NO: 24199 - DNA, 1605 bp, Artificial Sequence
  Description of Artificial Sequence: Synthetic coding sequence
atgttccagttccacgctggctcttgggagagttggtgctgttgctgccttatccccgccgaccggccatgggaccgtggacagcattggcagctggaaatggccgacacccggtccgtgcacgaaacccgcttcgaagcagcagtcaaggtgatccagagcctccctaaaaatggctccttccagccgactaatgaaatgatgttaaaattttactccttctataaacaggcgacagaaggcccctgtaaactcagtcggccaggcttctgggatcctatcggaaggtacaaatgggacgcatggagttctctcggagatatgacaaaagaggaagcaatgatagcctatgtggaggagatgaagaagataattgagactatgcctatgactgagaaagtggaggaactgctgagggttattggtccattttacgagattgtggaagacaagaaatctggacggtcgtcagatatcaccagcgtccgacttgagaagatatctaaatgcctcgaggatctcggcaacgtactgacgtctactccgaatgcgaagacagtaaacggaaaggccgagtcctccgattctggggccgaatctgaggaagaggaagcccaggaagaagtgaagggcgccgaacagagcgacaatgataagaaaatgatgaaaaaatcagccgaccacaagaatctggaggtcatcgtgacgaatggctacgacaaggacggattcgtccaggacatccagaacgatatccatgcctcctctagcttaaatggaagatccacagaggaagtcaagccaatcgatgagaatttaggccagactgggaaatcagctgtatgcatccatcaagacatcaacgatgatcacgtcgaagacgttaccggcattcagcacttgaccagtgattcagattcagaagtctattgcgatagtatggagcaattcggccaagaggagtcgctcgactccttcactagcaataatggtccctttcagtattatttgggtggtcattcctcacagcccatggaaaactccggattcagagaggatatacaagtgccccccggcaatggaaacattggaaacatgcaggtcgtcgctgtggagggcaaaggtgaagtgaaacacggcggggaagacggacgcaataacagtggggctcctcaccgggagaagaggggtggcgaaactgacgagttctcaaatgtccgtaggggaagagggcaccgcatgcagcatctttccgagggtaccaaggggaggcaggtcggtagtggcggcgatggcgaaagatggggaagcgataggggttcgagaggttcactcaatgagcaaatcgcgctggtactgatgaggttgcaggaggacatgcagaatgtcctgcaacgactccagaagctggagacactgactgccctgcaagcgaaaagcagcacttctacactgcagacggctccccagcctacatcccagcgccccagttggtggccattcgaaatgtctccaggagtcctgacctttgcaattatctggccattcatcgcccaatggctggtttatctttactatcagcggagaaggagaaagctcaattag

SEQ ID NO: 24200 - DNA, 1596 bp, Artificial Sequence
  Description of Artificial Sequence: Synthetic coding sequence
tttcacgccggctcttgggaaagctggtgctgttgttgcctgatcccagccgatcgcccctgggacaggggacagcattggcaactcgaaatggcagatacacgctcagttcacgaaacacggttcgaggccgctgtgaaagttattcaaagtctgcctaagaacggtagttttcagccgactaatgagatgatgctgaagttttactctttctacaaacaggccaccgaaggtccctgcaaactctcccgccccggtttctgggaccccattggccgatacaaatgggatgcatggtccagcctgggagacatgactaaggaggaggcaatgatcgcttacgtcgaggagatgaagaagattattgagactatgcctatgactgaaaaggtcgaggaactcctgcgagtgatcgggcccttttacgagatcgtggaagataagaagtccggtcgctcaagcgacatcacctctgtaaggctggagaagatctccaagtgtctcgaagacctcggcaacgtgttgacaagtacgccaaacgcaaagaccgtgaacggtaaggccgaatcctctgacagcggcgctgagagtgaagaggaagaggcgcaggaggaggtcaagggggcagaacagtcagacaacgacaagaaaatgatgaagaaatctgctgatcacaaaaacctggaggtgatagtcacaaacggatacgataaggatgggttcgtgcaagatattcaaaacgacatccatgcctcttcatccttaaacgggcggagcacagaggaagtcaaaccaattgatgaaaacctcggtcagacggggaagagcgctgtttgcattcaccaggacatcaatgatgaccatgtcgaagacgtgactggaatccagcacttgacctctgactctgactcagaggtatattgtgactccatggaacagtttggtcaggaggagagtctagactctttcacgtccaacaatggcccctttcaatattaccttggcggccactcgtcccagcccatggaaaattcagggttccgcgaagatatccaggttccccctggaaatggaaacatcggtaacatgcaggtggtcgcggttgaagggaaaggggaggtgaagcatggtggcgaagatggtcggaacaatagcggggccccacacagagaaaagcgaggtggggagacagacgaattcagtaatgtaagacggggaaggggccacaggatgcagcacctcagcgagggtactaagggtcgccaagtcggcagtggaggcgacggagaaaggtggggaagtgaccgcggttcccggggttctctgaatgagcagatcgccctggtgcttatgcgcctacaggaggacatgcagaatgtgctgcaacggctgcagaaattagaaactctcacagccctccaggcaaagtcatctaccagcacattgcagaccgcgccccagcctactagccaacgtccaagctggtggcccttcgaaatgtccccaggggtattaacctttgccatcatctggccgttcattgctcagtggctggtttatctctattaccaacgacggagacgaaaactgaattag

SEQ ID NO: 24201 - DNA, 1047 bp, Artificial Sequence
  Description of Artificial Sequence: Synthetic coding sequence
atgacgaaagaggaagctatgatagcctatgtggaagagatgaaaaaaataattgagacaatgcccatgaccgaaaaggttgaggaactgctgagggtaatcggccccttttatgagatcgtggaggataagaaaagtggacgaagtagcgacatcacgagtgacctcgggaacgttctgacttcgacacccaacgccaagacagttaacgggaaagcagagagctctgatagcggagccgaatccgaagaggaagaagcccaagaagaggtcaagggagcggaacagtccgataatgatatcaacgatgaccacgtggaggacgttacaggaattcagcatttgacctctgatagcgacagcgaggtatattgcgattcaatggagcagttcggtcaggaggagtctttagactcattcactagtaacaacggaccattccaatactacttggggggccattcctcccaaccaatggagaattccgggttcagggaggatatccaggtcccacccggaaacgggaatattggcaacatgcaagtggtggctgtagaagggaaaggcgaagttaagcatggaggtgaggatgggcggaataactctggcgctccgcatagggagaagcggggtggcgaaactgatgagtttagtaacgtgagacgtggaagaggacataggatgcagcacctgtctgaggggactaaaggtcggcaggtcgggtctggcggcgacggggaaaggtggggcagtgatcggggcagccgtggctcactgaatgaacagatcgccctggtgctcatgagactgcaggaggacatgcagaacgtactgcaaaggctgcaaaaattggagaccctcacagctttacaggccaaaagcagtacttctaccttacagactgcgcctcagcctacgagccagcggccgagttggtggccatttgagatgagtcctggagttctgacctttgcaatcatctggccattcatcgcccagtggttagtctacctgtactatcaacgacgacgtagaaaactcaactag

SEQ ID NO: 24202 - DNA, 1251 bp, Artificial Sequence
  Description of Artificial Sequence: Synthetic coding sequence
atgacaaaagaggaagcaatgatcgcttacgtggaagagatgaaaaaaattatcgaaacaatgccgatgacagagaaggtcgaagagctgctgcgcgttattggcccgttctacgaaattgtcgaggacaaaaaatcaggtcgctcatcagacattacaagcgacttgggtaatgttttaacctctacacccaacgccaaaacagtcaatggtaaggccgagagttctgattctggagcggagtctgaggaagaggaagcgcaggaagaggttaagggcgccgagcagagcgataatgacaagaagatgatgaaaaagtccgctgaccataagaatctcgaggtgatagtgacaaatggctacgacaaggatggttttgtccaggacattcagaacgacattcatgcttcatccagtctcaacgggagatcaaccgaagaagtgaagcctatagatgaaaatttgggacaaacaggcaaatctgcagtgtgcatacaccaggatatcaacgacgaccacgtggaggatgtcacaggtattcagcatttgacctccgactccgattctgaggtatattgcgatagtatggaacagtttggacaggaagaaagcctcgatagcttcacgtcgaataacgggcccttccagtactacctgggcggacactccagccaacccatggaaaattctggatttcgtgaggatatccaggtcccacctggaaacggtaacatcggcaacatgcaggtcgtggccgtagaagggaagggcgaggtgaagcatggtggagaggacggaagaaacaatagcggagctccacaccgtgaaaaacgagggggtgagaccgatgagtttagtaatgtcaggagggggcgcggccacaggatgcagcatctgagtgagggaaccaaaggtaggcaggtaggttctgggggcgacggagaacggtggggcagtgatagaggctccagggggtcccttaacgaacagatcgcactggttctgatgaggctccaagaggatatgcagaatgtgctgcagcgtcttcagaagctcgaaacacttactgccctgcaggctaagtctagcactagtacgcttcagacggccccccagccaactagccagagaccatcgtggtggccgttcgaaatgagccctggcgtcttgacctttgccatcatctggcctttcatcgcgcagtggttggtctacctgtattaccagagacgccggagaaagctcaattag

SEQ ID NO: 24203 - DNA, 1473 bp, Artificial Sequence
  Description of Artificial Sequence: Synthetic coding sequence
atggcagacacgcgatcagtacatgagacgcgatttgaggccgcggtgaaagtgatccagtccctaccgaagaatggcagctttcaaccaacaaatgagatgatgcttaagttctactcattttataagcaggcaacagaggggccttgcaagctttctagacctggtttctgggatcctattggtcgctataagtgggacgcttggagcagtttgggtgatatgactaaggaagaagccatgattgcgtacgtggaagagatgaagaaaatcatcgagacgatgcccatgaccgagaaggttgaggaacttctgagggtgatcgggcctttttacgagatcgtcgaagataagaaaagcgggcggtcctccgatatcactagtgatcttggcaacgtcctcacatctacccctaacgctaagaccgtcaatggtaaagccgaaagttctgactccggagctgagagtgaggaagaagaggcgcaggaagaggtaaagggcgctgaacagagtgacaatgacaaaaaaatgatgaagaaaagcgccgatcacaagaacctcgaagtgattgtgactaatgggtatgacaaggacgggttcgtccaagacattcagaacgacattcacgcctcttctagcttgaatggcagatccactgaagaggtgaagccgatcgacgaaaacctcggtcaaactggcaaaagcgctgtatgtattcaccaggacatcaacgacgatcatgtggaggatgtcacaggcatccaacaccttacttccgacagtgactccgaagtctattgcgacagcatggaacagttcggacaagaggagtcattagactctttcacatcgaataacggaccatttcagtactacctgggcggacactcctcccagccaatggagaacagcggcttccgagaggatatacaagtccctcccggcaatggcaatattggaaacatgcaagtagtcgcagtcgaggggaaaggagaagtgaaacacggtggcgaagatggccggaataattcgggtgcacctcatcgggaaaaaagaggaggtgagacggatgaattctctaatgtgcggcgtggaaggggtcaccgtatgcagcacctcagtgagggtacaaaagggagacaagtcgggagtggaggagatggcgaaagatggggttcggatcggggatcaagaggaagcctcaacgaacagatcgcacttgtactgatgagactccaggaggatatgcaaaatgtgctgcagcgtctccagaagctggaaacactgactgccctgcaggctaaaagttccacaagcacactgcagaccgccccccagccaacgagtcagagaccctcatggtggcccttcgagatgagccccggagtgttaacattcgccatcatttggccctttatagcccagtggttggtttacctctactaccagcgtagacggcggaaactgaattag

SEQ ID NO: 24204 - DNA, 1578 bp, Artificial Sequence
  Description of Artificial Sequence: Synthetic coding sequence
atgctctttcttagtttccatgccggctcttgggagtcttggtgttgttgttgtcttatccctgctgacaggccctgggacagaggccaacattggcagttggagatggccgatacccggtccgttcacgagacgagattcgaggctgccgtcaaggttatccagtccctgccgaagaatggcagctttcagccgacaaacgaaatgatgttgaagttctacagtttttataaacaagccactgaggggccctgcaaactttcacgaccaggattttgggaccctatcggccggtacaagtgggatgcatggagcagtctgggggatatgaccaaagaggaagccatgattgcctacgtcgaagagatgaaaaaaatcatagagacaatgcccatgaccgaaaaagtcgaggaacttttgcgcgtgattgggcccttttatgagatcgtggaggataagaaaagtggtcgcagtagtgacatcacaagcgatctgggaaacgtattaacttcaactcctaacgcaaagaccgtcaacggtaaagctgagtccagcgatagcggagcagagagtgaagaggaagaggcccaggaagaggtcaaaggagcagaacagagcgacaacgacaagaagatgatgaagaaatctgctgaccacaagaacttagaagttatcgtgacaaacgggtacgacaaggacgggttcgttcaggatattcaaaatgatattcatgcatcgagctctctgaacggccgatccaccgaggaagtcaagccaatagacgagaacctagggcaaaccggtaaaagcgccgtttgtattcaccaggacattaacgatgaccacgtcgaggatgttactggaatccagcacctgacctccgacagcgatagcgaggtttactgtgacagcatggagcagttcggacaggaggagtccctcgactcctttacaagcaataacggacccttccagtactatctggggggtcattcaagccaacctatggaaaactctggatttagagaggacatccaggtaccgccagggaacggcaacataggcaacatgcaggtggtggccgtggaaggaaagggtgaggtgaagcatggcggcgaagatggtaggaataactccggagctcctcatcgggagaaacgcggtggcgagactgacgaattcagtaatgtgagaagaggaagaggccaccggatgcagcacctgtcagagggaactaagggccgccaagttgggtcaggcggggacggagagagatggggttcagatagaggttccaggggaagcctgaatgagcagattgcccttgttctcatgagattacaggaagatatgcagaatgtcctccagcgactgcagaaactggaaaccctcactgctttacaggctaagagctctacctccactctgcagactgctccccaaccaacaagccaacggccatcctggtggccctttgaaatgtcgcctggagtccttaccttcgcaataatctggccgtttatagctcagtggttagtttacttgtattaccagagaagaaggagaaaactgaattag

SEQ ID NO: 24205 - DNA, 756 bp, Artificial Sequence
  Description of Artificial Sequence: Synthetic coding sequence
atggctgatacccgctcagtccacgagaccaggtttgaggcggcagtgaaagttatacagtctctgcctaagaatggttccttccaacctacaaacgaaatgatgcttaaattttacagcttctataaacaggcaacggagggcccctgtaaactttctaggcccggcttctgggacccgatcggacggtacaagtgggatgcatggtccagtttaggcgacatgacaaaagaagaggctatgattgcctacgtggaggagatgaaaaagatcatcgaaactatgccaatgacagaaaaggtggaagagctactcagagtgatcggaccattttacgaaatcgtggaagacaaaaaaagcggccggtcaagcgacataacatccgtgaggctggagaagatcagcaagtgcttggaagatctcgggaatgtcctcacgtcaacccctaatgctaaaacagtgaatgggaaggccgaaagctcggattcgggggccgagtccgaggaggaggaagctcaggaggaggtaaagggagccgaacagagcgataacgataagaagatgatgaagaaatccgctgatcacaagaatcttgaagtgatcgtgacaaatgggtacgacaaagacggattcgtgcaagacattcagaacgacattcatgctagctcttcgctgaatggtcgcagcacagaggaagtgaagccaattgacgagaatcttggccagaccggcaaaagcgcagtgtgcatccactag

SEQ ID NO: 24206 - DNA, 885 bp, Artificial Sequence
  Description of Artificial Sequence: Synthetic coding sequence
atgcctggccctccactgtctagcgcccgccatgccttacctcttgggtcctgggaatcttggtgttgttgttgcttgatccctgcagaccgcccatgggatcgcggtcagcactggcagctcgaaatggccgatacaagaagcgttcacgagacgcggtttgaggccgcagtgaaagtcatacagtcgctccccaagaacggcagtttccaacccaccaatgaaatgatgctgaagttttattcgttctataaacaggcaactgagggtccctgcaaactgtcacgaccagggttctgggatccaattggtagatacaagtgggatgcttggtcgtcgcttggggacatgaccaaggaggaggcaatgattgcttacgtcgaagaaatgaagaaaattatcgaaaccatgccgatgactgagaaggtggaggagctgctgcgggttatcggacccttttatgaaatcgttgaggataagaagagtggtcgcagcagcgacatcacttcggtccggctggagaaaatcagtaagtgcctggaggatctgggaaacgttctgacatcgactccaaatgcaaagaccgtaaatggtaaagcggaatcaagcgactccggcgccgagtcggaggaggaagaggcccaggaagaggtcaaaggggccgaacagagcgacaacgataagaaaatgatgaaaaaaagcgccgatcataagaatctcgaagtgatcgtgacaaacggttacgataaggacggatttgtccaagacatacaaaatgacatccacgcctcctcatccctgaacggccgatcaacagaggaggtgaagccaattgatgagaatcttggccagactgggaagagcgcggtgtgcattcaccaatag

SEQ ID NO: 24207 - DNA, 987 bp, Artificial Sequence
  Description of Artificial Sequence: Synthetic coding sequence
atggctcactctaaacaaccatcacacttccagagcctgatgctgctgcaatggcctctgagctatctggccattttttggatccttcagcccctgtttgtgtatctgctcttcacctccttatggcccctaccagtgctctattttgcatggctcttcctcgattggaagactccggagcggggcggtcgtcgtagtgcctgggtcaggaattggtgcgtatggacacacattcgggactatttcccgattactatactgaaaaccaaagatctctcccccgaacacaattacctcatgggggtgcacccacacggattgctgacctttggagccttttgcaacttctgtactgaggctaccgggttttcgaaaacttttccgggcattacgcctcacctggctactttgtcatggttcttcaaaatccctttcgtgagggagtatctcatggcaaaaggggtctgttccgtaagtcaacccgccatcaactatcttttatctcatgggacaggtaatctagttggcatcgtggttggcggcgtaggcgaagctctacagagcgtgcccaacactaccactctgatcctccagaagcgtaagggctttgtacgcacggcgctccagcacggtgcgcacctagtgcctactttcactttcggcgagactgaggtctatgaccaggtcctcttccataaagatagcagaatgtataaatttcagtcttgctttcgacgaatcttcggattttactgctgtgttttttatggacaatccttctgccagggctctacagggctgttaccatactctcgtcccatcgtaaccgtggtcggggaacctttaccactccctcagatcgagaagcccagtcaggagatggttgacaagtaccatgccctgtatatggatgcactgcacaagctcttcgaccagcacaaaactcattacgggtgctcagaaacacagaagctatttttcctctag

SEQ ID NO: 24208 - DNA, 1002 bp, Artificial Sequence
  Description of Artificial Sequence: Synthetic coding sequence
atgttgctgccatctaagaaggacctgaagacagccctggatgttttcgctgtcttccaatggtccttcagcgcactccttatcacaacaacagtgattgctgtgaacctgtaccttgtggtgtttaccccctattggcctgtcacggtgctaatcttaacttggttggcctttgattggaaaacacctcagcgcggcggcaggcgattcacttgcgttaggcactggcggctttggaagcattactccgactacttccccctgaagctgctgaaaacccatgacatatgcccatctagaaactacatcctagtgtgtcatccccatggcttgtttgcgcatggttggttcggccactttgccaccgaagcatccggcttctccaagatctttcctgggatcaccccgtatatcctaacactcggagccttcttttggatgccctttctgcgtgagtacgtgatgtcaaccggagcttgctctgtctctaggtcctccatcgatttcctcctcacacacaaggggactggaaatatggtcatcgtggttattggaggcctggctgaatgtaggtatagccttccggggagcagcaccctcgtgctgaagaaccggtccgggttcgtgcgcatggcgttacagcacggcgtgccgttgatccccgcttacgcttttggcgagacggacttgtacgaccagcacattttcacgcctggcggatttgtgaaccggttccaaaaatggtttcagagcatggttcatatttatccctgtgccttttacgggaggggattcactaagaactcttggggcctcctaccctactctagaccagtgaccacgattgtcggtgaaccattgcctatgcccaagattgagaatcccagtcaagaaatcgttgctaagtatcacacgttgtatattgatgccttgaggaagctgtttgatcagcataagacgaagttcggtatctcggagacacaggaacttgaaataatctag

SEQ ID NO: 24209 - DNA, 2220 bp, Artificial Sequence
  Description of Artificial Sequence: Synthetic coding sequence
atgtttctgcttctagccttgctgacggaattgggccgtctccaggcgcatgagggaagtgaagggatcttcttacatgtcactgtgcccaggaaaattaaaagcaacgattccgaggttagcgagcgtaagatgatctacattatcaccattgacgggcagccctacacactccatctggggaagcaaagttttctgcctcagaatttcctggtgtatacctacaacgagacaggaagcctgcattctgtgagcccatactttatgatgcactgccactaccagggctacgccgccgaatttcctaattcattcgttacgttatccatctgttctgggttaaggggtttcttgcaatttgaaaatatctcctacgggattgagccagtcgaaagttcggcccgatttgaacacattatctaccagatgaaaaacaatgacccgaatgtgtctatcttagccgttaattattctcacatctggcagaaagatcagccctataaagtgcccctgaacagccagatcaagaacttaagcaagcttctccctcaatatctggagatttatattattgtagagaaagcactctacgactatatgggaagcgagatgatggcagtgacccagaaaattgttcaggtaatcggcttggtgaacactatgttcactcagttcaagcttacagtgatactttccagcctggaactgtggtctaatgagaatcagattagtacttctggcgatgctgacgatatactccagagatttcttgcttggaaaagagactacctcattctgaggccccacgacatcgcgtacctgcttgtgtacagaaagcaccctaaatatgtaggcgcgactttcccgggcaccgtttgtaacaagagttacgacgctggcatcgcaatgtaccctgacgccattggcctcgaaggctttagcgtcatcatagcccaattgctggggctgaatgtcggtctaacctacgatgacataacccaatgtttctgcctaagggctacttgcatcatgaaccatgaagccgttagcgcttccggccgaaagatcttttcaaattgtagcatgcatgactacagatatttcgtgtctaagttcgagacaaaatgcctgcagaagctgtccaatctgcagccgcttcaccaaaatcagccagtttgcggaaatggtatacttgaatctaacgaagagtgtgactgtggaaacaaaaacgagtgccaatttaaaaagtgttgtgattataatacctgtaagctgaaagggagcgtaaagtgtggaagcggtccgtgctgcacttctaagtgtgagctgagtattgccggaactccttgcagaaaatctatcgatcctgaatgcgacttcaccgaatactgtaatgggacatccagcaactgcgtacccgatacttatgccttgaacggacgtctgtgtaagttaggaaccgcttactgctacaatggacagtgccagacgaccgataatcagtgtgctaaaatctttgggaagggggcccagggtgccccctttgcttgttttaaggaagtgaatagcctgcacgaacgctctgagaactgcgggttcaaaaactctcagcctttgccctgtgagcggaaagacgttttgtgtggcaagcttgcctgcgtccagccccataagaacgcaaacaaaagcgacgcccagtctacagtgtacagttatatccaggatcatgtatgtgtgtcaatcgctaccgggagctccatgcgatcggacgggaccgacaacgcgtatgtggctgatggaaccatgtgcggcccagaaatgtattgcgtgaataagacatgtaggaaagtccacttgatggggtataactgcaacgccacaaccaaatgtaaggggaaggggatatgtaacaacttcggcaattgtcaatgcttcccgggccaccgtccccccgattgtaaattccagtttggatccccaggcgggtcaatcgatgacggaaatttccaaaaatccggggacttttacacagagaagggctataacacgcattggaacaattggtttatcctttctttttgcatctttttgccgttttttatagtgtttactacagtgatctttaaaaggaacgaaattagcaagtcgtgcaatagggaaaacgctgagtacaatagaaattcatccgtggtttctgaaagcgacgacgtcggtcactag

SEQ ID NO: 24210 - DNA, 2148 bp, Artificial Sequence
  Description of Artificial Sequence: Synthetic coding sequence
atgtttctacttctagctctacttaccgagctgggcaggctccaagctcacgaaggttcagagggaatctttctgcacgtcacagtgcctcggaagatcaagagtaatgactcagaggtctcagaaagaaaaatgatttatattataactatcgacgggcagccctacaccctgcatctgggtaaacagagtttccttcctcagaacttcctcgtgtacacctacaatgaaacaggctctctgcactcggtgtctccttatttcatgatgcactgtcactaccaggggtatgctgccgagttccccaattcatttgtgaccctgtccatttgcagtggattacgcgggtttctacagttcgaaaacatatcatatggaattgaacccgtggaaagctcagcacggtttgagcacattatctaccagatgaagaacaatgaccctaatgtatctattctggccgttaactacagccacatctggcagaaggaccagccatacaaggtgccgctcaatagtcaaataaaaaacctttccaagctgctgccacagtacctggagatttatatcatcgtagagaaagccctaatgttcacacagtttaaacttaccgtcatactctcgagcctggagctgtggtctaatgagaaccagattagcacatctggcgatgccgacgatattctgcagaggtttctcgcctggaaacgcgattatttgattttgcgtcctcacgacattgcctacctgcttgtgtacagaaaacatccaaagtatgtgggagcaaccttcccgggaaccgtctgtaacaagtcgtatgatgccggcattgctatgtatccagacgccattggcctagagggcttctctgtgattatcgctcagctcctgggtctaaacgtgggcttaacctatgacgacatcacccaatgcttttgcctgagggcgacatgcattatgaatcacgaagctgtgagcgcttcagggcgcaaaatcttcagtaattgctccatgcatgactatagatacttcgtgagcaagttcgagaccaagtgcctgcaaaaattgagtaacttgcaacccctccatcagaatcaacctgtttgtgggaacggcatcctggagagcaatgaggagtgtgactgtgggaacaagaacgaatgccagtttaagaagtgctgtgactacaatacatgtaagttaaaagggagcgttaagtgcggcagcggcccatgctgcacctctaaatgcgagttatcaattgccggcacaccatgccggaagtccatcgatccggagtgcgactttaccgaatattgtaatggcaccagcagcaactgcgtgcctgatacctacgccctcaacgggcgcctgtgcaagttgggtaccgcctattgttataatgggcaatgccagacaaccgacaaccagtgcgcgaagatttttgggaagggagcgcagggggctcccttcgcctgcttcaaggaggttaactccctgcatgagcggagcgaaaactgcggcttcaaaaatagtcagcccctgccatgtgagcgaaaggatgtgctgtgcggaaaactcgcgtgtgtgcaaccccacaaaaatgccaataagtccgatgcgcaaagtacagtttattcttatatccaggaccacgtctgtgtgtcaattgcaaccgggagctcaatgcgcagcgatgggacagacaatgcgtacgtagccgatggtacaatgtgcgggccagagatgtactgcgtgaacaagacgtgtcgaaaggtgcacctgatgggttacaattgtaacgcaacaaccaaatgtaaaggaaaagggatctgtaacaatttcggcaactgccagtgtttccccggtcaccggccacctgattgtaagtttcagttcggctcaccaggaggatccatcgacgatgggaactttcagaaatccggagacttctatactgaaaagggatataacacccactggaataattggttcattctctcattttgtatcttcctgcccttcttcatcgtttttaccacagtgattttcaagaggaacgagatatcaaagtcttgtaatcgcgagaatgccgaatacaaccgtaattcaagcgtggtcagcgaatcagacgatgtcggtcactag

SEQ ID NO: 24211 - DNA, 462 bp, Artificial Sequence
  Description of Artificial Sequence: Synthetic coding sequence
atgcggtccgacgggacagacaacgcatacgtcgccgatggcacgatgtgtggcccagaaatgtactgcgtcaataagacatgtaggaaggtccatctaatgggctacaactgtaatgcaactaccaaatgcaaagggaaggggatttgtaataactttggaaattgtcagtgttttcccggacatagaccaccggactgcaagttccagttcggttctcccggaggaagcattgatgacggcaatttccaaaagtcaggtgatttctatactgagaaaggatataacacacactggaacaactggttcattcttagtttctgtattttcctccctttcttcattgtcttcactactgtgatcttcaaacgcaatgaaatatcaaagagctgtaatagggagaatgcagagtataacagaaattcatccgtcgtctcggaatctgatgatgtgggccactag

SEQ ID NO: 24212 - DNA, 549 bp, Artificial Sequence
  Description of Artificial Sequence: Synthetic coding sequence
atgttcttgttactggcacttctgactgaactcggccggttacaggcccatgagggaagtgagggaatttttttgcacgtcacagtacccaggaaaattaagtctaacgacagcgaggttagcgaacgcaagatgatctacataattacgatcgacggccagccctatactcttcatctcggtaaacaaagcttcctcccgcagaacttcctggtgtacacatacaacgagactggcagcctgcattctgttagcccatattttatgatgcattgccactatcagggttacgctgccgagtttccaaactcctttgttaccctgtctatatgctcaggcttacgggggtttctgcaattcgagaatattagctatgggattgaacccgtggagtcaagtgccaggttcgagcacatcatctaccaaatgaagaacaacgatccgaacgtttcgattttagcagtcaattactcccatatttggcagaaagaccaaccatacaaggtaccactcaatagtcaggtcaccgtaatcatccttatgttatag

SEQ ID NO: 24213 - DNA, 2364 bp, Artificial Sequence
  Description of Artificial Sequence: Synthetic coding sequence
atgtttaggctgtggctgctgttggcaggtttatgcggcctcctcgcttcaagacccgggtttcagaattcgctgctgcagatcgtgattccagagaaaatacagacaaacacaaatgattcgtcggagatcgagtacgaacaaattagctatatcattcctattgacgaaaagctctacactgtacatcttaagcaacgttatttcctggctgacaatttcatgatttacctctacaatcagggaagtatgaacacctacagtagcgacattcaaacccagtgttattaccagggcaacatcgaaggatatcctgactctatggtcacgctgagtacttgctccggactgagaggaatcttacagttcgaaaacgtgtcttacggcatcgagccccttgaatctgctgtggaatttcagcacgtcctatacaaacttaagaacgaggacaatgatatcgcaatctttatcgataggagtttgaaggagcagccgatggatgacaatatttttatttcagagaagtctgagccggctgtgcctgatctgttccctctgtacttagaaatgcatatcgtggtggacaagacactctacgattactggggctccgattccatgatagtcaccaataaagtgatcgaaatagtaggtctcgccaatagcatgtttacccagttcaaggtcacaatcgttctctccagccttgaactgtggtctgacgaaaacaaaattagcactgtgggggaggcggacgaactactccagaaatttctcgagtggaaacagagctatcttaatctgagacctcacgacatcgcatacctgttaatctatatggattacccaagatacctaggcgctgtgtttcccgggacaatgtgcatcacacggtatagtgcgggcgtggccctttatcccaaggagatcacacttgaagccttcgctgtgatagtcactcagatgctggcgctgagtctcggcatttcctacgacgacccaaaaaaatgccagtgtagcgaatcaacatgcatcatgaaccctgaggtggttcagtctaacggagtcaagacattttctagctgttctctacgttccttccagaatttcatcagcaacgtgggtgtgaaatgcctccagaacaagccacagatgcagaagaagtctcccaaacccgtttgcggaaacgggcggttggaaggaaatgaaatttgtgactgcggcaccgaggctcagtgtggacctgcatcgtgttgtgactttcgaacatgtgttttaaaagatggtgcaaagtgctacaagggattgtgttgtaaagactgccagattctccagtccggagtggagtgtagacccaaagcccacccagagtgtgacattgctgagaattgtaacggtacatcccccgagtgcggaccggacattacactcattaatggcctgtcatgcaagaataacaagttcatctgttatgacggagactgccatgatctcgacgccaggtgtgaatccgtgtttggaaagggatcacggaatgctccctttgcctgttacgaggagatacagtctcagtccgaccggttcggtaattgtggccgggacagaaacaataaatacgtcttctgcggctggcggaacttgatatgcggaaggctggtttgcacataccctacgcgcaaaccatttcaccaggaaaacggtgatgtcatttatgcctttgtccgggacagtgtttgcatcaccgtagactacaagcttcctaggactgtgcccgaccccctggcggtaaaaaatggatctcaatgtgacattggcagagtttgtgtgaatagagagtgtgtggagtcccgcataattaaggccagcgcccatgtgtgttcgcagcagtgttcaggccacggagtgtgcgattctcgcaacaagtgccattgctcccctggttacaaaccccctaattgccaaattcggtcgaagggcttctccatttttcccgaggaagatatgggatcaattatggaaagagcatctgggaagaccgagaacacttggctcctgggatttcttattgccctgcctatcctaatcgtaaccactgcaattgttctggctcgtaagcagcttaagaagtggttcgcgaaggaggaagaattccccagtagcgagtccaagtcagaggggtctacacagacgtacgcctcccagagctcatctgaggggtctacacagacatacgcgtcccagacaaggtccgaatcatcttctcaggcagacaccagcaagtcgaaaagtgaggattctgctgaagcctatacttcccggagcaagtcacaggactccacgcaaacccagtccagtagtaactag

SEQ ID NO: 24214 - DNA, 837 bp, Artificial Sequence
  Description of Artificial Sequence: Synthetic coding sequence
tttcgcaacttacttaataacgttagtctgtgccaccctggatggtcagccgtggctcagtcatggctcaccgctacttctgcctcacaggttcaggttatacttctgccacatccccccaattgctggctgggattacaggaacagatctcttatattattccaattgatgagaagttatacacagtccatttaaaacagcgctattttctggcagacaatttcatgatttacctctacaaccaaggcagcatgaatacttacagcagcgatattcaaactcagtgttactatcaaggcaatattgaaggctaccctgattccatggtcacactgtctacctgcagcgggctccggggaattctccaatttgagaacgtgtcatacggtatcgagcccctcgagagcgccgtggagttccagcatgtgctgtacaaactcaagaacgaagataacgacatagcaattttcatcgacagaagtctgaaggagcagccaatggatgataacattttcatatcagagaagtccgagccagccgtgcccgacctctttcctttgtatctggaaatgcacatcgttgttgacaaaactctttacgactactggggaagtgattcaatgatcgtcacgaacaaggtgatcgaaattgtgggcctcgcgaattcaatgttcactcagtttaaagtgacaattgtactgtccagcctcgagctgtggtcggacgagaacaagatctcaacagtcggcgaggccgatgaactgctccaaaaattcctggagtggaaacagagctacttgaatctgcgaccacacgacattgcttatctgctgtag

SEQ ID NO: 24215 - DNA, 2358 bp, Artificial Sequence
  Description of Artificial Sequence: Synthetic coding sequence
atggtggtgcccagtctgaagctacaagacctgatagaggagatcaggggagccaagacgcaggcccaagaaagggaggtgatccagaaagaatgtgcccatataagggccagctttagagatggagaccccgtccacagacatcggcaattagcgaagctgttgtacgtccacatgctgggttaccccgcgcattttggacagatggagtgtctcaagctaatagccagcagtagattcaccgacaagagggtgggctatttgggggccatgctcctgttggatgaaagacacgatgcgcatctcttgatcaccaatagcataaaaaacgatttgagtcagggcatccagccagtccagggactggcactctgtaccctgtcaactatgggatcagcggaaatgtgccgtgatctcgcacctgaagtcgagaagcttctgctgcagccttctccatacgtacgaaaaaaggccatcctcactgccgtccatatgataaggaaagtgcccgagctctcatccgtcttcctacccccgtgcgcccaactgctccatgaacgccaccatggaatattactgggcactattaccttaattacggagctgtgcgaacgcagtcctgccgcattacgccattttaggaaagtcgtcccccaactggtccatatactgcgaaccttggttaccatgggatatagcaccgaacactctattagtggagtgagcgacccattcttacaggtgcagattctccggctgttgagaattcttggacgcaaccacgaggaaagctccgagacgatgaatgatctgctagcccaagtagcaacaaatactgacacttcacggaatgctggcaacgccgtactgttcgagactgtcctgactataatggacataagaagcgctgcagggctacgggtcctggctgtgaacattcttgggagatttctgctcaattctgaccggaacatccgctacgttgccctgacttcgctactccggctggtccagtcagaccacagtgccgtacagcgccaccgaccgaccgtcgtggagtgcctcagagagacggacgccagtctgtcacgacgggcactcgaactctccctggctctcgtcaattcctccaacgttcgtgctatgatgcaggaacttcaggccttcttggagtcatgccctccagatctgcgggcagactgcgcatcaggcattttgttggcagccgagcggtttgcccccaccaaacgttggcacatagacactattctccacgtgctgactaccgcaggaactcatgtgcgcgatgacgctgtggcgaatttaacacagttaattggaggagctcaagagctgcacgcatactccgtgcgccgcctctacaacgccctagctgaggatatttcccagcaaccgctggtccaggttgccgcatggtgtattggcgagtacggtgatttattactcgctgggaactgcgaggaaattgaaccattacaggtggatgaggaggaagtgctggcccttttggaaaaggtgttgcagtcccacatgagcttgccggctacccgcggatacgctctcacagctctgatgaagctgtccactagactctgcggagataataatcggatacgacaggttgtctccatatacgggagctgcctggacgtcgaactccaacagcgtgcagtcgaatacgacacattattccggaaatacgatcacatgcgagccgccattttggagaagatgccactcgtggaacgggacggtccgcaagctgatgaggaggcaaaggaaagcaaggaggctgctcaactttccgaagctgctccagtgcctaccgagcctcaagcatctcaactgctagacctcttagacttgctggacggggcaagcggtgatgtgcagcatcccccccatctcgatccaagtcccggcggagcccttgtgcatctcctcgacctcccttgcgttcctccaccccctgcccccatccccgatctaaaagtcttcgagcgggaaggcgtgcagctcaacctgtctttcatcagaccccctgaaaatccagcactccttctgatcaccataaccgctaccaactttagtgaaggagatgttacgcatttcatctgccaggctgccgtcccgaagtccctccagttacagctgcaggctccctccggtaacaccgtccctgcccggggtggcctccccataactcagctgtttcgcatccttaacccaaacaaggccccgttgcgcctcaaacttcggttaacatatgaccattttcatcaaagcgtccaggagatctttgaggtgaacaatctgcccgtggagtcctggcagtag

SEQ ID NO: 24216 - DNA, 2358 bp, Artificial Sequence
  Description of Artificial Sequence: Synthetic coding sequence
atggtggtccctagcttaaagctgcaggatttaatcgaggagatccgcggcgccaagacccaagcccaggaacgggaggttatccagaaggagtgcgcccatatacgggccagctttagggatggagatcctgtgcaccgacacagacaactcgcaaagctcctgtatgtgcacatgctgggctatccagctcatttcggtcagatggagtgcctgaagctgatcgcatcttccaggttcacagataaacgggtgggttatctgggtgccatgctcctgttagacgagcgccacgacgcacatctgcttatcactaacagtatcaaaaatgatttatctcagggcatccagccagtccaaggactggcgctctgcaccttgtcgacaatgggaagcgctgagatgtgcagagacctggcacccgaggtagagaagcttctgctccagcctagcccctacgttcggaaaaaagcaatcttgaccgcagtgcacatgatccggaaagtgcctgaactgagcagtgtcttccttccgccatgtgcacaattgctgcatgagcgacatcatggcatcctgcttggtaccatcacactcatcactgaactgtgtgagcggagccctgccgctttgcggcactttcggaaggtggtaccacaacttgtgcatatcctgagaactttagttaccatgggttattccactgaacatagtatatctggcgtctctgatcctttcctccaagtccagattctgcggctcctaagaatcctcggacgcaatcacgaggagagttcagaaaccatgaatgacctgctagcccaggtggccaccaatacggacacatcccggaacgcaggcaatgccgtgctattcgagacagtgctcacaattatggatatacgctccgccgcaggattgagagtgctcgctgtgaatatcctcggacggtttttgctaaattcagacagaaacatacggtacgtcgctctgacatcattgctgagactcgtgcagtccgaccacagtgccgtccagcgacatcggcctacggtagttgaatgcctacgagagacagatgcttctctgtcaagacgcgccttagagctctcactagccctcgtgaattcctctaacgtccgggccatgatgcaggaactccaggcattcctggaatcatgcccaccagacctccgcgctgactgtgcttccggaatactgttggccgcagagcgattcgcacccaccaagaggtggcacatagacacaattctgcatgtgctgacaaccgccggtacccatgtgcgcgatgacgccgtcgcgaacctcacacagttgattggaggagcgcaagagctgcatgcctacagcgtgaggagactctataacgctctcgcggaggacatttctcaacaacccctggttcaggttgccgcttggtgcatcggtgagtatggggatttactgctggctggcaactgcgaagagatcgagcccctgcaagttgatgaggaagaagtacttgccctcctcgagaaagtgctccagtctcacatgtcactgccagcaacacgaggatatgcattgacagcactgatgaagttgtcaactcgactgtgcggagacaataataggattcgacaggtggtgagtatatacggttcttgtctggatgttgagctgcagcagagagccgtggaatacgacaccctatttcggaaatatgatcatatgcgagccgctattctcgaaaaaatgcctctcgtagaacgcgatgggcctcaggctgacgaagaagcaaaggagtctaaagaagccgctcaactatccgaagctgcacccgtgcctactgaaccgcaggctagccaactcctcgatctcttggacctactagatggagcttccggcgacgtccaacaccccccccatctggatcccagcccggggggagcccttgtacacctgcttgatttgccatgtgtaccccccccacctgctcccatacctgacctcaaggtgttcgagcgagagggtgtgcagctcaacctaagcttcatcagacctcccgagaaccctgctctcttgcttataaccatcaccgccacaaacttcagcgagggcgacgtgactcacttcatctgccaggcagccgtacccaagtctttgcagctccagcttcaagcaccctcagggaacaccgtgcctgcacggggaggactgcctatcacccaactgttccgcatactgaatccaaacaaggcacccctaaggcttaaacttcgcctcacatatgatcatttccaccagtcagtgcaggaaatcttcgaggttaacaatctgccggtagagagctggcaatag

SEQ ID NO: 24217 - DNA, 1923 bp, Artificial Sequence
  Description of Artificial Sequence: Synthetic coding sequence
atggacaggaggattgagaacaggatgggcacccccgcccacaggagaagagtggtgcatactcacagacacactaggaacagactgtcatgtccctggcccccacccttcacctctccaactctaacgcctggcatcctgctgggcaccattaccctgattacggagttgtgcgagcggagccctgccgccctaaggcatttccggaaggtcgtgcctcagctcgtccatatattaagaacattggtgaccatgggctactccacagagcacagcatctccggtgtatcagatcccttcctccaagtgcaaattttgcgtcttctcagaatactgggtcgcaatcatgaggagtcctcagagacaatgaacgatctgctggcccaggtggcaaccaatacagatacctcacgaaatgcgggtaacgcagtgctgtttgagaccgttctgacaatcatggatatcaggtcagccgcgggtcttcgcgtgctcgcagtgaatatccttggacggtttctattaaacagtgacaggaatataaggtacgtggctctaacttcactgcttagactggtgcaatccgaccattctgccgtccagagacatcgtcccacagtggttgagtgcctgcgggagaccgacgcttccctgagcagacgcgctctagaactctccctggccttagtgaatagctcgaacgtgcgtgcaatgatgcaggaacttcaggcatttctcgaatcctgtcccccagatctgagagccgactgcgcatccgggatactcttagccgcggaaaggttcgcaccaacaaaacgttggcacattgataccattctacatgtcctgacaactgcagggactcatgtgagagatgacgctgttgccaatctgactcaactgattggaggagcccaagagctccatgcctattctgtccgaaggctgtacaatgccctggccgaggacatcagtcagcaaccacttgtgcaggtagccgcatggtgtatcggggagtatggggacctcctgctcgcaggcaattgtgaagagatcgaaccccttcaggtagatgaggaggaagtactggcacttctcgaaaaggtgctgcagtcccatatgagtctgcccgccaccaggggctatgcgcttaccgctttaatgaagctgagtacaaggctgtgcggggacaataatcggattaggcaagtggtatccatatacggcagctgcctagacgtagagttgcaacagcgggccgtagaatatgacacactgtttagaaaatatgatcacatgagagccgctatcttggaaaagatgcccctggttgaaagagatggcccacaggcagacgaggaagccaaggaatccaaagaggctgcccagctgagtgaggctgcaccggtgccgacagagccacaggcgtcacaactgcttgacctgctcgacctgctggacggagcttctggagacgtacaacatcccccacatctggaccccagccctggtggcgccctagtgcacctgcttgatctgccgtgcgtgcccccacccccggcgcccattcccgacctcaaagttttcgagcgggagggtgttcaattaaacctgagcttcatccgaccgcccgaaaatcccgctttgttgctgataaccataaccgctaccaacttcagtgagggagacgtgacccactttatttgccaagcggctgtaccgaaatcgctgcagttacagctccaggctccatcaggaaacaccgtccctgcccggggcggtctgcctattactcaactgttccggatccttaatccaaataaagcgccactgcggctcaagctccgtctgacttatgatcatttccatcaaagcgttcaggaaatattcgaggttaacaaccttccagtggaaagttggcaatag

SEQ ID NO: 24218 - DNA, 1665 bp, Artificial Sequence
  Description of Artificial Sequence: Synthetic coding sequence
atgtcagtgaccatggtggttccacagctcgttcatattctgaggaccctggttacaatggggtacagtactgagcactctatttccggggtgagcgatccttttcttcaagtgcagattttgaggctgctgaggattctgggccggaaccacgaggagagttccgaaaccatgaatgatctaacggtgctcacaattatggatattcgatctgcagccggcctacgcgtactcgctgtgaatatattgggcagattcctgctgaacagtgacaggaatatcaggtacgtggcacttacctcattactgaggctcgtacagtcagaccactctgccgtgcagcgccacaggccaacagtggtggaatgcctgcgcgagaccgacgcaagcttgtccagaagagccttagagcttagtctcgcgctcgtgaattcttccaatgtgcgcgcaatgatgcaagaattgcaggcatttctcgagtcgtgcccacctgatctgcgggcagactgtgctagcggcatcctgttggccgccgagagatttgctcctaccaaacgctggcacattgataccatacttcacgttctcaccacggccggaacgcacgtgcgggatgatgccgtagctaatttgacacagctgattggaggagcacaggaattgcacgcatacagtgtccggaggctctacaacgccctcgccgaggacattagccagcaaccactcgtgcaagtggccgcttggtgcatcggtgagtatggagatttgctgttagccggcaattgcgaggagatagaacccttgcaggtcgacgaagaggaggtccttgccttgctggagaaggtcctccaaagtcatatgtctctgcctgccactcgtggatacgcgctgactgcacttatgaagctctctacacgcctctgtggagataataatagaatacggcaggttgtcagcatatatgggtcttgtctcgacgtggaattgcagcagcgggccgtggagtatgatacactgtttcgaaagtacgaccatatgcgtgctgccattctcgaaaaaatgccgttagtagagagagatgggccacaggccgatgaggaagcgaaggagagtaaagaggccgctcagctctcagaggccgctcccgtgcccaccgagcctcaagcctctcagctgctggatctgctggatctgttggacggcgccagcggtgatgtgcaacacccaccccacctagacccttctccagggggagcattggtgcacctgctcgacttgccatgcgttccaccacccccagctcccatccctgacctgaaagtcttcgagagagagggcgtgcaactgaatctgagctttataagacctccggaaaatcccgccctgctgttgataactatcactgcaaccaatttttcagagggggatgtgacacattttatttgccaagcagcagtcccaaagtccttgcaactgcagctgcaggcccccagcgggaataccgtgccagccaggggtggactaccaattacacagctttttcgcatactaaatcctaacaaggctcccctgagactcaagttgcgactgacttacgatcatttccatcaaagtgtccaggagatttttgaggtgaataacctgcccgtggaaagctggcagtag

SEQ ID NO: 24219 - DNA, 414 bp, Artificial Sequence
  Description of Artificial Sequence: Synthetic coding sequence
atggtggttcccagtctgaaactccaggatctgatcgaagaaatccggggagctaaaacccaagctcaggagcgggaagtcattcagaaagaatgcgctcatattcgcgccagttttagagacggagaccctgtacataggcataggcagcttgctaagttattgtacgtgcacatgctcggctacccggctcattttggccaaatggaatgcttgaaactcatcgccagcagcaggtttactgataaacgtgtcggttatctgggcgcaatgctcctgcttgatgaacggcacgacgctcacctgttaattacaaattccattaagaatgatctcagccaggggatccagcccgtccagggcctcgccctgtgtactttgagtaccatgggatccgcagagatgtgccgctag

SEQ ID NO: 24220 - DNA, 603 bp, Artificial Sequence
  Description of Artificial Sequence: Synthetic coding sequence
atggtggtgccaagcctcaaactccaggatctgatcgaggaaatacggggagccaaaacacaggcacaggaacgcgaagtgattcagaaggaatgtgcccacattagagcttccttccgcgatggcgatccagtccaccgacacagacagctggccaaattactgtacgtgcacatgctgggttaccccgctcactttggacaaatggagtgcctcaaactcatagccagtagtcgctttactgacaagagagtgggctacctgggagcgatgctcttactggatgagcgccacgatgcacatttgctgataacaaactctatcaaaaatgacctcagccagggtattcagccggtccaagggttggccctgtgtactttaagtactatgggcagtgccgagatgtgccgagatcttgcccctgaagttgagaagctgctgttacagccatctccatatgtgcggaaaaaggcgattctaacggcagtacacatgatcaggaaggtccccgagctttcatctgtgttcctgcccccgtgcgcgcagctcctgcacgaacggcaccatggaattttgctggggacgattaccctgattacttag

SEQ ID NO: 24221 - DNA, 465 bp, Artificial Sequence
  Description of Artificial Sequence: Synthetic coding sequence
atgatccactttattctgttattctccaggcagggcaagctgcgcctgcagaaatggtatataaccctgcctgataaggaacgaaagaaaatcacacgagagatagttcagatcattctgtcaagagggcaccgcacaagttcgttcgtagactggaaggagctgaagttggtctacaaacgatacgcgagtctatatttttgttgtgcaattgagaatcaggacaacgaacttcttaccctggagattgttcaccgatacgttgagctgttggacaaatacttcggaaacgtatgtgagctcgatattattttcaatttcgaaaaggcatatttcattcttgacgagttcattatcggaggagagattcaggagacatctaaaaagatcgcagtgaaggctatagaggacagtgatatgttacaggaaaccatggaagagtacatgaacaagcccactttctag

SEQ ID NO: 24222 - DNA, 315 bp, Artificial Sequence
  Description of Artificial Sequence: Synthetic coding sequence
atgatccacttcatcctcttgttcagccgacagggcaaactccgcctccagaagtggtacatcaccctgcccgacaaggaacggaaaaaaataacgcgcgaaatcgtccaaatcattttgtccagaggtcataggaccagctcattcgtggactggaaggagttgaagttggtgtacaaaagatatgccagtttgtacttctgttgcgccatcgaaaatcaggataatgaactgctcacactggagattgttcaccggtacgtggaattgttggacaagtactttggtaatacctggcccttcgctagggcatag

SEQ ID NO: 24223 - DNA, 495 bp, Artificial Sequence
  Description of Artificial Sequence: Synthetic coding sequence
atgatccactttatcctcttgttctccagacagggcaagctccggcttcaaaaatggtacatcacactgccagataaggagcggaagaagataacgcgtgaaatcgtgcagataattttgtcgagaggccaccgcacaagcagcttcgtcgattggaaagaactgaagttagtgtataagcgctacgcgtccctgtacttttgctgcgctatcgaaaaccaggataatgagctgttgacactggagatagtccacaggtatgtggaactgctggataaatattttggtaacgtctgcgaactagacatcatctttaactttgagaaggcttacttcatcctggacgaatttatcatcggtggtgagattcaggaaacgtcaaagaaaattgccgtcaaagccattgaggattctgacatgctgcaagaaaaccggctgtccccgcgagggcgggattgttctgagccccgcagctgccactgtaccctggcgtag

SEQ ID NO: 24224 - DNA, 465 bp, Artificial Sequence
  Description of Artificial Sequence: Synthetic coding sequence
atgattcacttcatcctattgtttagcagacagggcaagctgcgattgcagaagtggtacattacactgcccgataaggaaagaaaaaagatcactagggagatagtacagattattctgagcagaggccatagaacaagctcctttgtggactggaaggagctcaaactggtctacaagaggtatgccagcctgtacttttgttgcgccatcgagaatcaggataacgagttgctcactctagaaatcgtacacaggtatgtagagctgcttgataagtactttggtaacgtctgcgagctggatatcatcttcaacttcgagaaggcctactttattcttgatgagttcatcatcggtggcgaaatccaggagaccagcaagaagatcgcagtcaaggccatcgaagacagcgatatgctccaggaggtatccacggtcagccagaccatgggggaaaggtag

SEQ ID NO: 24225 - DNA, 3249 bp, Artificial Sequence
  Description of Artificial Sequence: Synthetic coding sequence
atgtccgccgctccagcatactccgaggataagggtggttccgctggcccgggtgaacccgagtacggccacgatccagcttccggtggcatattttccagcgattacaaacgtcacgacgacctcaaggaaatgctggacactaataaagactctcttaaattggaggctatgaaacggatcgtcgctatgatcgcccgcggaaagaacgccagcgacttgtttccagcagtagtgaagaatgtggcgtgcaagaatatcgaagtgaaaaagcttgtatatgtgtatctggtgagatatgcagaggaacagcaggatcttgctttgctgtctatctccacctttcagagaggcttgaaggatcctaaccagctgatcagggcctctgcgctccgggtgctctctagcattcgagtgccaattatagttccaattatgatgcttgccatcaaggaagccgcatcagacatgtctccatacgtgaggaaaaccgctgctcacgccatcccaaaattgtattccttggactctgaccaaaaagatcagctgattgaggtcatcgagaaattactggccgataagacaaccctggttgctggtagcgtggttatggcctttgaagaggtttgtcccgagaggatagacctcatccacaagaactacaggaaactatgcaatctgctgatagatgtagaagaatgggggcaggttgtgataatttcgatgctgaccagatacgctagaacccagtttctgagccctacccagaatgaatcccttctggaggaaaacgcagaaaaggcgttctacggttctgaagaagatgaggccaaaggcgccggttccgaagagaccgctgcggcagctgccccttctcgcaaaccttacgtaatggaccctgatcataggcttctgcttagaaatacgaagccactgctgcaaagtaggtcggcggccgtggtaatggctgtcgcacaactttacttccatcttgcaccaaaagctgaggttggcgtgattgctaaagctcttgtacgcttactccgttctcattctgaagtccagtacgtggtgcttcagaatgtggctacgatgtcaatcaagaggagaggaatgttcgaaccctatctcaagtccttctatataagatcaaccgatccaacacagattaagattctgaaactggaagtgctgacaaatttggcgaatgagactaacattcctactgtgttgcgcgaatttcagacatacattcgttccatggacaaggattttgtggccgcaacaatccaagccattggacggtgtgccacgaacattggccgcgtgagggacacttgtctgaacgggttagtgcagctgctgtctaacagagacgagctcgtggtcgccgagtcagtggtggttatcaagaagctgttgcagatgcagcccgcccagcacggggagataattaagcatctggctaagctgacagacaatattcaggttcccatggccagggccagcattctttggctgattggcgaatactgcgaacatgtgccacggattgccccggatgtactaaggaaaatggctaaaagctttacagccgaagaggacatcgtcaagttacaagtaataaacctggccgcaaaactgtacctcaccaattcaaaacagaccaaactgttgactcagtatgtgctgagcctggccaagtacgaccaaaattacgatattagagatagagcccggttcacaagacagctcatcgtcccgagtgagcagggtggcgccctgagcaggcacgccaagaaactgtttctggcgcccaagcctgctccagtgctggaatcaagcttcaaggacagagaccatttccagctcggttctttgtcgcacctgctaaacgcaaaggctacgggttatcaggagctacccgattggcccgaagaggctccggacccctccgtacggaacgtagaagtgccagaatggaccaagtgcagcaacagagagaagagaaaagagaaagaaaaacctttctacagcgactcggagggcgagagcgggcccacagagagcgctgattcagatccggaatctgaatctgaatccgactctaagagcagctcagaatccggttcaggtgagagctcttcagagtccgacaacgaggaccaggacgaagatgaagagaagggccgggggagcgaaagcgaacaatccgaggaggatggaaagcgaaaaactaagaagaaagtaccggagcgcaaaggagaagcgagttccagcgacgaaggctccgatagcagcagctcaagctccgaatctgagatgacatcagaatcggaggaggagcagctggagccggcctcctggtcacggaagaccccacctagctctaagagcgctcctgcaaccaaggaaatttccctgctggacctggaggactttacccctccatctgtccagcccgtcagtccacccgccatcgtgagcacgagtcttgcggcggatctcgaaggtctgactctgaccgattccaccctggtccccagtttgctttctccagtctccggggtcggacgccaagaactactgcaccgggtggcaggagaaggcctcgcggtggactatactttcagccgtcagcccttttcgggggatccccatatggtctccgtgcacatccatttctcaaacagttctgacactccgatcaaaggtcttcacgtgggcacccctaagcttcccgctggaatcagcatacaagaatttcctgagattgaatccctcgcacctggtgaatccgccacagctgtcatgggcataaatttttgcgactctacacaggcagcaaattttcaactgtgtacacagaccagacagttctatgtttctatccagcctccagttggagagttaatggcaccagttttcatgtcagagaatgagttcaagaaggagcagggcaaattaatgggaatgaacgagatcactgaaaagctgatgctccctgatacttgtcgatccgatcacatcgtcgtgcaaaaagtgacggctaccgctaacttgggtagggtgccctgtggtactagcgacgagtataggttcgccggacggacactgactggaggaagcctggtgctgctgactcttgacgcaagacctgccggggccgctcagctcaccgttaattccgaaaagatggtgataggcacaatgctggttaaggacgtgatccaggctctaacccagtag

SEQ ID NO: 24226 - DNA, 3153 bp, Artificial Sequence
  Description of Artificial Sequence: Synthetic coding sequence
atgtcagccgcgcccgcatactctgaagataagggcggctcagcgggtccaggcgagccagagtacggacacgacccagcaagcggcgggatattctcctccgattacaaaaggcacgacgacctgaaagagatgctggataccaacaaggattctctcaagctggaagccatgaagagaatcgtcgctatgatcgcccggggcaaaaacgctagtgatctctttccagcggttgtgaaaaatgtggcatgcaagaacatagaggatcctaatcagctcattcgggcatcggcccttcgtgtcctgagcagtatccgtgtcccgatcattgtaccgataatgatgctggctataaaggaagcagcatcggacatgagtccgtatgtgcgcaagacagctgcacatgctattccgaaactgtacagcctggattctgatcagaaagaccagctgatcgaggtcatcgaaaaactgctcgctgacaaaaccacactggtcgccggttcagtggtcatggcttttgaggaagtctgccctgagcggatcgacctgatccacaaaaattataggaagctatgcaatctgctgatcgatgtggaagagtggggccaagtggtgataatctcaatgcttactcgttacgcccggacccagtttctgtctcctacccagaatgagagtctgctcgaagaaaacgccgagaaggctttttatggctcggaggaagacgaagcgaagggtgctgggtccgaggagaccgccgctgcggcggcaccctctaggaagccatacgtgatggatcccgaccaccgtctcctgctgcgcaataccaagcccctcctccaatctcggtccgcagccgtggtgatggccgttgcacagttgtattttcacctcgcccctaaggctgaggttggagtgattgccaaagcgctcgtccgccttctgcgttcccacagcgaggtacagtacgttgtgctgcagaacgtggcaaccatgtcaatcaaacgcaggggcatgttcgagccctatctgaagtctttctacataagaagcacggacccaactcagattaagatcctcaagttagaagttctgaccaacctagccaacgagacaaatattccaacggtcctccgggagttccaaacatatatcagaagcatggacaaggattttgtggccgccactatccaagcaatcgggcggtgcgcaacaaatattggaagagtacgagacacatgtttgaatgggctggtgcagctgttgagcaaccgcgatgaactggtggtggccgagagcgtggttgtcatcaagaagctgcttcagatgcaacccgctcagcacggcgaaattattaagcatctagcaaaactgaccgataatatacaggtgccaatggcacgggcatcaattctttggctgattggcgagtattgtgaacacgtccccagaatcgcccccgatgtcctgcgcaaaatggcaaaaagcttcaccgccgaagaggacattgtgaaattgcaggttatcaacctcgcagcgaagctgtatctgacaaatagcaaacagaccaagctcctcacccaatatgtcctgtccctagcaaaatatgatcagaactatgatataagggacagggcccggtttactcggcagttgattgttcccagtgagcagggaggtgccctgtcccggcatgccaaaaagctgttcctcgcacctaagccagctccagtcctcgagagttcgttcaaggaccgggaccatttccagcttgggtccctgtctcacttgcttaatgcaaaggccactggttaccaagagctgccagattggccagaggaggcgccggatccaagtgtgcggaatgtagaagtccccgagtggacaaagtgttcaaacagagagaaaagaaaagagaaggaaaaaccattctattcagattctgagggggagtccggtcctaccgagagcgccgacagtgaccctgagagtgagtctgagtcagatagcaaatcctctagcgagtccggctccggggaatcatcgagcgagtctgataatgaagatcaggacgaagatgaagaaaagggtagaggaagtgagtcagagcagagtgaagaagacggcaagagaaagacaaagaagaaggttcccgagagaaagggtgaagccagcagtagtgatgagggttctgatagctcatcatccagcagcgagagcgagatgacttccgaaagcgaggaagagcaactcgaacctgccagctggagcagaaagactcctccgagctctaaatcggcccccgctacgaaggagatatccttgttagacttggaggatttcaccccgccatcagttcagccagtgtccccacctgccattgtaagcacatcattggccgcggatttagaggggcttacgctgaccgattcgactctggtccccagcctgctgtctccagtctccggtgtaggaagacaggagctgctacatagagtggccggagaagggttggccgtggactataccttttcccgtcaaccgttttccggcgatccccacatggtgtccgtgcacatccatttcagcaactcttctgacacgccaattaaaggtctgcatgtcggcacacctaaactgccggctggaatttcaatccaagagtttcctgaaatcgagtctttggctcctggcgaatcagcgaccgcggttatggggataaacttctgtgatagtactcaggccgccaactttcagttgtgtacccagacgcgacaattttatgtctcaatacagcctccggtgggcgaactgatggccccagtatttatgagtgaaaacgagtttaaaaaggagcaggggaagctgatgggaatgaatgagattaccgagaagctcatgctgccggatacatgtaggagtgatcatattgttgtccagaaggttaccgcaacagcgaacctgggtcgggtgccttgcggcacatcagatgagtatagattcgcggggagaacattaactggtgggtcacttgtcttactgacattagatgccaggcctgcgggagcagcccagctgaccgtgaactcagaaaaaatggtcattggcacgatgctcgtgaaggacgtcatccaagcacttacacagtag

SEQ ID NO: 24227 - DNA, 3306 bp, Artificial Sequence
  Description of Artificial Sequence: Synthetic coding sequence
atgtcagcagcaccagcatactctgaggataagggagggagcgcaggacccggggagcctgagtatggccatgatcccgcctcaggaggcatcttctcaagtgattataagcgccatgatgacctgaaagagatgctggatactaataaagactctctcaaactggaggcaatgaaaagaatcgtggccatgattgcgcgaggtaaaaatgcatccgacctgttcccagctgttgtaaagaacgtggcatgtaagaacatagaggtcaaaaagctggtttacgtttacctcgtcaggtacgctgaagagcagcaagatcttgctctgttatcaatttccacctttcagcgcggactgaaggacccaaaccagctaatcagggcttcagcacttagagtgctaagttccatccgagtccccattattgtacctatcatgatgttagcaatcaaagaggcagccagcgatatgagcccctatgttcgtaagactgcagcgcacgcaattcctaagctctattccctggattccgatcaaaaagaccaattgattgaggtgatcgaaaagcttttagctgacaagaccactcttgttgcaggctctgtggtcatggcgttcgaagaggtgtgccccgaacgtattgacctgatccacaagaattacaggaagctgtgtaacctcttgatcgacgtggaagaatggggccaagtagtgataatttccatgcttacacgctacgcacggacgcagtttttgagccctacacagaacgaaagccttttggaggagaatgccgagaaagcattctacgggtcagaggaggacgaggccaagggcgctggatccgaggagacggcagctgcggccgcgccaagcagaaagccctatgtcatggaccctgaccaccgcctcctgctcagaaatacaaagcccctgctccaatcccggtccgccgctgtcgtgatggctgtcgcgcagctctatttccacttggctcccaaggcagaggtcggagtgatagcaaaggctctcgttcggctcctcaggagccattccgaggtgcagtatgtggttctgcagaatgtggccactatgtccatcaaacgcagaggcatgttcgaaccttacctcaagagtttttacatcaggagtaccgatccaactcagatcaaaattctgaaactggaggttttgactaatcttgctaatgagactaacataccaacagtcttaagagagttccagacatatatccgatctatggataaagactttgtggcggccactattcaagcgataggccgctgcgccaccaatattggtagagtaagagacacatgcctgaatggcctagtgcagctgctatctaacagggacgagctcgtcgtcgccgagtcagtggtggtcatcaagaagttgctccagatgcagccggcacagcacggcgaaatcattaagcatttagctaaactgaccgataatatacaagtaccaatggctagggccagtatactgtggcttatcggtgagtactgcgagcatgtgcctcgaattgcccctgacgtactgcggaagatggcaaaatcatttacagccgaagaggacatcgttaagctgcaagtcattaatctggcagcaaaactctatctgactaacagtaaacagacaaaattgctcactcaatacgtgttgtcattggctaagtatgaccagaattatgacatccgcgatagagcaaggttcacccgccagctgatcgtccccagcgagcagggcggggccctgtccaggcacgcaaagaaattgtttcttgcccccaagcccgctccagtgctggaaagcagtttcaaggaccgcgatcacttccagctgggcagtctaagccatctgttaaacgccaaggccaccgggtaccaggagctcccagattggccagaagaggcccccgatcctagcgtgagaaacgtagaggaggaggacttatccctgatagaaacccacgtcggcctgttgggggagtacacagaagtgccggaatggacaaagtgtagtaacagagaaaagcgcaaggagaaggagaagcccttttactctgattccgagggggagtccgggcccacagagtctgccgattctgatccagagagtgagtcggagagtgactccaagagcagttccgaatcagggtctggcgaatccagcagcgagtccgataatgaggaccaggatgaggacgaggagaagggtcgtggaagtgagtctgagcaaagtgaggaagacggcaagagaaaaacgaagaagaaagtgcccgagagaaagggagaggcgtcaagtagtgacgaaggctcagatagctccagttcaagctcagaatccgagatgaccagtgagtctgaagaggagcagttggagcccgcttcatggagcaggaagacaccaccgagctccaagtctgcccccgctacaaaagagatctcactactagaccttgaggacttcactcccccctcagtgcagcctgtaagccctcccgctattgtctcaacctccctggctgcagaccttgaggggctgacactgacagatagtactctggtgccttccctgctgtcacctgtgtctggagtcggaaggcaggagctgctccaccgtgtggcaggcgagggactcgctgttgattacactttttctcgtcaaccattcagcggggacccccatatggtgtccgtgcacattcattttagcaactcatcggataccccaataaaaggcctacacgtgggaactcctaagctgccggccggtatctccattcaggagttccccgaaattgagtccctcgctcctggcgaatcagctaccgccgtcatgggaatcaacttctgtgattcaacccaggccgcaaattttcagctctgtacacagacacggcagttctatgtgtcgatccaaccccctgtaggagagttgatggcgccagtttttatgtcagagaatgagtttaagaaggaacagggaaagttaatgggcatgaatgagatcacagagaagctgatgctgccagatacctgtcgctcggatcatatagtggtgcagaaagtcaccgcaaccgcaaatttaggcagagtaccctgcggcacgtccgatgaatatcgattcgctggcagaacattaacagggggaagtctcgtattgttgaccttagatgcacgtcctgctggagccgcccagctgaccgtgaattctgaaaagatggtgatcggtaccatgttagtcaaagacgtaatccaggctctgacacagtag

SEQ ID NO: 24228 - DNA, 3066 bp, Artificial Sequence
  Description of Artificial Sequence: Synthetic coding sequence
atggcactaaaaatggttaaaggaagcattgaccgaatgttcgacaaaaacctgcaggatctggttcgtggaattaggaaccacaaggaggatgaagccaagtatatcagccagtgcattgacgaaataaagcaggaacttaagcaggacaacattgcggtgaaggccaatgcagtctgcaagcttacatacttgcaaatgttagggtatgatatctcttgggcagcgttcaatattatcgaagtcatgtcagcctctaagtttacttttaaaaggattgggtacctagctgcatctcaaagttttcacgagggcacagatgtgattatgttgaccacaaaccagattaggaaggacttgtcttccccatcgcagtatgacacaggggtggccctcacaggcttgagctgtttcgtgacacccgacttagctagagacctggcgaatgatatcatgacactgatgagccataccaagccttacatcaggaaaaaggctgtcctaattatgtacaaagtctttttgaaatatcctgaatccctgcgccccgcattcccaaggttgaaagaaaagctggaagatcccgatccaggcgtgcagtccgctgctgtgaacgttatttgtgagctcgcccgcaggaatcctaagaactacctgtcactggcaccactgtttttcaagctgatgaccagctccactaataactgggtgctgatcaaaattattaagctgttcggtgccttaacacccctggagcctcgactcggcaaaaaactgattgaaccccttaccaatctgattcactcgacatctgcgatgagtctgctctacgaatgtgttaacacagttatagccgtgttgatttccctgagttcagggatgccaaatcattcggcttcaatccagctgtgtgtccagaagctccgcattttaatcgaggattccgaccagaatctaaagtatctggggctgctagctatgtctaaaatcttaaagactcacccaaaatccgtccagagtcataaggatcttatactgcagtgccttgacgacaaggacgaaagcattaggctcagagcgctggacctgttgtacggcatggtgagcaaaaagaacctcatggagatcgtgaaaaagctaatgacgcacgttgacaaggccgagggaacaacataccgtgacgagttgttaacaaagattatagatatttgttcccagtcgaattaccagtatatcacgaattttgagtggtatataagcattctcgtagagctgactaggctggagggcacaaggcacggccatctcatcgccgcccaaatgttggacgtggccatccgcgtcaaagctatccgtaagtttgctgtcagtcagatgtctgccctgctggattctgctcacctcttagcttcatccacccagaggaatggaatatgcgaagtgctgtacgctgccgcgtggatctgcggagagttttctgagcacctgcaggagcctcaccacaccctcgaggcaatgctacgccctcgcgtgactacccttccaggacatattcaggctgtttacgtccagaatgtggtcaagctgtatgcctccatcctccagcagaaggagcaggctggcgaggcggagggggctcaggccgttacccaacttatggtggatcgcctgccccaattcgtacagagcgctgaccttgaagtgcaggagagagccagttgtatcctccagctcgttaaacacatccagaaactgcaggctaaggacgtgcccgtcgcagaggaagtatccgctttatttgcaggcgagcttaaccctgtggccccaaaggcccagaagaaggtgccagtgccggaaggattagacctggatgcctggatcaacgagccactctcggactccgagtctgaagatgagcgaccccgggccgtgttccacgaggaagaacagcgccgcccaaagcatagaccgtcagaggcagacgaagaggagttagcgagacggcgagaagcaaggaaacaggaacaagccaacaacccattctatataaaatcaagccccagtcctcagaagcgctatcaggacactcccggcgtggaacacatccccgtcgtgcagatcgatctcagtgtgcctttgaaagtgcctgggctcccgatgtccgatcagtacgtgaagctggaagaggagaggcgccacagacagaagctggaaaaggataagagaagaaaaaaacggaaggaaaaagaagagaggacaaagggcaaaaagaaaagcaagaagcagcctcccggttccgaggaggctgcaggtgaaccagtccagaatggtgccccggaggaagagcagctgccacccgagtcctcgtattccctgttggctgagaactcttacgtcaaaatgacctgcgacatacgaggatcattacaggaagatagccaggttacagtggccattgtcctggagaaccgctcttctagtatcctcaagggaatggaattgagcgttctggactcgctcaatgcgagaatggcacgcccccagggctcttcagtgcacgatggcgtgccagttccatttcagctgcctcccggggtttctaatgaagctcagtatgtatttactatccaatctatcgtcatggcccaaaaactaaaggggacacttagctttatcgccaaaaacgacgaaggcgcaacccacgaaaagctggactttcgcttgcatttctcctgtagcagctacctaatcacaacaccttgttacagtgacgctttcgctaaactgctagagtccggcgatctctcaatgtctagtattaaagttgacggcattcggatgtcctttcagaacctgcttgcaaagatctgcttccaccatcattttagcgtcgttgagagggtagactcttgtgccagcatgtattcgcgttcaattcagggtcaccacgtatgtttgctggttaagaagggcgagaatagtgtgtccgttgatggaaaatgttcggattccaccctgttatcaaacctgctggaagaaatgaaggccacattagcaaagtgttag

SEQ ID NO: 24229 - DNA, 3462 bp, Artificial Sequence
  Description of Artificial Sequence: Synthetic coding sequence
atggctttgaaaatggtcaaaggctccatcgatagaatgttcgataagaacttgcaggacttggtccgcggcatcaggaatcataaagaagacgaggccaagtacattagtcagtgcatcgatgagatcaaacaggaattaaagcaggacaatatcgcagtgaaagcaaatgcagtgtgcaagctaacatatttgcagatgttgggttacgatattagttgggctgcatttaatattattgaagttatgtccgcgtctaagtttactttcaagcgcattggctacttggcagcttcccaaagcttccatgaaggtaccgatgtgatcatgctgacaactaaccaaataaggaaggacctatcgtcaccatcgcagtacgacacgggtgtggctctcaccggcctgtcctgctttgttacaccagacctggctcgtgatttagctaacgatattatgacgctgatgagccatactaagccatacattcggaaaaaggccgttttaatcatgtataaggtctttttaaaataccctgagtccctcaggcccgccttccctcgcctgaaggaaaaacttgaggaccccgatccaggcgtgcagtcagccgcagtcaatgtgatttgcgaactggcccgcaggaatcccaagaattacctgtcactggcacccttgttttttaaactgatgacgtcatcaacgaataactgggtgctgatcaagatcattaagcttttcggggcactaacgcccctggaaccgcgcttagggaaaaaactgatcgagcctctcacaaacctcatccactccacatcagccatgtccctgctatatgaatgtgtgaataccgttatagctgtgctgatctctctcagctccgggatgccaaatcattccgccagcattcagttgtgtgtccagaaattacggattttaatcgaagactccgatcaaaatctgaaatatctcggtctgttggcaatgagtaaaatactaaaaactcaccctaaatctgtgcaatcacacaaggatttaatactgcaatgcctggacgataaagacgagagtatcagattgagagccctggatttgctgtatgggatggtgtcgaagaaaaacctgatggagatagttaaaaaactgatgacccatgttgataaggctgagggcaccacctatagggatgagttactcacaaagatcatcgacatttgctcacagtcaaattatcagtatattaccaacttcgaatggtacatctcaattctggtggagctcacccgcttagagggcacaaggcacggacacttaatcgcagcccagatgttggacgtggcgattagggtgaaggccattcgtaagttcgccgtgtcccagatgagtgccctcctcgatagcgcacacctccttgctagttctacccagagaaacggcatctgcgaggtgctgtatgctgccgcctggatttgcggagagttcagcgagcacctgcaggaacctcaccacactcttgaggccatgctacgcccccgggtgacaacactccccggacacattcaggcagtgtacgtgcagaacgtggtaaagctgtacgcttctattttgcagcagaaggagcaagccggggaggcagaaggtgctcaggctgtaactcagcttatggtggatcgccttccgcagttcgtgcagagtgccgacctcgaagtacaggagcgggctagctgcattcttcagcttgtaaaacacatccagaagctgcaggctaaggacgtgcccgtggccgaggaggtgagcgcactgttcgctggagaattaaatcccgtggctccaaaagcacagaagaaagtgccagtcccagagggcctagatctggatgcgtggatcaatgagcccctgtctgattcggaatccgaggatgagaggcctcgagcggtattccatgaagaagagcagcggaggccgaaacaccggccaagcgaggcagatgaggaagaactggctagacggcgggaagcccggaaacaagaacaggccaacaatcccttctatatcaagtcatctccctccccccagaagagatatcaggatacaccaggcgttgagcacatccccgtggtccagatagacctatcagtgccccttaaggtcccaggcctgccaatgagcgaccagtatgttaagcttgaagaggagagaagacatcggcagaagctggaaaaagacaaacggagaaagaaaagaaaggagaaagaaaaaaagggcaaaaggagacattcttccctgcccacagagtctgacgaggacatcgccccagctcagcaggttgacatagttactgaggaaatgccagagaacgcactacccagtgacgaggatgacaaagatcctaacgatccttaccgcgcccttgatatagatctcgataaaccactcgcagatagcgagaaacttcccattcaaaagcacaggaacaccgagacaagcaagtcccctgaaaaggatgttcctatggttgaaaaaaaatcaaaaaaacctaagaaaaaagagaaaaagcataaagagaaggaacgcgataaggagaagaagaaggagaaagaaaaaaagaaatccccgaagcctaagaaaaaaaaacatcgcaaagaaaaagaagagagaactaaaggaaaaaaaaagtcgaaaaaacagccgcctgggagcgaagaggccgctggcgagccggttcaaaacggtgctcctgaggaagagcagctgcctcctgaatcttcatactcattgctggcagagaacagctatgtgaaaatgacgtgtgatataagaggatctctgcaagaggactctcaggttaccgtggctatagtgctcgaaaatcgctcttcaagcattctgaagggaatggagctgtcagtgctggattcactgaacgctcggatggctaggcctcaggggagtagcgtacacgatggagtcccagtgccttttcagctccctcctggagtatccaatgaggctcagtatgtctttactatccagtctattgtgatggctcagaaattgaagggtactctgagctttattgccaaaaatgatgagggggctacccatgagaagctggactttcgcctccattttagttgttcctcgtacctgatcacaaccccgtgctactctgacgcatttgctaagttactggagtccggcgacctctcgatgtcttcgatcaaagtcgacgggatcaggatgtctttccagaacttattagctaagatttgcttccaccaccactttagtgtggtggagagagtggactcgtgtgccagcatgtattcccggtcaatccaaggccatcacgtctgtctgctcgtgaagaaaggcgagaattccgtaagtgtcgacggaaagtgctccgattcaactctgctatcaaacttactggaagaaatgaaggcaaccttggctaaatgttag

SEQ ID NO: 24230 - DNA, 2955 bp, Artificial Sequence
  Description of Artificial Sequence: Synthetic coding sequence
atggcactgaagatggtcaagggcagtatcgatcggatgtttgacaagaacctgcaagacctggtgcgtggtatcagaaatcacaaggaagatgaggctaagtatatttcccagtgcattgacgagatcaagcaagagctgaaacaagataatattgccgtcaaggctaatgccgtctgtaagcttacatacttgcagatgctcgggtatgatatttcttgggcagcctttaatattatcgaagttatgtcggcatcgaagttcacttttaagaggataggttatctggctgcaagccagtcatttcatgagggaactgacgttatcatgctgactacgaatcagattctgcttatttcactgtcatctggcatgcccaatcattcagcctcaattcagctttgcgtccagaaactgcgtattttgatcgaggattcggaccagaatttgaagtatctgggactgctggccatgtcaaaaattctgaaaactcacccaaaatccgtccagagccacaaagacctcattcttcagtgtctcgatgacaaagatgaatccataaggcttcgggccctggatttgctctatggcatggtgagcaagaagaacctgatggagatagtgaagaaactgatgacacatgtggacaaggcagaaggtaccacatatagagatgaactgctcaccaaaattatcgatatctgttcgcaatctaattaccagtatatcacaaacttcgagtggtatatttcgattttggtggaactcacacggttggagggaacgcgccatggccatctgattgctgctcaaatgcttgatgtcgcaatccgcgtgaaggcgatcaggaagtttgccgtttctcagatgtcagctctcctcgatagtgcacatcttttggcttcttccacccagaggaacgggatctgcgaagtcctgtatgccgccgcttggatctgtggtgagttttcagagcatctgcaggaaccccaccatacccttgaggcaatgcttaggcccagagtgacaacccttcctggacacatccaggcagtttatgtgcagaatgtcgtaaaattatacgcaagcattctacagcaaaaggagcaagctggtgaggctgagggtgcacaggctgtgactcaattaatggtggatcggctgccacaattcgtacaatccgctgatctcgaggtccaggaaagagctagctgcattctccaactcgttaaacacatccaaaaattgcaagctaaagatgtgcccgtggccgaggaagtctcagctctatttgcaggggagctaaatcctgtagcccctaaagcccagaagaaagtgcccgtacccgagggactggacttggacgcttggattaacgagccattgtcagacagcgaatcagaggacgaacggccccgagcggtgttccacgaagaagaacagcgccgccctaagcaccggccttcagaggctgatgaggaagagctggccaggagaagagaagctagaaagcaggagcaggcaaacaaccctttttacattaaatcctcaccctccccacagaagagatatcaggatacgcctggggtcgagcatattccggtagtgcagattgacctgtccgttcctttaaaggttcccggactgcccatgtctgaccagtacgtcaagttagaggaggagaggaggcacaggcagaagctggaaaaggacaaaagaaggaaaaagagaaaagagaaagagaagaaggggaagcgtcggcatagttccctgccaactgagtccgacgaggacattgctcctgcgcagcaggtcgacatcgtcaccgaagaaatgcctgaaaatgctctccctagcgatgaggacgataaagacccgaacgacccctaccgagccctcgatatcgatctagacaagccattggctgacagcgaaaaattgccgattcagaaacaccgtaataccgagacatctaagtctccagaaaaggatgtgccaatggtcgagaaaaagtccaaaaagccaaaaaagaaggaaaaaaaacataaggagaaggaaagggataaggagaagaagaaagagaaggagaaaaaaaaaagcccaaagcccaaaaaaaagaaacacaggaaagaaaaggaggaacgaaccaaaggaaagaagaaatccaagaaacagccccctggcagcgaagaagcagcaggagagcccgtccagaatggcgcccccgaggaagagcagctgccaccagagagctcgtactctttgctagccgagaactcctacgtgaagatgacatgtgacataaggggctcactgcaagaagattctcaagtcacagtggcaatcgtgctagaaaatcgttcatcttccattctaaaagggatggagctgagtgtactagacagcttgaacgcccgtatggcccggccacagggtagcagcgtgcatgacggcgtgcccgttccctttcagctgccccccggagtgagcaacgaggcccagtacgtgtttacgatacagtcgattgttatggcacagaaattgaaaggcactctgtcgttcattgcgaagaacgatgaaggggccactcatgagaaactggactttcgcctgcacttttcatgttcgtcctatctaattaccaccccttgctatagtgacgcctttgccaaactgctcgagagcggagacctctcgatgtcgagcatcaaggtcgacggcataagaatgtctttccagaacctgctggccaagatctgcttccatcaccatttttcagtcgttgagagagttgatagttgcgcaagcatgtattcccgaagcatacagggacatcatgtgtgtctcttggtcaagaaaggggaaaacagtgtttccgtggacgggaaatgctccgacagtactttactgagtaacctgctggaagaaatgaaggccactctggcgaaatgctag

SEQ ID NO: 24231 - DNA, 3648 bp, Artificial Sequence
  Description of Artificial Sequence: Synthetic coding sequence
atggctctgaagatggtcaagggatcaattgataggatgttcgataagaacttacaggaccttgtgcgaggaattcgcaatcataaagaagacgaggcaaagtatatttcccagtgcattgatgaaatcaagcaagaattaaagcaggacaatatcgctgtaaaagcgaatgcagtctgtaagctcacttacctccagatgctcgggtatgacatcagctgggcggctttcaatatcatcgaggtgatgagcgcatcaaaattcaccttcaagcgcatcggctatttggcggcatcccagtccttccacgagggcaccgatgtcatcatgctcaccaccaatcagatccgcaaggacctctcttctccttctcagtacgatacaggcgtggctcttacaggactgagttgctttgttacaccagatctggcccgcgatctggcaaacgacataatgacgctcatgtcccacactaaaccatacattcgcaagaaggcggtgcttattatgtataaagtgttcctgaaataccccgagtccttacggccggcattccctagactcaaggaaaagctggaagatccagatcctggtgtccagagcgccgccgtgaacgtcatctgcgaattagctagacgaaatccaaaaaactacctgtccctggcaccgcttttcttcaagctcatgacgtcctctacaaataactgggttctcataaagataattaaactgtttggagccctgactcccttagagccccgactgggtaagaaattgatcgagcccctgacaaacctgatacatagcactagtgcgatgtcactcctgtatgagtgcgtgaacacagtaattgcagtcttaatcagtttgtctagcggtatgcccaatcattccgcctctattcagctatgcgttcagaagctcagaatccttatcgaagactccgaccagaatctcaagtatctagggctcctggccatgtccaagattcttaagacacaccctaaaagtgtgcagtctcataaggacctcatactgcaatgcctggacgataaggacgagtccataagattgcgcgcacttgacctgctgtacgggatggtgagtaagaagaaccttatggagatagtgaagaaactgatgacccatgtggacaaagccgaggggaccacatacagggacgaactcttaaccaagataatcgacatctgctcacagagcaactaccaatacattaccaattttgaatggtacattagcattcttgtggagctcaccaggctggagggtacacggcacggccatctgattgctgcccagatgctcgacgtggccatccgagtcaaggcgatcaggaaattcgctgtctcgcaaatgtctgccctacttgattctgcccatctactcgcaagctccacccagcgaaacggcatatgcgaggttctgtatgccgcagcatggatttgtggcgagttttctgaacacctccaagagccgcatcacacccttgaagctatgctaaggcctagggtgaccacactgccgggccacatccaggccgtgtacgtgcagaacgtcgtgaaactgtatgcaagcatcctgcagcagaaggaacaggccggggaggcagaaggcgcacaagccgtgactcaattgatggtggaccgccttccgcagttcgtccagagtgctgatcttgaggtacaggagcgagcttcctgtattctgcagctggtgaaacacatccaaaagctgcaggcaaaggatgtgccggtagcagaggaagtctcggctctgttcgccggagaactgaatcccgtggccccaaaagctcaaaaaaaagtgccagttccagagggactggacctcgacgcatggattaacgagcctctgagtgatagtgaatcagaggacgagcgccctcgggcggtgttccatgaagaggaacagcggaggcccaagcaccggccgagtgaagccgatgaagaggagcttgcccgccgaagggaggctcggaaacaggagcaagccaataatccattttatattaaatcgagtccttcaccgcaaaaacggtaccaggacacacctggcgtggaacatataccggtggtgcagattgatctgtccgtgcctctgaaggtcccaggcctgccaatgagcgaccagtatgtcaagctagaagaggagcgtagacataggcagaagttggagaaagataagagaagaaaaaaaagaaaggaaaaagaaaagaaaggaaagcgtcggcattcatctttgcccacagagtccgatgaagatatcgcccctgctcagcaggtggatatcgtgacggaggagatgcccgaaaacgctctccctagcgatgaagacgataaggatcccaacgacccatatagggcgttggatatcgatctcgacaagccgctggccgattcagaaaagctccccattcagaagcatcgcaacacagagaccagtaaaagccctgaaaaggatgtgccgatggtggagaaaaagagcaagaagccaaagaagaaggaaaagaagcataaggagaaagaacgcgataaggagaaaaagaaagaaaaagaaaagaaagcggaagatctagatttctggttgtcaactacgcccccgccagctcctgctccggcccctgcacccgtcccaagcaccggggaactgagcgtaaacaccgtgaccacaccgaaggacgagtgcgaggatgccaaaactgaagcacagggcgaagaagacgatgcagaggggcaagaccaggacaagaaaagtccaaagcctaagaaaaaaaaacaccgaaaggagaaagaggagcggaccaaaggaaagaagaaatccaagaaacagcctcctggttccgaggaagcagccggggaacccgttcagaacggagcccctgaggaggagcagctacctcccgaaagttcctactctttgctggctgagaactcatatgtgaaaatgacctgtgatattagagggtctctgcaggaggactcccaggtgaccgtggcaatcgtcctggaaaatcggagctctagtattctgaagggcatggagctgtcagtcctagatagcttgaatgctagaatggcccggccccagggcagctcagtgcacgatggcgtccccgtgccgtttcaacttcctcctggggtaagcaacgaagcgcagtacgtctttaccatacagagcatcgtcatggcccagaagctcaagggaacactgtcttttatcgcgaaaaatgatgagggagcaacccatgagaagttggactttcgactccacttttcctgcagcagttacctcatcaccaccccctgctactcagatgcttttgcgaaactgcttgagtcgggagacctctccatgagttcaattaaggtggacgggatccggatgagcttccagaatttgttagccaaaatctgcttccatcatcatttctcagtggtcgaacgggtggacagttgtgcatccatgtattccaggtctatacaaggccaccacgtatgcttgcttgtcaaaaaaggcgagaatagtgtgagcgtggacggaaaatgctccgacagcacactcttatctaacttactagaagagatgaaggccacactcgccaaatgctag

SEQ ID NO: 24232 - DNA, 3339 bp, Artificial Sequence
  Description of Artificial Sequence: Synthetic coding sequence
atggctttgaagatggtaaaaggcagcattgacaggatgttcgataagaatttgcaggacttagtgaggggcattcggaatcacaaggaggatgaggctaaatatatcagccagtgcattgatgaaattaagcaggagttgaaacaggataacatagccgtgaaggccaacgccgtctgtaagttaacctatctgcaaatgctgggatatgacatcagctgggccgccttcaatataattgaagtcatgtctgcgtcaaagtttacctttaagaggattgggtatctggctgctagccaatcttttcacgaaggcacagatgtaattatgttaactaccaaccagatccgcaaagatctgagtagcccctcgcaatacgacaccggggtggccctgaccgggctttcctgcttcgttacaccagacctggctagagatctcgccaacgacatcatgactttgatgtcccatacgaagccgtatattaggaagaaggctaaactcattgagcccctgactaacttaatacactctacttccgccatgtccctactctatgaatgtgtcaatacagtgatagccgtgttaatcagcttgtctagcggtatgccaaatcattccgcatcgatccagctgtgtgttcaaaagctcaggattctgatcgaggatagcgaccagaatctcaagtaccttggcttgctggctatgagcaaaatcttgaaaacacaccccaagagtgtgcaatcccacaaagacctcatcctgcagtgccttgacgacaaggacgaatcaattaggctccgcgctttggacttgctgtacggaatggtgagtaagaaaaacctcatggagattgtgaagaaattaatgacgcacgtggacaaagcagagggtactacatacagggatgagcttctaacgaagatcatagatatctgtagtcagagcaactaccagtacattacaaacttcgagtggtatatatctatcttggttgagctgaccaggttggagggaacacggcacgggcatttgattgctgctcagatgctggacgtggctattagagtgaaggcaatcagaaaatttgcagtcagccagatgagtgcgttattggactcagcccatctcctggcctcctccacccagcgcaacggtatctgcgaagttctctacgctgcggcatggatttgcggagaatttagcgaacacttacaggagccccatcacacattggaggccatgttacgacccagagtcacaactctgccaggccatatccaggccgtatacgtgcagaatgtggtcaagctgtacgcgagtatcctgcaacaaaaagagcaggccggagaggccgagggcgcccaggcagtgactcaactgatggtggatcgcctcccccagttcgtgcagtcagccgacctggaagtgcaggaacgcgcttcctgcattttgcagctggtgaagcatatccagaaactgcaggctaaggatgtgcccgtggcagaagaagtatcagctttgttcgccggagagcttaatccagttgcacccaaagctcaaaagaaagtgcccgtcccagagggacttgatctcgacgcgtggattaatgaaccactcagtgattcagaaagcgaagacgagcggccgagggccgtgttccacgaggaagagcagagaaggccaaaacacagaccctccgaggctgatgaagaggaacttgcccgcagacgcgaagctaggaaacaggagcaggccaataatcccttttatattaaatccagtccttcaccacagaaacggtatcaggatacccctggtgttgagcatattccagtggtgcaaatagacctcagcgttcctctgaaggtgcccggcctacccatgagcgatcagtacgtcaagctcgaggaggagagaaggcaccgtcaaaaacttgaaaaggataagcgtcgtaaaaagaggaaagagaaggagaagaagggtaagagacggcactcctccctcccaactgagtctgatgaggacattgccccagcccaacaagttgatatcgtgaccgaggaaatgcccgagaatgctctaccctcagacgaggacgacaaagatccaaacgatccctatcgcgcccttgacattgatctggacaagcctctcgcagactcggaaaaacttcctattcagaagcacagaaataccgaaacttctaaaagccccgagaaggacgtgcccatggtggagaagaagtctaagaagcccaaaaagaaggagaaaaagcacaaggaaaaggagcgggataaagagaaaaaaaaagaaaaagagaagaaggcagaggatcttgatttttggctttctactactccccccccagcccctgccccagcccctgcgcccgtgcccagtacggacgagtgtgaggacgcaaagaccgaagcgcaaggcgaagaagatgatgccgaggggcaagaccaggataagaagagccctaagcctaagaagaagaagcacaggaaggagaaggaagaaagaaccaaaggcaagaaaaaaagcaaaaagcaacccccgggaagcgaggaagccgcaggagaaccggtgcagaatggggcaccagaggaggagcagctgcctcctgaatcatcctattcgctcctggctgagaactcttacgtgaaaatgacgtgtgacataaggggatccctgcaagaagattcccaggtcaccgtggccatcgttctcgagaatcggtcaagctctatcctgaagggcatggagctgagcgtattagactcactcaatgcacgtatggcacgacctcaaggcagttctgtgcacgatggagtgcccgtccctttccagctgcccccaggtgtctcaaatgaagcacagtacgtatttaccatacagagcatcgtaatggcacagaaactcaaaggcaccctctcattcattgccaaaaatgacgagggagctacccatgaaaagctggattttcgcttgcacttcagttgtagttcctacctgatcacaactccatgttattccgacgcttttgccaagttactggaaagcggggacttatccatgtcgagcataaaggtggacgggatccgtatgtctttccagaatctccttgctaagatctgctttcaccatcacttttcagtcgttgagagagtggatagttgtgcaagcatgtatagcaggtctatccaaggtcatcacgtgtgcctcctcgtcaagaaaggggagaatagcgtctcagtggacggaaaatgcagcgatagcaccctactgagcaatcttttggaagagatgaaagctactcttgcaaaatgttag

SEQ ID NO: 24233 - DNA, 1257 bp, Artificial Sequence
  Description of Artificial Sequence: Synthetic coding sequence
atgatccactcactgttcttgatcaactgctccggcgacatcttcctcgagaagcattggaagagtgttgtgtcacaatccgtgtgtgactatttcttcgaggcccaggaaaaggctgctgacgttgagaacgtgccgcctgtgatctccaccccacatcattatctgattagcatctaccgcgataagcttttcttcgtgtccgtgatccagaccgaggtgcctcctctgttcgtgattgagttcctgcatcgtgtcgccgatacttttcaggactacttcggcgagtgctctgaggctgcaattaaggacaatgtcgttattgtctacgaactactcgaggagatgctcgacaacggcttccctctagctaccgaatccaacattctgaaggaactgatcaaaccacctactatcctccggtcagtggtgaactcgatcactggctccagcaacgtgggggataccctgcccacggggcagctgagcaacataccctggcggcgcgctggcgtaaaatatactaataacgaggcttattttgatgttgttgaggagatcgatgccatcattgacaaaagcggaagcacagtcttcgccgaaatacaaggcgtcattgacgcgtgcatcaagttatctggcatgcccgatttgtccctgtcctttatgaaccccagattattggatgatgttagttttcatccctgcatccggtttaagaggtgggagtctgaacgtgttcttagcttcataccccccgatggcaactttcggctaatatcctacagagtcagtagccagaatctggtggcaatccctgtttatgttaaacattcaatctcatttaaggagaacagttcatgcgggcgttttgacattactattgggcctaaacagaatatgggcaagacaatcgaaggaatcacggtgactgtgcacatgccaaaggtcgtcttgaacatgaatctgacacctactcagggatcatacaccttcgatccggtgactaaagtgttaacctgggacgtgggcaagattaccccacagaaactaccaagcctgaagggactggtcaacctacaatccggagcacccaaacccgaggagaacccgtctcttaatatccaatttaaaatacagcagctggccatatccggtcttaaagtgaatagattagacatgtatggagaaaagtataaacctttcaaaggcgtcaaatatgtgaccaaagctggcaagtttcaggtaaggacatag

SEQ ID NO: 24234 - DNA, 1257 bp, Artificial Sequence
  Description of Artificial Sequence: Synthetic coding sequence
atgatacacagtctgttcctcattaattgctccggcgatattttcctggaaaaacactggaagtctgttgtttctcagagcgtgtgtgattactttttcgaggcacaggagaaggcagcagatgtggagaacgtcccacccgtaatatcgactccccatcactacttgatttctatttaccgcgataaattatttttcgtgagtgtaattcaaactgaggtgccacccctgttcgtgatcgaattcctgcatagagtggccgatacgtttcaggactactttggagaatgcagcgaggcagcgatcaaagacaatgtagtgattgtctatgaacttttggaggagatgctggacaacggatttccactggctactgaaagtaacatcctcaaggaactcatcaaacctcccacaatcctccgttccgtggtgaattccattaccggttcaagcaacgtgggagacacactccccacaggtcaactgtctaatataccctggagaagagccggagttaagtataccaacaatgaagcttacttcgatgtggttgaggaaattgatgctataatagacaagtctggatctaccgtgtttgccgaaatacaaggagtaatcgatgcatgcattaagctctctgggatgcctgatctatcgcttagctttatgaacccccgattgcttgatgacgttagcttccacccatgcattcgctttaagcggtgggagtcagagagggtgctcagtttcatcccccctgacgggaattttcggctgatttcgtatcgcgtgtcctctcagaacttggtcgcaattcctgtctacgttaaacattccattagtttcaaggagaatagcagctgcggccgctttgacatcactatcggaccaaagcagaatatgggcaagactatagagggcatcactgtgacagtgcatatgcccaaagtggtgctcaacatgaacctgacccccacacagggaagttataccttcgacccagtgacaaaggtgctgacatgggacgtggggaagatcaccccacagaagttgccatctctcaaagggctcgtgaatctgcaatccggcgctccgaaacctgaggagaaccctagtttgaatatccagttcaagatccaacagctagccatatccggtctaaaagtcaatcgattagacatgtatggagaaaagtataaacccttcaaaggggtgaagtacgttacaaaagctggcaaattccaggtccggacctag

SEQ ID NO: 24235 - DNA, 1257 bp, Artificial Sequence
  Description of Artificial Sequence: Synthetic coding sequence
atgatccactcactgttccttatcaattctagtggcgatatttttctggagaagcattggaaatctgtggtgtctaggagcgtgtgcgattacttttttgaggcccaggagagagccactgaagctgaaaatgtgccccctgtgatccctactccacaccactatctgttgagtgtataccgccacaaaattttttttgtggctgtgatacaaaccgaggtgccaccactgtttgttatcgaattcctgcaccgggtggttgatactttccaggactacttcggagtttgttctgagcccgtgattaaggacaatgtggtcgtggtctacgaggtcctcgaggaaatgctggacaacggatttcccttagcaaccgagtccaacatcttgaaagaattgattaagccccctaccattctccggaccgtcgtcaatactatcactggaagtactaatgtgggggatcagctgcccaccggccagctcagcgtggtcccttggcgaagaaccggagtgaaatataccaacaatgaggcttatttcgacgtgatcgaggagatcgatgcaattatcgataaaagcggttctactatcacggccgagatacaaggcgttatagacgcttgtgttaaactcacaggtatgccggatctcacactgagtttcatgaatccacgactcctggatgacgtaagctttcacccgtgcgttcgcttcaaacgctgggagtctgagagaattctctcatttatcccgcctgatgggaatttcaggctcctgtcataccacgtaagtgcacagaacttggtggcgatcccggtgtatgtgaaacacaacatttcctttagggatagctcttcacttggtaggttcgagatcaccgtgggccccaagcaaacgatgggcaagactatcgagggggttaccgtcactagtcaaatgccgaaaggggtgctgaacatgagcttgaccccatctcaggggacccataccttcgaccccgtcaccaagatgctgagttgggacgtcggtaaaatcaacccacagaaactgccctccctgaaaggcaccatgtctctgcaggctggtgcaagcaagcctgacgaaaatcctacaattaatttgcagtttaaaatacagcaactggctatttccgggctgaaggtcaatagactggatatgtacggggaaaaatataagccttttaagggtataaagtatatgactaaggctgggaaatttcaggttaggacgtag

SEQ ID NO: 24236 - DNA, 1257 bp, Artificial Sequence
  Description of Artificial Sequence: Synthetic coding sequence
atgattcacagtttattcctgataaattcatccggagacatctttctggagaagcactggaagagcgtggtttctcgatccgtttgcgactatttcttcgaagcacaggagcgtgcaacggaagctgagaatgtgccacccgttattcccacgccccaccactatctgttgtccgtttatcggcacaaaatcttcttcgtcgctgtcatccagacagaggtcccgccacttttcgttatcgagtttctgcacagggtggtcgacacattccaggattatttcggagtgtgcagcgaacccgtcatcaaggataacgtcgtggtggtatatgaggttttggaagaaatgctcgataatggattccctctcgccactgaatctaacattcttaaggagctgattaaacctccaacaattcttcgcaccgtagtgaacactataaccggtagcacgaacgtcggggatcaactgcccacagggcagctgtcagtggttccctggcggagaacaggggtgaagtacacaaacaatgaagcttatttcgacgtcattgaggagatcgacgcaattatcgacaagagtggatctacaattactgccgagattcagggggtcatcgacgcgtgtgtcaagctgacaggcatgcccgacctgacactttcctttatgaacccccggctcttggacgatgtgtcattccacccttgcgtccgcttcaagcgctgggagtccgagcggatcctgtctttcattccacctgatggcaatttccgactcctaagctaccacgtatccgctcagaatttggttgccattccggtctacgtgaaacataatatctccttcagagattccagttctctaggaaggttcgaaataacagtcggcccaaaacaaaccatgggcaagactatagagggcgtcactgtcactagtcagatgcccaaaggggttctgaatatgtcacttacaccaagccaaggtacccatacattcgaccctgttaccaaaatgctctcttgggacgtagggaaaatcaacccccagaagttacctagcctgaaggggacaatgtctttgcaagctggcgcctctaaacccgatgagaatccaaccattaacttgcagttcaagatccagcagctcgccatctcagggctcaaagtgaaccggctggatatgtatggtgagaaatataagccatttaagggaataaagtacatgacaaaggcagggaaatttcaggtccgcacatag

SEQ ID NO: 24237 - DNA, 33 bp, Artificial Sequence
  Description of Artificial Sequence: Synthetic coding sequence
atgattcacagtctgttcttgattaatagctag

SEQ ID NO: 24238 - DNA, 1257 bp, Artificial Sequence
  Description of Artificial Sequence: Synthetic coding sequence
atgatccactctcttttcctgattaacagcagcggggatatcttccttgagaagcactggaaatcagtcgtatctcgatccgtctgcgactacttcttcgaggcgcaggagcgtgccactgaggcagaaaacgtaccccccgtgatccccaccccacaccattacctcctgtctgtctataggcacaaaatttttttcgtggctgtcatacagacagaggtgccaccgctgttcgtgattgaatttctccacagggtggtcgacacttttcaggattattttggggtgtgctctgaacctgtgatcaaagacaatgtggtggtcgtgtatgaggtcctggaggaaatgttagataacggctttcccttggcaactgaatcaaatattcttaaagaactaatcaagcctcctactattttgaggacggttgtgaacaccatcaccgggtccacaaatgtgggggaccagctccccactggacagttatccgttgttccctggcgaagaactggagttaagtacacgaacaacgaggcttactttgatgttattgaggagatcgacgccatcatcgacaaatccgggtcaaccatcacagcagaaattcagggtgtgatcgatgcttgtgtgaaacttaccggcatgcctgatcttactctgagtttcatgaatccaagactactggatgacgtgagtttccacccatgcgttcgctttaaaaggtgggagtccgagagaatactctcatttattcccccagatggaaacttcaggctgttatcctatcatgtatcagcccagaacctggtcgctatcccagtgtacgtcaaacacaacatttcttttagagactcctccagcctgggcagattcgaaattaccgtagggcccaagcagacaatggggaagacaattgagggtgtcaccgtaacatctcagatgcctaaaggtgtgctcaatatgtcattgactccttctcagggaactcacacattcgatccagtaactaagatgcttagctgggatgtgggtaagatcaatcctcagaagttaccctcgctgaagggcacaatgtccctgcaggccggagcctccaaacccgacgaaaatcccactatcaacctccagtttaagattcagcaactggccatttctggcctcaaagtgaatcggctcgacatgtacggcgagaagtataaacctttcaaaggcataaagtatatgactaaggctggcaagtttcaggtgcgcacatag

SEQ ID NO: 24239 - DNA, 420 bp, Artificial Sequence
  Description of Artificial Sequence: Synthetic coding sequence
atgatacactctctgttcctgatcaactccagtggggacatattcctcgagaaacactggaagtcggtggtttccagatctgtgtgcgactacttcttcgaagctcaggagagagccacagaagcggaaaacgttcccccagtaatcccgactccccaccactacctcctgtctgtttatcgccacaaaatcttctttgttgccgtcatccagacagaggtgccccccctttttgtgattgaattccttcatagggtggtggacacattccaggactacttcggtgtctgctctgaacccgtgattaaggataatgtggtggttgtatacgaggttcttgaggaaatgctcgataacggtttccctttggccacggagtccaatattctgaaagagctcattaagccccccacaatctag

SEQ ID NO: 24240 - DNA, 822 bp, Artificial Sequence
  Description of Artificial Sequence: Synthetic coding sequence
atgattcacagtctctttctgattaatagtagtggagacatcttccttgagaagcactggaaatccgtcgtcagcaggtccgtctgtgattacttttttgaggctcaagagagggctacagaggcggagaacgtgcccccagtcatcccgacccctcaccattacctcttaagtgtgtatcggcacaagatattctttgtggccgttatccagacagaggtaccaccattgttcgttattgagttcctgcaccgcgtggtggatacctttcaagattactttggtgtttgttccgaaccggttattaaggacaatgtcgtagtcgtttacgaagtgttggaggagatgctcgacaatgggttccctctagctacggagtccaacattctgaaggagctgattaagcctccaaccatactgcgcaccgttgtgaacacaataaccggaagtactaacgtcggcgatcaacttcctaccggtcagctgagcgtggtgccttggagaaggaccggcgtgaaatacaccaataatgaagcatacttcgatgtgattgaggaaatcgatgccatcatagacaaaagcggcagtaccattacagcggaaatccagggcgtcattgatgcttgcgtgaaactgactggaatgcccgatctgactctgagcttcatgaatcccagattattggacgacgtgtctttccatccttgcgtcagatttaaacgctgggagagcgaacgcatcctttccttcatccctcccgatggtaacttcaggctcctcagttaccacgtgtccgcccagaagtgttgtctggggatgtag

SEQ ID NO: 24241 - DNA, 582 bp, Artificial Sequence
  Description of Artificial Sequence: Synthetic coding sequence
atgattcaggctatcctggtatttaataaccatggtaagccacggttggtaaggttctatcagcgttttcctgaagaaatccagcagcagattgtgagggaaacattccatttagttctgaaaagagacgacaatatttgcaatttcctggaaggggggtcactgatagggggctctgattacaaattgatttaccgccactatgccaccctgtattttgtgttttgtgtagattcctctgaatctgagctgggcatcctggacctgatccaggtgttcgtggagacacttgacaagtgttttgagaacgtctgcgagctggacttaatttttcatatggacaaggtacactatattctgcaggaagtcgtcatgggaggtatggtgcttgaaacaaatatgaatgagatcgtggcacaaattgaagctcaaaacagactggagaaaagcgagggggggttgtccgccgcgcctgctcgcgccgtctctgccgtgaagaatataaacctgcccgagattcccaggaacataaacatcggggacctgaatataaaggtcccaaacctttcgcagtttgtatag

SEQ ID NO: 24242 - DNA, 375 bp, Artificial Sequence
  Description of Artificial Sequence: Synthetic coding sequence
atgatccaagctattctggttttcaacaaccacggcaaacccagactggttcgcttctaccagcgctttcccgaagagattcagcagcagatcgtgcgcgaaacgttccaccttgtgctgaagagggacgacaacatctgtaattttttggaaggggggagcttgatcggcggatcagactacaagctcatctatcgacattatgccacactgtactttgttttttgcgtcgattcttccgagagtgaactgggtattctggatcttattcagctgaaaaagcgagagagaaaaaaaagtcagtgcaacacgctgcagaccggcacgttagctctgtgggagcagggaccagatatccgcacacgacggctgtag

SEQ ID NO: 24243 - DNA, 375 bp, Artificial Sequence
  Description of Artificial Sequence: Synthetic coding sequence
atgattcaggctatcttagtgttcaacaatcacggaaagcctaggttagtccgtttctaccagcggtttcccgaggagattcagcagcagattgtgcgtgagacctttcatttagtgctgaagagggatgacaatatctgcaatttcctggaagggggatcattgattgggggatcagattacaagcttatctaccgtcactatgcaactctatacttcgtgttttgcgtcgattccagcgagtccgagctgggaatcctcgacctgattcagcttaagaaacgagaacggaagaagtcgcagtgtaataccctgcaaaccggaactttggccctctgggaacagggtccagatataagaacccgcaggctgtag

SEQ ID NO: 24244 - DNA, 1506 bp, Artificial Sequence
  Description of Artificial Sequence: Synthetic coding sequence
atgccggcagccatgttgccctatgcctgcgtgctggtccttctcggggcccatactgctccggccgcaggggaagctgggggcagttgcctgcgttgggagcctcactgtcagcagcctttgccagatagagttccttccaccgccatcctgcccccgaggctcaacggcccatggattagtacaggctgcgaggtaaggccaggccctgagttcctgacccgcgcctatacattctacccgagccggctgtttagggcccatcaattttactacgaagacccattctgtggtgaacctgcccactccctgctggtgaaaggtaaagtgcgactgcgacgcgctagctgggtgacgcggggggcaaccgaagccgactaccatctccataaagtggggatagttttccatagtaggagggctttagtggatgtaacgggaagacttaaccaaactcgagccggcagagattgtgcccgtcgtctcccacctgctagagcctggctcccaggtgccttatacgaactcaggtctgcccgggcccagggagattgcctggaggcactgggtctgaccatgcacgagctatccttagttagggtgcagaggaggctgcagccccaaccccgggcgtctccaagactcgttgaagagttgtacctgggtgatattcacaccgaccccgccgagcggaggcactataggccgaccgggtaccagagaccactgcagagtgctctgcatcacgttcagccttgccccgcctgcggtctgatagcccgctccgatgtgcaccacccacccgtgctacctcctccactggccctgcccctgcatctcggaggatggtgggtgtcctccggctgcgaggtccgccctgccgtgcttttcttgacgcgtctgttcaccttccacggccactcacgatcttgggaaggctactatcatcacttctccgatccagcatgtcgccagcccaccttcactgtgtatgcagccggcagatatacacggggcacaccctcaactcgggtgcggggcggtaccgaactcgtattcgaggtcactcgggcccatgtgaccccaatggaccaagttacaaccgccatgctcaatttctctgaaccttcaagctgcggaggcgccggtgcatggagcatgggcaccgagcgtgatgttactgccactaacggctgcctgccccttggaatccgactgccccatgtggagtatgagctttttaaaatggagcaagaccccttgggtcaatcgctgttattcatcggccagcgcccgactgatggttcctcgccagatacacctgaaaagcgtccaacctcatatcaggccccgctcgtcctgtgtcacggagaggccccagatttttcccgtccgcctcagcaccggccaagtctgcaaaaacacccctccaccgggggactgcatatcgcaccatttccactcctacctctggtgctgggtctggcctttctgcactggctgtag

SEQ ID NO: 24245 - DNA, 1539 bp, Artificial Sequence
  Description of Artificial Sequence: Synthetic coding sequence
atggcggagaatagtggacctggcgttcggcctccgggttgggaagcgcagattaacatcatttcaacacgtctggcactggcacacaccgcacccgctgccggagaagctggtggcagctgtcttcggtgggaaccgcactgtcagcagccactcccagaccgggtgccatctaccgcgattctgccaccgagacttaacggaccttggatttccaccgggtgtgaggttagaccaggcccggaatttcttactagagcttataccttctatccatccagacttttcagagcacatcagttctattacgaggatcccttctgtggtgagcccgcccacagtttgcttgtgaagggaaaggtacggctgcgcagagccagctgggttacaagaggcgctacagaggcagactatcatctgcataaggtcggcattgtgttccactcccggagggctctggtggatgttactggtaggctgaaccaaacacgggccgggagggactgtgcgaggcgcctgccacccgctcgggcgtggctgccaggagcactgtacgagctgaggagcgcgcgcgctcagggggactgtctggaggccttaggcctgaccatgcatgagctttccctggtaagagtgcagaggcgtctgcagccccagccacgcgccagtccacgcctggtagaggaactgtatcttggagatatccatacagatcccgccgagcgcagacactataggcctacggggtaccaaaggccattgcaatcagcactgcatcatgttcagccctgccctgcctgtgggctgatagcgcgatccgatgtgcaccatccacccgtgctcccaccaccccttgctctgcccctgcacctgggtggatggtgggtgtcttccggatgcgaggtccgccccgcggttctctttttaacccgactgtttacattccacggtcattccaggtcctgggagggatattatcaccacttctcggaccctgcttgcaggcaaccgactttcacggtctacgctgccggtcggtatactcggggaaccccctctactcgcgttagaggaggaaccgaactggtattcgaagttactcgagcccatgtgaccccgatggatcaggtcactaccgcaatgcttaacttttcagaacccagctcttgtgggggcgccggtgcttggagcatgggcacagagcgcgacgtgactgccactaatggttgcctacctctgggtatccggctgccacatgtggagtacgagctgtttaagatggagcaggaccccctgggacagtcgctgctctttattggccagcgcccaactgacggttcttctcccgacacaccggagaagcgtcctacctcataccaggcccccctggttctttgtcacggcgaggcacccgacttctctcgacctcctcagcacagaccatcactgcaaaagcacccgagtaccggagggctacacatcgccccattccccctgttgccattggtcctaggactcgcatttctgcactggctctag

SEQ ID NO: 24246 - DNA, 1452 bp, Artificial Sequence
  Description of Artificial Sequence: Synthetic coding sequence
atgcaagagtttactaagttcccaactaagacgggaagacgttctctgtcaaggtcgatttcccagtcatcgaccgactcttactccagcgctgcatcttacactgacagcagcgatgacgaagtttctccgcgcgagaaacagcagacaaattcgaagggatcctccaacttttgcgtgaagaacatcaagcaagccgagttcggcagaagggagatcgagatcgccgagcaagacatgtcggccctaatcagtcttaggaagagggctcagggtgaaaaaccattggctggagcaaaaatagttgggtgcactcacataactgcacagaccgccgtgttgatcgaaacactctgcgctctcggcgcccagtgcaggtggtctgcatgcaacatttacagcactcagaatgaagtggcagcggcactcgccgaagcaggcgttgctgtgttcgcttggaaaggcgaatcagaagacgacttctggtggtgcatcgaccgctgtgtgaacatggatggctggcaggcaaacatgattctcgatgatggaggcgatctgacacattgggtttacaaaaaatatcctaatgtgtttaagaagatcaggggcatcgtggaagagtctgtaacgggcgtccatcggctgtaccagctttcaaaagctgggaaactgtgcgtgcctgccatgaacgttaatgacagtgtgacaaaacaaaagttcgataatttatattgttgtcgcgaaagcatactcgacggtctaaagaggactacagatgtgatgtttggcggtaaacaagtcgttgtctgcggctacggagaagtcgggaaaggatgctgcgccgccttaaaagctttgggcgctatcgtgtacattactgaaatcgacccaatttgtgccctccaggcatgtatggatggcttccgggtcgtcaaactgaatgaggtgattcggcaagtagatgtggttattacatgtacaggaaacaaaaatgtcgttaccagggagcatcttgatcggatgaagaactcatgtattgtgtgtaacatggggcacagtaacaccgagatcgacgtgacctccctcagaacgcccgagctgacgtgggaacgggtccgaagtcaagtcgatcatgtgatttggcctgatggaaaacgcgtggtccttttggcggagggacgtctcctcaatctgagctgtagcactgtgcccacgttcgtgctgtctatcaccgccactacccaggcactggcgttaattgagttgtataatgcaccggaaggacgatataaacaggacgtctatcttctccctaagaagatggatgagtacgtggcgtctttgcatctcccttctttcgacgcccacctcaccgagctgactgatgatcaggccaagtacctgggcctgaataaaaacgggccttttaagccaaactattacagatactag

SEQ ID NO: 24247 - DNA, 1593 bp, Artificial Sequence
  Description of Artificial Sequence: Synthetic coding sequence
atgtcaatgcccgatgctatgcctctacctggcgtgggggaagagttgaagcaggctaaagaaattgaagacgcagagaaatacagcttcatggccaccgtcacaaaggctcctaaaaaacagattcagtttgctgacgacatgcaggagtttactaagttccctacaaaaactggacgtcgctcactgtcccgaagcatcagtcagtcatctacagactcatacagttccgcagcctcctataccgatagctctgatgacgaagtttcccctagggagaaacaacagacaaactcgaaggggagtagcaatttttgcgtcaagaacatcaaacaagccgagtttggacgcagagagattgaaatcgcggaacaggatatgagtgcactgataagccttcgcaaacgcgcccagggcgagaaacctctagccggggccaagatcgtcggatgcacacatatcacagctcagactgcagtgttgattgaaaccctttgcgcactgggagcccagtgtcgctggagcgcttgtaacatctactcgacccaaaacgaggtggccgccgccctagctgaggccggggtggccgtgtttgcctggaagggggaatccgaggatgatttttggtggtgcatcgatcgttgtgtgaacatggacggatggcaggcgaatatgatccttgatgacggcggggatctgacgcattgggtgtacaagaagtatcccaatgtatttaagaaaatccggggtatcgtcgaggagtcagtgaccggtgtacaccgcctttaccagctgagtaaggcaggcaagttgtgcgtgcccgctatgaatgtcaacgactctgtgactaagcagaagtttgacaatctttattgctgtcgcgaatctatcctcgatggcctgaagcgcaccaccgatgtgatgtttggcggcaaacaggtggtggtgtgcgggtatggggaggtgggtaaaggttgctgtgcagctttgaaggctctaggtgcgatcgtttacattaccgagattgatcctatctgcgctcttcaagcctgtatggacggcttccgcgtcgtaaagctgaatgaggttatccgccaggtcgatgtcgtgatcacatgtaccggcaataaaaatgtggtgacccgagaacatctggaccgaatgaaaaacagttgtatagtgtgcaatatgggtcacagcaacacggagatagatgtaacaagccttcggactcccgagcttacatgggaaagggtgcgctcccaagtggatcacgttatctggccggacgggaagcgcgttgttctgctcgccgaaggacgtcttctgaacttgtcatgttcgaccgtgccaacgttcgtgttgtccattaccgccactacccaggccctggccctgattgagctgtacaacgcgccagaggggagatacaagcaggatgtttatctgttgcctaagaaaatggacgagtacgtggcttctctgcaccttccgagctttgatgcacatttaacagagttaaccgacgaccaagccaagtatctagggctgaacaaaaatgggccatttaagccaaattactaccgatattag

SEQ ID NO: 24248 - DNA, 1452 bp, Artificial Sequence
  Description of Artificial Sequence: Synthetic coding sequence
atgcaggaatttaccaagttcccaacgaaaaccgggcgtcggtcgctttcccgatctattagccagagttccactgactcatatagcagtgctgcctcgtatacagacagctcggacgatgaagtgagccccagggagaaacagcaaaccaacagtaaggggtcttccaatttctgcgtgaaaaatatcaaacaggcagagttcggtcgcagagaaatcgagatcgcagaacaagatatgagcgccctgatttcactccgcaagcgggcacagggagagaaaccactggccggcgcgaagatcgtgggttgtactcatatcacagctcagactgcagtactaatcgagaccctctgcgcattgggagctcagtgtcggtggtcagcatgtaacatctacagcacccaaaacgaggtggctgccgcactcgcagaggccggagtggccgtttttgcttggaagggcgagagtgaagatgacttttggtggtgcattgacaggtgcgttaatatggacggttggcaggcgaatatgatactcgacgacggtggcgaccttacacactgggtctacaaaaagtatcccaatgtgttcaagaagatcaggggtatcgtcgaagagtccgtcaccggagtacatcgcctctaccagttgagcaaagccgggaaactctgcgtgcccgccatgaacgtgaatgactctgtgaccaaacagaagttcgataacctgtactgttgtcgcgagagtattttggatggtctgaagagaactacagacgtgatgttcgggggcaaacaggtcgttgtctgtggctatggcgaggtcgggaaaggctgttgcgccgctctcaaggcattgggcgctatcgtctacataaccgaaatcgacccaatttgtgctctgcaggcttgtatggacggctttcgtgttgtgaaactcaacgaagtcataagacaagtggatgtcgtcatcacttgcacaggcaataagaatgtagtaaccagagagcatctcgacaggatgaagaattcatgtatagtgtgcaatatggggcattcaaataccgagatcgatgtgaccagtttaagaacacctgaactgacatgggagcgcgtgcgctcccaggtcgatcacgtgatttggccagatggaaaaagggtggtgcttctggctgagggccgcctgttaaacttatcgtgctccaccgtgccaacctttgtgctcagcatcactgcaacaacccaggccctagctctgatagagctctacaatgccccagaggggcggtacaagcaagacgtctatctgctccccaaaaaaatggatgagtacgtggcatcactacatctaccatcttttgacgcccacctgactgaactgactgacgatcaagcaaaatatctggggttgaacaagaacggcccattcaaacccaactattaccgctactag

SEQ ID NO: 24249 - DNA, 1119 bp, Artificial Sequence
  Description of Artificial Sequence: Synthetic coding sequence
tttgtcttcaaagcctacatgtacctcaatgaaggacagaagcttttgaagacgcttaagaaggataagtcgtggagtcagacattcgagtctgctactttctacagcctcaagggcgaggtttgttttaacatgggccagatcgtactcgcgaagaagatgctgcgcaaagccctgaaactgcttaaccgcatcttcccatacaatttgatctccctgtttctgcacatccacgtggaaaagaatcgacattttcactatgtgaaccgccaggcccaggaaagtcccccacctggcaagaaaagactggctcagttgtataggcagaccgtctgtctttctctactttggcgaatctattcatacagctatctgttccactgcaagtattatgcccacctggcagtcatgatgcagatgaacacagctctcgagacccagaactgttttcagattattaaggcttacttggattactcactttaccatcacctcgctggatacaaaggagtttggtttaaatatgaagtgatggccatggagcatatcttcaacctgcctctcaaaggtgagggtatagagatcgtagcctacgtcgctgagactttagtatttaacaaactgatcatgggccacctggacctggccatagaactaggctcacgagccctgcagatgtgggccctgctgcagaatcctaaccggcactatcagtccctatgtagactgagcagatgcctgctgctgaattcacggtaccctcagttgatccaggtgctgggtagactttgggagttatccgtgacacaggaacacatcttcagcaaggctttcttctacttcgtgtgtctggacattctgctttacagcggcttcgtgtacaggactttcgaggagtgcctggagttcattcatcagtacgaaaataacaggatcctcaaattccactccgggctattattggggctgtactctagcgttgctatctgggagtgtgaggcaggagttggacggagactacacacaagccgggaccccggcatgccagatttccggaacggcactaccttcaccaattttcctatcgagctgaagattttctgccaagaggaaccatag

SEQ ID NO: 24250 - DNA, 4557 bp, Artificial Sequence
  Description of Artificial Sequence: Synthetic coding sequence
atgagcttaagtgaaggcgacgccttgctcgctctttggcgggtggagcgcaaacagctgaagaacattataaccgttgtgatcaagtgctccctcgagatccacgggttgttcgagacccaggagtgggaggaaggattggatattagggttaaaatcgggctggctgcggggcatatatctatgcttgttttcggagatgaaacgcactctcactttctggtgattgggcaagccgttgatgacgttcggctggcgcagaacatggcgcagatgaacgatgtgattctatctcccaattgctggcagctgtgtgaccggtctatgatcgaaattgaatcggtgcccgatcagagggctgtgaaggtcaacttcctgaagccgcctccaaactttaactttgatgaatttttcacgaagtgcacgacttttatgcattactacccgagcggcgaacacaagaatctccttagactggcttgtaccctgaagcccgaccctgagctggagatgagtttgcagaagtacgtgatggaatcaattttaaagcaaattgacaacaaacagttgcaaggctacctctccgagctgcgcccagtaacaatcgtttttgtgaatctgatgtttgaggatcaggacaaggcggaagagattgggccagccatccaggacgcttacatgcacataaccagtgtgcttaaaatttttcagggccagataaacaaggtgttcatgtttgataagggatgttcctttctctgtgtttttggttttccgggcgaaaaggtacctgatgagttaacacacgctctggaatgtgcgatggatatctttgatttctgtagtcaggttcacaagattcagaccgtgagcataggtgtggcaagcggtatcgtgttttgcggaatcgtgggccatacagtgcgccacgagtacacagtgattggtcagaaggtcaatctggcggcacggatgatgatgtattatcccggcatcgtgacctgtgattccgtgacctacaacgggtcaaacctgccagcatatttttttaaggagttgcctaaaaaggttatgaagggtgttgcggactctggccctctttaccagtattggggaaggacggaaaaagtgatgtttggtatggcatgcctgatctgcaataggaaggaagattacccattgctcgggcgcaataaggagattaattacttcatgtacactatgaaaaagttccttatctctaattccagtcaagtcctgatgtatgagggcctgcccggttacggcaagtctcaaatcctgatgaagattgaatatttggcgcagggcaaaaaccatcggataatagccataagcctgaataaaatttccttccaccagacattttataccatacagatgtttatggctaatgtgctgggcttggacacgtgtaagcactataaggaaaggcagactaacctgagaaataaagtgatgacattgctggatgagaagttctattgtttgctgaacgacattttccacgtgcagttccccatcagtcgagaaatctcccggatgagtaccctcaagaagcagaaacagttggaaatcttgtttatgaagatactgaaacttatagtgaaagaggaacgaataatttttattatagacgaagctcaattcgtcgatagcacttcttggcggttcatggagaagctaatcagaaccttacctatctttattatcatgagcctgtgcccattcgtcaatattccatgtgctgcagcacgcgccgtgatcaaaaaccgaaatacaacctacatcgtgatcggtgctgtgcaacctaacgacattagcaataagatctgtctggatttgaacgtaagctgtatctctaaagagctggactcatatctgggcgagggaagctgcggtatccctttttactgcgaggaactgctaaaaaacctggagcaccatgaagtactggtatttcagcagacagaaagcgaggagaagacaaatagaacctggaacaatctttttaagtactctattaagctgaccgagaagctcaacatggtgacactgcattctgacaaggaaagtgaagaggtctgccatttgacatccggagtccgcttgaagaacctttctcctcctacttccctgaaggaaatttccttaattcaactggatagcatgcgcctgagccaccaaatgctcgtcaggtgtgctgccataattggcttgacttttactacagaactgttgttcgaaatcctgccatgttggaacatgaagatgatgattaagactttggccaccctggtggagagtaatatattttactgcttcagaaacggtaaggagttacagaaagccctgaaacagaacgacccaagtttcgaggtacactatagatctctgtctttgaagcccagcgagggcatggatcacggcgaggaagagcagcttcgggagctagagaatgaggtcattgagtgccatagaattcggttttgtaatcctatgatgcagaagacggcttacgaactgtggctgaaagaccagaggaaagctatgcatctcaagtgcgctcgtttccttgaagaggacgcgcacaggtgcgaccactgtagggggcgtgactttattccctaccatcacttcactgtgaacattagactcaatgcgttggatatggatgcgataaagaagatggctatgagccacggattcaaaactgaggaaaaattgatcctatctaattcagagattccagaaaccagcgccttcttcccagagaacaggtctccggaagagatccgtgagaagattttgaattttttcgaccacgtgctgacgaagatgaagacatccgatgaagatattattcccctcgagtcctgccagtgcgaggaaatactcgagatcgtgattctgccacttgctcaccatttccttgccttaggagagaacgacaaggctttatactattttctggagattgcctctgcttacctgatcttttgcgataactatatggcgtatatgtacctcaacgagggacaaaagttgcttaagaccctcaaaaaggataagagctggtcccagacttttgaatctgccacattctattcactcaagggggaggtctgtttcaacatggggcaaatagttcttgcgaagaaaatgctgaggaaggctcttaagctgttgaacaggattttcccatacaatctcatatctcttttcctccatatccacgtggaaaagaataggcactttcactacgttaataggcaagcacaggagtctccccctccaggcaagaagagactcgctcaactgtacaggcagacagtctgtctctcgcttctgtggaggatatatagctattcttacctctttcactgtaagtattacgcacacctggccgtgatgatgcagatgaacaccgccctcgagacacaaaactgtttccaaatcatcaaggcttatctggactactctctttaccaccacctcgccggctataaaggagtctggttcaaatacgaggtgatggccatggaacatatcttcaatctccctctgaaaggcgagggcatcgagatcgtcgcgtatgtcgccgagacgttggtgtttaacaagctgatcatgggccaccttgatttagccatcgagcttggatcccgcgccctccaaatgtgggcactcctgcaaaaccccaacagacattaccagtctctctgtaggttgtcccggtgtctgctcctgaactcacggtatccacagctgatccaggtattgggccggctttgggaactatcagtgacccaggagcatatattctccaaggcattcttctacttcgtttgcctggacattttgctgtacagtggatttgtctaccgcaccttcgaagagtgccttgagttcatccatcagtatgaaaacaaccggatacttaaatttcattcggggttactcctcggactgtacagtagcgtagcaatctggtatgccagactgcaagaatgggacaacttctacaagttcagcaacagagcaaagaatcttctacctcgtaggacgatgactctgacatattatgacgggatcagccggtacatggaaggacaggtcctccatctgcagaaacaaattaaggagcaatcagagaacgcccaggcgtccggagaagagttgctgaaaaatcttgagaacctagttgcccagaacactacagggcctgtgttctgtcctaggctgtaccatttgatggcttacgtatgcattcttatgggtgatggccaaaaatgcggtctgttcttaaacaccgctctgagactgtccgagacccagggaaatatccttgaaaagtgctggctaaatatgaataaggagtcttggtactctacatccgagttgaaagaagatcaatggctgcagaccattctctccctgcctagttgggaaaaaatcgtggcaggccgtgtcaatatacaggacctgcagaagaataagttcctcatgagggccaataccgttgacaatcacttctag

SEQ ID NO: 24251 - DNA, 4833 bp, Artificial Sequence
  Description of Artificial Sequence: Synthetic coding sequence
atgaatacccccaaggaagagtttcaggactggcccattgtccgtatcgcagcgcacttaccagacctaatcgtgtatggccacttttcacctgaacggcctttcatggattatttcgacggagtgctgatgttcgtggatatatcaggatttacagcgatgaccgaaaagttctcctcagcgatgtacatggatcgcggcgcagagcagctggtcgaaatcctgaattatcatataagcgcaattgtggaaaaagtgctgatcttcggaggtgacatactgaagttcgctggagatgcattgttggccctgtggagggtggagcgcaagcagctgaagaacatcatcacggtggtgatcaaatgctcgctggagatacatggcctgttcgagacccaggagtgggaagaggggctagacatccgggtaaagatcggacttgcggccggtcacatcagcatgctggtcttcggggacgaaactcatagccacttcctcgtgataggacaagctgttgatgacgtcagacttgcccagaacatggcccagatgaacgatgttatactctcacctaactgttggcaactctgcgatagatcgatgatcgaaatcgagtccgtgcctgatcagagggcagtcaaggtgaactttctgaagcctcctcctaactttaattttgacgaattttttaccaaatgtaccacatttatgcactactacccctctggcgagcacaagaatctgcttcgtctggcatgtaccctgaaaccagatccagagctggaaatgtccctgcagaagtacgtcatggagagcatcctcaagcaaatcgacaataagcagctccaggggtatctatctgaacttagacctgtgaccattgtcttcgtgaacctcatgttcgaggatcaggacaaggcagaagagatcgggccagcgattcaggatgcatacatgcatataacatccgtgctcaagatcttccagggacaaattaataaagtatttatgtttgataagggctgcagctttctttgtgtctttggcttccctggcgaaaaagtgccagacgagctgacgcacgccctggagtgtgccatggatatattcgacttttgttcccaggttcacaagatccagacagtctcaatcggtgtggcatctggtattgtgttctgtgggatcgtgggtcatacagtgagacatgagtacactgtgatcggacagaaagttaacctcgctgcacggatgatgatgtattacccgggcattgtgacatgcgactctgtgacctataatggctccaacttgcccgcatatttctttaaagaactaccaaagaaggtcatgaagggcgtcgccgattccgggccactttatcaatattggggacgcacggagaaggtcatgttcggtatggcctgcctcatttgcaatcgtaaggaagactatccgctcctgggaaggaacaaggagatcaattacttcatgtacaccatgaagaagttcttgatttccaattccagtcaggtcctaatgtacgaaggcctaccaggctacgggaaaagccagattcttatgaagattgagtacctggctcaaggcaagaaccacagaattattgctatcagtctgaacaaaatttcttttcaccagaccttttataccatccagatgtttatggcaaatgtgctgggtctggatacatgtaagcattataaagaacgccagacaaatctgagaaataaggttatgacactactggatgaaaagttttactgcctcttgaatgacattttccacgtgcagtttcccatttccagagagataagcaggatgagcaccctcaagaagcagaagcagctagaaattctatttatgaagattctgaagttgatcgtgaaggaagagcgaataatctttattatcgatgaggcccaatttgtagacagcacaagctggagatttatggaaaagctcatcaggaccctgcctatttttatcattatgagtctctgtccatttgtgaatattccttgtgccgccgcccgcgcagtgataaagaaccggaatacgacatatattgttattggggccgtgcagcctaatgatatctccaataagatctgtcttgacctcaacgtgtcatgtattagcaaagagctggattcctacctgggcgagggaagttgcggaatccctttttactgcgaagagctgcttaagaaccttgagcaccacgaagttctggttttccagcagactgagagtgaggaaaaaacaaatcgaacgtggaacaacctgtttaagtattctataaagctcactgaaaaactgaatatggtgaccctgcacagtgacaaagaaagtgaggaagtgtgtcatctgacaagtggtgtcaggctgaaaaatttgtcacccccgacaagtctgaaagaaatttcactgattcagctggattccatgcgactgtcacaccagatgctggtgaggtgcgctgccataatcgggctgacctttaccacagaacttctgtttgagattcttccctgctggaacatgaagatgatgattaagacgctcgctaccctggtggaatcgaacattttttattgttttcggaatggaaaggagctccagaaagccttgaagcagaacgaccccagctttgaggtgcattataggtcgctatcactgaaacctagcgagggcatggaccacggagaggaagaacaattaagagagttggagaatgaggtcatagagtgccacaggatcagattctgtaatcccatgatgcagaagaccgcctatgaattgtggctgaaggatcaacgcaaagcaatgcacttgaagtgtgccaggtttctggaggaggacgcccatcggtgtgatcactgtagagggcgcgactttattccctaccaccatttcactgtgaacattagactgaacgccctggatatggacgctatcaagaagatggccatgagccatggtttcaagacggaagagaagctcatcctatctaatagtgaaatcccagagacatcagcgttttttccagagaacaggagtcctgaagagatccgcgaaaaaattctgaattttttcgaccacgttttaacaaagatgaagacctcagacgaagacatcattcccctcgaatcctgccaatgcgaagagatcttagagattgtgatccttccgctcgcgcaccacttcttggccctgggagaaaacgacaaagccctgtattacttcttggagatcgccagtgcgtatttaatcttctgtgacaactacatggcatacatgtatctgaatgagggccagaaacttttgaaaactctcaagaaggataagtcttggagtcagacattcgagtccgcaacattttacagtttaaaaggcgaagtttgtttcaatatggggcagatcgtgttggccaaaaagatgctcaggaaggcactgaaactcctgaacagaatcttcccctacaatttaataagtctgtttctccacattcatgtggagaaaaaccgtcacttccattacgtgaacaggcaagctcaggaatcccctcctcccggcaaaaaacgcctggcgcagctttacagacaaacagtctgtctgagtctcctgtggagaatatattcctatagctacctgttccactgcaagtactacgcccaccttgcagtgatgatgcaaatgaacaccgcactcgagactcagaattgttttcaaatcattaaagcttacctggactacagcctctatcaccaccttgcgggttacaagggcgtgtggttcaaatacgaggttatggcaatggagcacattttcaatcttcctctgaaaggcgagggtattgagatcgtggcctacgtcgccgaaacactagtgtttaataagctcatcatgggtcatcttgacctagctatagagctgggatccagagccctgcaaatgtgggctttgctccagaacccaaaccggcactaccagtctctttgtaggctcagcagatgcttactacttaacagccgatatccacagctcatccaggtgcttggcaggctctgggagctaagcgtgactcaggagcacatttttagcaaggcttttttctactttgtctgcctcgacattctcctctattcaggcttcgtgtaccgaacctttgaggagtgcctcgaattcatccaccaatacgaaaataaccgtatcttgaaattccattcggggcttctcctgggcctatatagcagcgtagccatttggtacgcccggctgcaggaatgggacaatttctataagttctcgaatagggcgaagaatctgctcccccggcggaccatgacactcacctattacgatggcataagtagatatatggaggggcaggtgctccacttgcagaagcagatcaaggagcagagtgagaacgcccaagccagcggcgaagaactgctcaaaaatctcgagaacctcgtggcccagaacacaacaggtcccgtcttctgtcccagattataccatttgatggcctacgtttgtatacttatgggagatgggcagaaatgtggattgttcctgaacacagcactgcgcctcagtgagacccagggcaatatcctagagaagtgctggctgaacatgaacaaagaatcttggtacagtaccagtgagctgaaagaggatcagtggctacagacaatcctcagccttccttcttgggagaagattgtggccgggcgtgttaatattcaagacttgcaaaagaacaagttcctcatgcgcgctaacaccgtagataaccacttctag

SEQ ID NO: 24252 - DNA, 4374 bp, Artificial Sequence
  Description of Artificial Sequence: Synthetic coding sequence
atgctagtgtttggtgacgaaacacatagtcatttccttgttatcgggcaggccgtggacgacgtccgccttgctcagaacatggcgcagatgaatgatgtcatactgagcccaaactgctggcagttgtgcgacagatcgatgattgaaatcgagagtgtgcctgatcagcgagcagttaaagtcaattttcttaagccacctcccaacttcaatttcgatgaattttttaccaaatgtacgaccttcatgcattattatccaagcggggagcataagaacctattaagattggcttgtactctgaaacccgatccggaactcgaaatgagcctccagaagtacgttatggagtccatcctgaaacagattgacaacaaacaactgcagggctacctgagcgagttgcggcctgtcacaatcgtgtttgtaaatctgatgtttgaggaccaagataaagccgaagagatcggaccagctattcaggacgcatatatgcacataacttccgtgcttaagattttccaaggacagataaacaaggtgtttatgttcgataaaggttgttccttcctctgcgtctttggattccctggggagaaagtgcccgacgaactgacacatgccctggagtgcgccatggacatcttcgacttttgcagccaggtgcacaaaatccagacagtgagtattggagttgcctccggtattgtcttctgcggcatcgtgggccataccgtgcgacacgagtataccgttattggccaaaaggttaatctcgcagcgaggatgatgatgtactatccaggaatcgtcacgtgcgacagcgtgacttataatggcagcaacttgcccgcttatttttttaaggagctgcctaaaaaggtgatgaaaggtgtcgctgacagtggacctctgtatcaatactggggcagaaccgaaaaagtgatgttcggaatggcctgcctgatctgtaatcggaaagaggattatcctctgttagggcggaataaagaaatcaattattttatgtataccatgaagaagtttttgatctcaaacagctcccaggtcctgatgtacgaaggcctgcctggatatggcaagtcccagatactgatgaagatcgaatatttggcacagggcaaaaatcataggattattgccatcagcttgaataagatttcttttcaccagaccttctatacaattcagatgtttatggcaaatgtgctaggcctggatacctgcaagcactacaaggaaaggcagacaaacttacgcaataaagtcatgacgctgctggatgagaagttttactgtttgcttaatgacatttttcacgtgcagttccccatcagccgggagatttcacgtatgtcaacactgaagaagcagaagcaactggaaatactgtttatgaaaatccttaaactgatagtgaaggaagagcgaatcatttttattatcgacgaagcacagttcgtggacagcactagctggcgatttatggaaaaactgattcggacccttcccatctttatcataatgagcttgtgccccttcgtgaatatcccttgtgccgccgccagagccgtcatcaagaacaggaatactacatatatcgtgatcggcgccgtccagcctaatgacatcagtaacaagatttgcctggatctgaatgtcagctgtatctctaaggaactggattcttacttgggggagggttcgtgcggcattccattctattgtgaggaactgctgaagaatctagagcaccatgaggtgttagtctttcagcagacggagtccgaggaaaagaccaataggacatggaacaatctcttcaaatactcaataaagctaacggagaaactgaacatggtaaccctgcattcagacaaggaatctgaggaagtctgtcatctcacttctggcgtgaggctgaaaaacctgtctcctcccaccagcttaaaggaaatctccctaatccaactcgacagcatgcgactgagtcaccagatgctggtgagatgcgccgcaatcatcgggctgaccttcacaaccgagcttcttttcgaaatccttccctgctggaatatgaagatgatgatcaaaactctagcaaccctggttgagtccaacattttttattgttttaggaatggaaaggagctccagaaggcccttaaacagaatgaccctagtttcgaagtgcattaccgttctctgtccctgaagccctccgagggtatggaccatggcgaggaagaacagcttcgagaactcgaaaacgaggtgatagagtgccacagaatacgattttgcaacccgatgatgcagaaaactgcctacgaactgtggttgaaagaccagaggaaagctatgcacttgaagtgtgctcggtttctggaagaggatgcacatcgctgcgaccactgtcggggacgggacttcattccttaccaccactttaccgtgaacattcgcctgaacgctctggacatggatgccataaagaagatggccatgagccatggcttcaagaccgaggagaagctgattctgtccaattctgaaattcctgagacaagtgcattcttccccgagaaccgctctcctgaagaaattagagaaaagattctcaacttcttcgaccacgtgctaaccaaaatgaaaaccagcgacgaggatataatccccctggagagctgccagtgtgaagagattctggagatcgtgattttacccttggcacatcactttctggcccttggggagaatgataaggctttgtattactttctggaaatcgcatccgcctatttgatcttctgcgacaattacatggcctacatgtacctcaacgaaggacagaaactgctgaagactctgaaaaaagacaaatcttggagccagacatttgagtccgcaaccttctactccctcaagggcgaggtttgttttaacatgggccagattgtgctggccaagaaaatgttgcggaaggccttaaagctcttgaatagaatcttcccgtataatctcatcagtctgttcctgcatatccacgtggagaaaaacaggcattttcactatgtgaatcgccaggctcaggaatcccccccacctggcaagaagcggctggctcagctctaccgacaaacagtctgcctgagtcttttgtggcggatttacagctacagttacctgtttcattgcaagtactacgcccacctggccgtgatgatgcagatgaacacagcgttggagactcaaaactgtttccagatcattaaagcttatttggactactctctctaccaccaccttgcggggtacaaaggcgtttggtttaaatacgaagtgatggctatggagcacatctttaaccttcccctcaagggagaagggatcgaaatcgttgcttatgttgccgagaccctcgtgtttaataagctgatcatggggcatcttgacttggccatcgaactgggcagtagagcccttcagatgtgggccctccttcagaatcccaatcgccactaccagagcctttgccgattgagccgctgtctgctgctaaactcaaggtaccctcagctgatccaagtgttggggcgtctttgggagctgtcagtaactcaggaacatatcttctctaaagcgtttttctatttcgtgtgtttggatatactgctatatagtggattcgtgtacaggacatttgaagagtgcctggagttcattcaccaatatgagaacaacaggatcctgaagtttcacagtggcctgctgctcggtctgtattcctctgtggccatttggtatgcccggctccaggaatgggacaatttctataaattctctaatcgggccaagaacctgctacctcggaggactatgactctgacttactatgacgggatctcacggtacatggagggacaagttctccatctgcagaagcagattaaggagcagtccgagaacgcccaggcgtctggggaagagcttctaaaaaatttggaaaacttagtcgcacagaataccaccgggccagttttctgtccccgtctgtaccatctaatggcatacgtgtgtatattaatgggagatggacagaagtgcggtctgtttctgaataccgccctgaggctgtcagagacacaaggcaacatccttgagaaatgttggctgaacatgaacaaagagtcctggtattcaactagcgagctgaaggaggaccaatggctgcagaccattctgtccctgccgtcctgggagaaaatcgtggcaggcagagtgaatattcaagatctgcaaaagaacaagttcctaatgcgagccaacactgttgacaaccatttctag

SEQ ID NO: 24253 - DNA, 672 bp, Artificial Sequence
  Description of Artificial Sequence: Synthetic coding sequence
atggcttcaaaactgctgcgagccgtcatcctcggacccccgggatctgggaaggggacagtgtgccagcgtatcgcgcaaaatttcgggcttcagcacctctccagcggacacttcctgagagagaacatcaaggcctccacagaggttggcgagatggcaaaacagtacattgagaaatctctactggtgccagatcatgttatcacgcgtctgatgatgtccgagctggagaataggcgggggcagcactggttgctcgacggctttcctcggactctgggccaggccgaggccttggacaaaatttgtgaggtggatttggttatctctctgaacatccctttcgagacacttaaagaccgattgagtagacgttggatccaccccccctctgggcgggtttacaatcttgactttaatccgccccacgtccacgggatcgacgacgtgacaggggaacctctggtgcagcaggaagacgacaagcccgaagctgtagctgcgcgacttcgccagtataaggacgtggctaaacccgtaattgagctctacaagagtagaggggtcttgcatcagttctcaggaacagagacgaacaaaatctggccctacgtctatactttgttcagcaataaaattacaccgatccagtcaaaagaggcatactag

SEQ ID NO: 24254 - DNA, 672 bp, Artificial Sequence
  Description of Artificial Sequence: Synthetic coding sequence
atggcaagcaagctgctgcgcgctgttatcctcgggccacccggcagtggtaaaggcactgtgtgtcagcgtatcgcccagaactttgggctgcaacatctctcttcgggtcacttcctgagggagaacatcaaggcatctacagaagtgggagagatggctaaacagtacatagagaaaagcctgctggtgccagatcacgtgattaccaggctcatgatgagtgaattggagaaccgccggggtcaacactggctgttggacggtttcccaaggaccttaggtcaggcagaggcactggataaaatttgtgaggtcgatctggtcatcagcttgaacattcctttcgagacacttaaggaccgcctgtcacgaaggtggatacacccaccttctggtcgggtctacaatctggatttcaatccaccgcatgtccatgggatcgacgacgttacaggcgagccactggttcagcaggaggatgacaagcctgaggctgttgccgctcgactccgccagtataaagacgttgccaaaccggtgattgaactgtataagtcgagaggcgtgttgcatcagtttagtggtactgagaccaacaaaatatggccatatgtgtataccctattttccaataagatcacgcccattcagagcaaagaagcgtactag

SEQ ID NO: 24255 - DNA, 672 bp, Artificial Sequence
  Description of Artificial Sequence: Synthetic coding sequence
atggcatcaaaacttttaagggccgtaattctagggccacctggtagcggaaagggaactgtgtgccaaaggatcgcacagaactttgggcttcagcacctgtcctccggacacttcctcagagagaacatcaaggctagcactgaggttggggagatggcaaagcaatacatcgaaaaaagtctgctcgtgcccgatcatgtaatcacacgcctgatgatgagcgagctggaaaatcgccggggacagcactggctgcttgacgggttcccaagaaccctcgggcaggctgaggcactagataagatctgcgaggtggacctggtgatatcgcttaacatcccatttgagaccctgaaggacaggttatccaggcggtggatacatccgccctccgggcgagtctacaacctggacttcaatccaccccacgtgcacggaatcgacgatgttacaggcgagcctttagtccagcaggaagacgataagcctgaagccgttgccgcccgtcttcgccagtacaaggatgtcgccaaacccgtcatcgagctctataagtccaggggagtcctgcatcagttctcaggtaccgaaacgaataaaatctggccgtacgtgtacaccttgttctccaataaaattacccctatccaatccaaggaagcctattag

SEQ ID NO: 24256 - DNA, 1482 bp, Artificial Sequence
  Description of Artificial Sequence: Synthetic coding sequence
atgcacccacaccgcgaccccagagggctgtggctgctactcccgtctctgagccttctactgtttgaggtggctcgggcaggcagggccgtggtcagctgtcccgccgcttgcttgtgtgcttctaatattttatcgtgtagcaagcagcagctcccaaatgtgccacactccttaccttcctacacagctctgctggacctcagccacaataaccttagcaggctcagggcggagtggactcctacgcgcctgacgcagctgcattcactcctgctgagccataaccacctcaacttcatctcatccgaggcattcagtccagttcctaacctgagatatctggatctcagctctaaccaactgagaaccctcgatgagttcctatttagtgatcttcaggtgttagaagtactcctcctgtataacaatcatatcatggccgtggataggtgcgccttcgacgacatggcacaattacagaagctgtacctctcgcagaatcaaatcagcagatttccactggagctcgtcaaagaaggggctaagctgcccaagttgaccctgctggacttgtcgagtaataagctgaaaaacctgccactgcctgatctccagaagcttcctgcatggataaaaaatggactgtatctgcacaacaatccactgaactgcgattgtgaactgtatcagctcttctctcactggcagtaccgccaactgtcctccgtgatggacttccaggaggatctctactgtatgaattctaagaaacttcacaacgttttcaatctgtcctttcttaattgtggcgaatataaggagagggcctgggaggcacacttaggtgacaccctgatcatcaaatgtgacactaagcagcaggggatgaccaaagtatgggttactccgagcaacgagcgcgtgcttgatgaggtgaccaatgggacagtgtctgtttctaaagacggaagccttctgttccagcaggttcaggtggaggatggaggcgtatacacgtgctatgctatgggcgagacgttcaatgaaaccctgtctgtagagcttaaggtccataatttcactctacacggccaccacgacacacttaacacggcttatactacacttgtggggtgcatcctctctgtggtgctggtgctcatatacctttacctgacaccctgtcgctgttggtgccgaggagtggagaagccaagtagccaccagggggacagcctcagctcttctatgctttccaccacacctaaccacgaccccatggctgggggagataaggacgacggcttcgacagacgtgtggcattcttggagccggcaggcccaggtcagggccagaatgggaagttaaagcccggaaatacactgcccgtgccagaggctacggggaaagggcagcgaagaatgtccgatccagaatcagtgtccagtgtgttttcagatacacctatcgtcgtttag

SEQ ID NO: 24257 - DNA, 1482 bp, Artificial Sequence
  Description of Artificial Sequence: Synthetic coding sequence
atgcacccacatcgagaccctcgagggctctggctgttgttgccatctctgtccttgctgctgttcgaggtcgccagggccgggcgggctgtggtgagctgccctgccgcctgcttatgtgcttcaaacatcctctcttgctctaaacaacaacttccaaacgtgccccattcactcccgagttatacggctctcctggacctgagtcataataatctctcacgactcagggctgagtggacacccacaagactgacacaactgcatagcctcctgttgtctcacaaccacttaaactttatcagctccgaagcttttagcccagtacccaatctgcggtacctggatctgtcctctaaccagctgaggaccctggatgagtttctttttagcgatctccaggtgctggaggtcctcctcctctacaacaaccacatcatggctgttgacaggtgcgcttttgacgacatggcacagctacagaaactatatctatctcagaaccagatctctcggtttcctcttgagcttgttaaggaaggtgccaagcttccaaagttaaccctgcttgacttatcctccaacaaattgaaaaatctgcccctgccggatctgcagaaactcccagcctggattaagaatgggctgtatctccataataaccctctgaattgtgactgtgaactgtatcaactgttttcacactggcaatatagacagctgtcatctgtcatggatttccaggaggatctctactgtatgaattcgaagaagctgcacaatgtgttcaatctatctttccttaactgtggcgagtataaggagcgggcctgggaggctcatctcggagataccctgatcatcaagtgcgatactaagcagcagggcatgacaaaagtctgggtgactcctagtaatgagagagtgttggatgaggttactaatggcacggtctcagtgtcaaaagacgggtcactgctctttcaacaggtgcaggtggaagacggcggtgtctacacctgttacgccatgggggaaacttttaacgaaaccctttccgtcgaactaaaagtgcataacttcaccctgcatgggcatcacgacacactcaacacagcctacaccacactggtcgggtgtattttatccgtggtgttggttctgatctacctgtacctaaccccttgtagatgttggtgcaggggcgttgagaaaccttcatcgcaccagggggactcgttgtccagtagtatgctgtcaacaacgccaaaccacgaccctatggccggcggtgacaaagatgacggatttgacagaagggtggcatttctcgaacccgctgggcctggacaaggccagaacgggaagctgaagccaggcaatacattgccagttcctgaagccacaggaaagggccagcgcagaatgagcgacccggaatctgtgtcctctgtcttttcggacacccccatcgttgtatag

SEQ ID NO: 24258 - DNA, 1569 bp, Artificial Sequence
  Description of Artificial Sequence: Synthetic coding sequence
atgtcactcagagtccatactctacccaccctgctcggtgctgtcgtgcgcccggggtgtcgggaactgctgtgtctgctgatgatcacagtgaccgtgggccctggggcttcaggagtgtgccctacagcatgtatttgtgcaactgacatcgtctcatgcaccaacaaaaacctaagcaaggttcctggaaatttgttcagactcatcaaaaggctggacctctcatataatagaatcgggcttctggacagtgagtggattcctgtctccttcgccaagttaaatacactcatactcaggcataataacatcacatccatttctaccggatcattttctactacccctaatctgaagtgtctggatctgtcttccaacaagctcaaaactgtaaaaaatgcggtgttccaggaactaaaagtgcttgaagtgcttttgttgtacaacaaccacatttcatacctagatccttcagcatttgggggactgagccagttgcaaaagctatacctgagcggtaattttctcacccagttcccaatggatctctacgtcggcagatttaagctggcagaactgatgtttttggacgtctcttataaccggattccttccatgcccatgcaccacattaatctggtgccaggtaaacagttacggggaatttatctccatggaaatcctttcgtgtgcgactgctccctttacagcttattagtcttttggtaccgccggcactttagctctgtgatggacttcaagaatgattacacctgcaggctgtggtcagacagccgacattctcgccaagtgctcctgctgcaagacagctttatgaattgcagtgactctatcatcaatgggagcttcagggcattgggcttcatccacgaagcgcaggtgggagagaggctcatggttcactgtgattctaagactgggaatgctaataccgatttcatctgggtaggaccagataacagacttctggaaccagataaggagatggagaacttctatgtcttccacaacggatctctggttatcgagtccccaagatttgaggacgctggggtttactcctgcatagccatgaataagcagagactactaaatgaaaccgtggatgtgacgatcaacgtatccaactttacggtcagcagatctcacgcccatgaggctttcaacacagccttcaccactctcgctgcgtgtgtagcgagtatcgtactcgtccttctgtatctttacctcaccccttgcccatgcaagtgtaagactaagaggcagaaaaacatgctgcaccaatcaaatgcccattctagcatcttgtcccctggccctgcatctgacgcctcggctgatgagagaaaggctggagccgggaagagggtagtgttcttggaacccctgaaggacactgctgctgggcaaaacggcaaggtcaggctatttcccagtgaggcagtaatcgccgaaggtattctcaaatcaacacgcggcaagtcagatagcgactcagtgaatagtgttttctcggacacccctttcgttgcctcaacttag

SEQ ID NO: 24259 - DNA, 1569 bp, Artificial Sequence
  Description of Artificial Sequence: Synthetic coding sequence
atgagtctgagagtccacacactgcctacactgctcggcgccgtcgtgaggcctggctgtagggaactcctgtgtctgctgatgatcactgtgacagtgggccccggcgcatctggagtctgcccgacggcctgtatctgcgccaccgatattgtctcctgcactaataagaacctgagtaaagtgccaggaaacttgttcagacttatcaaacggttggacctcagttacaacaggatagggctgctggactctgagtggatccccgtaagcttcgctaagctaaacactctaatacttcgccacaataatatcacctccatttccactggatccttctcgactacaccaaatttgaagtgtctcgatctctccagtaacaagctcaaaactgtgaagaacgctgtgtttcaggagcttaaagtgctagaggtgttgctcctgtacaacaatcatatatcttatttggatccatccgcattcgggggtctctcacagctgcaaaagctgtacttgagtggtaatttcttgacgcagtttccaatggatctctatgtcggccgcttcaaactggctgagctcatgtttctggatgtttcctataatcgcattccttctatgcctatgcaccacataaatctggtgcctgggaagcagctgcgcggtatctatctgcacgggaacccattcgtttgtgactgctcactttactccttgctcgtgttttggtatcgtagacacttcagcagtgtgatggactttaagaacgactatacctgccgcctctggagtgacagtcggcattcgaggcaggtcctcctcctgcaggacagttttatgaactgttccgactccatcattaatggatccttccgggcactcgggttcattcatgaggcccaggttggcgaacgcctcatggtccattgcgattctaagactgggaacgctaatacagactttatatgggttggtcccgataatcgattactggaacctgataaagagatggagaatttttacgtgttccataacggtagtttggttatcgagtcacctagattcgaggatgcaggggtgtactcctgcattgctatgaataagcagcgcctcctgaatgaaacagtcgatgtaacaatcaacgtgtccaacttcaccgtgtctcggtcccacgcacacgaagctttcaatacggcttttaccactctcgctgcgtgtgtggcaagtatcgtgcttgtactgctgtatttgtacctgacaccatgcccatgtaaatgtaaaaccaaacgacaaaagaatatgctacaccagtcaaacgcccatagttccattttgtctcctggacctgcctcagatgcatcagccgatgaacgaaaagcaggcgccggtaagagggtggtcttcttggagcccctgaaggacacagccgccgggcagaatgggaaggtaaggctgtttccctcggaggcagtcatcgctgagggtattctgaaatcaactagaggaaaatccgactctgactctgtcaactcagtcttcagcgacacaccattcgttgcctctacatag

SEQ ID NO: 24260 - DNA, 1569 bp, Artificial Sequence
  Description of Artificial Sequence: Synthetic coding sequence
atgtccctcagagtccacactctgcctaccctgctgggggctgtcgtaaggccaggatgccgcgaactgttgtgcttgcttatgataacggtcaccgtgggaccaggcgcctccggagtgtgcccgacagcatgcatttgtgcaacagatattgtatcctgcactaacaaaaatttatctaaagtgcccggtaaccttttccgcttgattaaaaggctggacctctcctacaaccggattggcctgcttgattctgaatggattcctgtgtccttcgccaagctaaatacactcatcttgagacataacaacatcacgtctattagcactggctctttctcgactactccgaatctcaagtgtctggacctgtcctccaacaaactcaaaacagtaaagaacgccgtgttccaggagttaaaagttctggaggtgctattgttgtataacaaccacatcagctatctagatccctctgcttttggtggactaagccaactgcaaaaactctacctgtccgggaatttccttactcagttcccaatggacctctacgtcgggcgttttaagctagcggagttaatgtttctggatgtgagttacaacagaataccatctatgcctatgcaccatataaacttagtgcccggcaaacagctccgaggcatctaccttcatggtaatccctttgtgtgcgactgtagcctgtactcactactggttttttggtatcgacgtcacttcagttcggtcatggatttcaaaaacgactacacttgccgactgtggtccgactccagacactcccgccaggtactcctgttacaggattcctttatgaactgtagcgattctatcattaatggatcatttagagcattaggcttcattcacgaagcgcaggtgggtgagaggctgatggtccactgcgacagcaagacaggaaatgcgaacaccgacttcatatgggtcgggcctgataatagattactagagcctgacaaggagatggagaatttctatgtcttccacaacggctctctggtgattgagtcccctcggttcgaagacgcaggtgtgtattcctgcattgcaatgaataaacagcgactgctgaacgagacggtggacgtgaccattaacgtcagcaattttaccgtcagtcgatcccatgcgcacgaagccttcaatacggctttcacgacactagctgcttgtgtggcctcgattgtccttgtgttgctgtatctgtacctcacaccctgcccctgcaagtgtaaaacaaaaaggcagaaaaacatgctccaccagtcgaacgcacacagctctatcctctctccaggaccagcctccgacgcatcagcggacgagaggaaggctggggccggaaagagagtcgtctttctggaacccctgaaagataccgccgccggccagaacggcaaagtgagactgttcccttcggaagctgtgattgcagagggcatcctgaaatccacccggggcaaatcagattccgattctgtaaattccgtattttctgacaccccctttgtcgccagcacttag

SEQ ID NO: 24261 - DNA, 1569 bp, Artificial Sequence
  Description of Artificial Sequence: Synthetic coding sequence
atgagcctgagggtacacaccctgcctacattgctgggagctgtggtaagaccaggatgcagagagctgctctgcctgttaatgattaccgtcacagtcggtccaggggctagtggcgtctgtccaaccgcatgcatttgcgctactgacatcgtttcttgcacaaataagaatctgtccaaagtgccaggcaatttgtttcgactgattaagcgcctggacttgtcttacaaccggatcggcctgctggattcagaatggataccagtttcatttgcaaagctgaacacactgatcctccggcataacaacatcacgtcaattagcacaggctccttctcaactacgcctaatctcaagtgcctcgatctgtcttctaacaagctgaagaccgttaaaaatgccgtttttcaagagctgaaagtgcttgaggtgctcctcttatataacaaccacataagttacctcgatccatcagccttcggtggcttatcacagttgcaaaaactctatctttctggtaattttctgacacagtttccgatggacctgtacgtgggtcgctttaagctagccgaactcatgtttctcgatgtgagttataatagaataccttctatgcctatgcaccatatcaatctggtacctggaaaacaattacggggtatctatctgcacggtaacccttttgtgtgtgactgttctctttactctttgttggtcttctggtatagacgccatttttcaagtgttatggattttaagaatgattacacatgccgattatggtccgatagccggcattcaagacaagtcctgctactccaagattcttttatgaactgtagcgatagtattattaatggtagctttcgcgctctggggttcatccacgaggctcaagtcggtgaacgacttatggtccattgtgactccaagacagggaatgccaataccgactttatctgggttgggcctgacaatagactgctggagcccgataaagagatggagaacttttacgtgttccacaacggaagcttagtcatcgagtccccccgctttgaggacgccggtgtctactcatgtatcgcaatgaacaagcaacgactgctgaatgaaaccgttgacgttactatcaacgtgtctaatttcaccgtgtctcgctcacacgcccatgaggcatttaacacagcttttaccactctcgctgcatgtgtcgcttcaatcgtgctggtactgttgtacctgtatctcaccccatgtccatgcaaatgcaaaactaagaggcagaagaatatgctacatcaaagcaatgcacactcttccatcctgagtcccggtcccgcttcagatgcctctgcagacgagcgcaaagccggggctggtaagcgtgtcgtattcctcgagccgctgaaagacacagccgccgggcaaaatggcaaagtcagactctttcccagtgaagcagttattgcagagggcattctgaaaagcacccggggtaaatcggactctgatagcgtgaactccgttttctccgacaccccattcgtcgcctccacatag

SEQ ID NO: 24262 - DNA, 1515 bp, Artificial Sequence
  Description of Artificial Sequence: Synthetic coding sequence
atgacatggctggtactcttgggcacactgctttgcatgttgcgagtcggtctaggcacccccgattcagaaggatttcctccaagagcattgcacaattgcccttataagtgtatatgtgcagctgacctcctgagctgtaccggactcggcctgcaggatgtgcccgcggaactcccggccgcaactgcagaccttgaccttagccacaacgctctgcagagactgaggcctgggtggttagctcccctcttccagctgcgggctctacatcttgatcacaatgagctggacgctcttggcagaggagtgtttgtgaatgccagtggccttcggcttctggatctgagctctaacactctgagggcgcttgggcggcacgacctcgatggcttgggggcattagaaaagctactgctgtttaataacaggttagtccacttggacgaacatgccttccacggtttgcgagctttgtctcatctctatctcgggtgcaatgagctggccagttttagttttgaccatctccacggattatccgctactcacctcctgacgttagacctcagctctaaccgcctcggccatatctccgtacccgaactggctgcgctgcctgcctttcttaaaaacggactttatctgcacaataatcccctgccgtgcgattgtcgcctgtatcacctcctccaaagatggcatcagcgggggctgtccgccgttagggacttcgccagggaatacgtatgtcttgcattcaaagttcccgcttcacgagtacgattttttcaacacagccgcgtcttcgaaaactgctccagtgccccagccctggggctggaacggccagaggagcacctatacgctctagttggccgatctctccgcctctattgtaatacctcagttcccgctatgcgaatagcgtgggtgagcccacagcaggaactgctcagagctccgggcagcagggacggcagcattgccgtgctggccgatgggtcgctggctatagggaacgttcaggagcagcatgccgggctgttcgtgtgtctagctaccggcccaaggctgcatcacaatcagactcacgagtacaatgtgtcagttcactttcctagaccagaaccggaggcgttcaatacaggatttacaactcttctcggctgtgccgtggggctcgtcctcgtcctgctgtacctgttcgcaccaccttgccgctgttgccgaagagcttgcagatgtagacgttggccacagaccccctccccgctccaggaactctcggcacagtcgtctgtgctttctactactccgccggacgccccctctcgcaaggccagcgtgcacaagcacgtagtttttcttgaacctgggcggcgcgggctgaatgggcgggtgcagttggctgtggccgaggagtttgatctgtataacccgggcggcctgcagctgaaggctggcagcgagtctgccagtagcattgggtctgaagggcctatgactacctag

SEQ ID NO: 24263 - DNA, 1515 bp, Artificial Sequence
  Description of Artificial Sequence: Synthetic coding sequence
atgacctggcttgtgctgctgggaaccctcctgtgtatgctacgggtggggttaggcactccagatagcgagggctttcctcccagagcgttacacaattgtccgtacaagtgcatatgcgctgccgacttgttatcctgcaccggactgggactccaggatgtgcccgccgaactgcctgccgccacagccgatttggatctctcccataatgccctgcagagactgcgcccgggctggttggcgcccttgttccagctgcgagctttgcacctcgatcacaatgaactggatgcgctaggccggggggtctttgttaatgcctcgggcctacggctccttgatctgtcaagtaatacactgcgcgccctggggagacatgacctcgacggcctgggcgctctggaaaaacttcttctattcaacaaccgcctggtgcacttagatgaacatgcttttcacgggctgcgtgctctgagccacttgtatcttggttgcaatgaacttgcttctttctcgttcgatcacctccacgggttgtcagctacacacctgcttaccctggatctctcctccaatcggttagggcatatcagcgttcccgaactggcagcccttccagcttttcttaagaatgggctctatttgcataataatcctctgccatgtgattgtcggctctaccacttgctacagaggtggcaccagagaggcctatccgccgttcgtgacttcgcccgcgagtatgtatgcctggcctttaaagtgcccgcgtctcgtgtaaggtttttccagcactctcgcgtctttgagaattgctctagcgcccctgctttgggcctggaacgaccggaggagcatctgtacgccctagtcggacggagtttgcgactgtactgtaatacatccgtgcccgcaatgaggatcgcatgggtgtcgccacaacaagaactgcttagagccccaggttcacgggacggcagcattgccgtgctggccgatggcagcttagctattggtaatgtccaggaacagcacgcaggtctgtttgtctgcttggcgacagggcctcgcctgcatcataaccagactcacgagtacaatgtgagcgtgcacttccctaggcccgagcccgaggcttttaacaccggctttaccacactccttgggtgcgctgtcggcttggtgctggtgctgctctacctgttcgccccaccctgtagatgttgccgaagggcatgccgatgtcggaggtggcctcagaccccttctccactccaagagctgagtgctcagagctcagtgttgtccacaaccccaccagacgccccttcacgaaaggcatctgtgcacaagcacgtggtttttctggaacctggtagaagaggcttgaacggacgcgtccaacttgctgtcgcagaagagttcgacctgtacaatccgggcgggctgcaattaaaggccgggtctgagagcgccagctccattggatcggagggcccaatgacaacttag

SEQ ID NO: 24264 - DNA, 1224 bp, Artificial Sequence
  Description of Artificial Sequence: Synthetic coding sequence
atgacaacatccggcgccctgtttccttcactggtgcccgggagtagaggagcaagtaataagtacctggtggagttccgggcaggtaaaatgagcctgaagggaaccacagtcactcctgataagaggaagggcctggtttacattcagcaaaccgacgacagtttaatccacttctgttggaaagacaggacctctggaaacgtcgaagacgatttaatcatctttcctgacgattgcgaatttaaaagagtgccgcaatgcccttctgggcgcgtgtacgtgctgaagtttaaagccggctccaaacggttgttcttctggatgcaggaaccgaaaacagaccaagacgaagaacactgccggaaggtgaacgagtaccttaataaccctcccatgccaggggccctgggggcgtctggcagtagcggacacgagttgtctgcactgggcggggagggggggctgcagagccttctcggaaatatgagtcacagccagctgatgcagctcatcgggcctgcaggcctgggcgggcttggggggttaggcgctctgactggccctggtttagcctctctcctaggaagctcaggtcctcctggatcttcgagtagcagcagttccaggtcccagtctgcagccgtgaccccaagctccacgaccagctccaccagggctacacctgcaccgagcgcccctgcagctgccagtgccacgtctcccagcccggcaccatcaagcggtaacggggcatcaaccgccgcttcacccacccagcctatacagctgtcagacttgcaatcaatcctagccacgatgaacgtgcccgccggcccagccggcgggcaacaggtggacctcgccagcgtgctgacccctgaaatcatggccccgatcctggccaatgcggacgtgcaggagaggctgctgccttacctgccgagtggagaatcgctgccacaaacagccgatgaaattcagaatacacttactagccctcagtttcagcaggccctgggaatgttttccgcagccttggcatccggccagttgggacctctgatgtgccagttcggtctaccggctgaagctgtcgaagccgccaacaaaggagacgtcgaagccttcgccaaggctatgcaaaacaatgccaagccagaacagaaagaaggcgacaccaaagacaagaaggacgaggaggaagatatgtcattggactag

SEQ ID NO: 24265 - DNA, 954 bp, Artificial Sequence
  Description of Artificial Sequence: Synthetic coding sequence
atgacaacatccggagccctgtttccgagcctcgtacccggctcacgaggcgcctccaacaagtatctggtcgagttcagggccgggaaaatgtccctcaaaggcaccacagtcaccccagataaacgtaaaggactggtgtacattcaacagactgatgatagcctcatccacttctgctggaaggacagaaccagtggtaatgtcgaagatgacttgatcatctttccagatgattgcgagttcaagcgggtcccgcaatgtccgtctggccgtgtttacgtgctgaagtttaaagctggaagtaagagactttttttttggatgcaggagcccaagacagatcaagatgaagaacattgtcgcaaagtgaatgagtatctcaataacccgcccatgcctggcgccttgggtgcgtctggctcctccggtcacgagctgagcgcacttggcgcagggggcctcggcgcactgacaggtccaggactggcctcactcttggggagttctggccctccgggcagctctagcagttccagcggggctctgtcattgagaagttcccgctcccagagtgctgccgtgactccgtcttccaccaccagctcaacccgggctactcctgcacctagcgcacccgcagccgcttctgcaaccagcccaagcccagcgccttccagtggaaatggagctagcaccgcggcgtcacccactcagcctatacagctgtctgacctccagtctatcctggctactatgaatgtgccagctggtccagctggtggccagcaggtcgacctggcctcagtcctgaccccagagataatggccccaattctggccaacgccgacgtacaggagcgcctgcttccttacctcccttctggcgaatccttaccacagaccgccgatgagatccagaatacactaacatcgccacagttccagcagtag

SEQ ID NO: 24266 - DNA, 243 bp, Artificial Sequence
  Description of Artificial Sequence: Synthetic coding sequence
atgaaatatcctttaatgcccctggttaacgatcttacattcagtttcctcgtcttttggttctgcttacccgtgggcctcctcctgctcctgatcatctggttacggtttcttctgagccaggactcagaggaaaatgatagctccgtctgtctggactgggagccttggagcaagggacctgcagaattctgttggaagggaactctgcatggccaggaaaaagagcggccctgttggtag

SEQ ID NO: 24267 - DNA, 579 bp, Artificial Sequence
  Description of Artificial Sequence: Synthetic coding sequence
atgcctttggtgaacgacttaactttttcctttctggtgttctggttctgcctgcctgtcggccttctgctgcttctgataatttggttgagatttctgctgagccaggatagcgaagagaatgactcttcagtgtgcctcgattgggagccatggtcaaagggccccgctgaattttgctggaaaggtactctgcacggtcaggagaaagagcggccatgctgtcttgtgttcctggaatcagctgggcagtggcaatggcagaagtggatgggagagacttgccagggcggcaagcggaccctggccaccgtggtgcctccatggaacccacaactgattagttctagcgatcggcatgtgaaagccagtcgcgggccatccccatctcctgccagccagatgacaagttcaccggctgggtcgcggtcttcgttgggtggccacggttcttccgaacaggcccatggggagaagttggccaacttaatccagcgggggcttaaggcgggcctggggagaagggtttgggtgcacatcaaggaagcgagggtttttccataccctggagatccttag

SEQ ID NO: 24268 - DNA, 1026 bp, Artificial Sequence
  Description of Artificial Sequence: Synthetic coding sequence
atgactgatggtattctcggcaaagcagctaccatggaaattcccatccacggaaatggggaggccaggcaattgcccgaggacgatgggttggaacaggacttacagcaagtgatggtgtcgggccctaacctaaacgagacgtcaatcgtgtccggagggtatggaggctccggagatgggctgatccctaccggatccggccgacaccccagccacagcactactccctctgggccaggtgacgaagtggctcgagggattgcgggcgaaaaatttgatatagtcaagaagtgggggattaacacatataagtgtacaaagcagctgttatcggagcgattcggacgaggcagccgtaccgttgatttggagctcgaactgcagattgagttgctgcgagagacaaaaaggaagtatgagtccgttctgcagttgggccgagcactcacagcccacctgtactccctcctccagacgcagcatgcactaggagacgcatttgccgacctgtcgcagaaatcacccgaactgcaggaggagtttggctacaacgccgaaactcaaaaacttttgtgcaagaatggggagacgctgctgggagccgttaattttttcgtcagtagtatcaataccctggttacaaaaacaatggaagatactctcatgactgtgaagcagtacgaggccgcacgactcgagtacgatgcgtaccggacagacctagaggaactctccctcggacctagggacgcggggacaagagggcgactagagagtgcccaagctacatttcaggcgcacagggataagtacgaaaagcttcgcggtgacgtcgcgattaagctgaagtttctcgaagagaataaaatcaaagtgatgcacaagcagctgcttctgttccataacgcagttagcgcctattttgccggcaaccagaagcagctggaacagactttgcagcagtttaatattaaactgaggcctcctggcgccgagaagcccagttggctggaagagcagtag

SEQ ID NO: 24269 - DNA, 1026 bp, Artificial Sequence
  Description of Artificial Sequence: Synthetic coding sequence
atgaccgacgggatcctggggaaagctgccacaatggaaatccctatacatggaaatggcgaagcaagacaactccccgaggatgacgggttagagcaggatctgcaacaggttatggtgtccggaccaaacttgaatgaaaccagcattgtaagcggcggctatggcggctctggcgacggcttgatccctacggggagtggcagacatccatcacacagtacaacaccgagtggtccaggagacgaggtcgctagaggaatcgcaggcgagaagttcgatattgtaaaaaagtggggtataaacacctacaagtgcacaaagcaactcctaagtgagcggttcggcaggggaagtagaacagtagatctggaattggaactccagatcgagttactcagagaaactaagcgaaagtatgagtccgtcctgcaacttggacgcgctctgactgcacatctttattcgctgctgcaaactcagcatgccctgggagacgcctttgcagatttatcacagaaatctccagaactccaggaagagttcggttataacgccgagacccaaaaactgttatgtaagaatggcgaaacattgttgggcgccgtcaatttcttcgtgtccagcattaacacactggtgactaaaaccatggaagataccttaatgactgttaagcagtatgaagcagcccgactggagtacgatgcctaccggaccgatcttgaagaactgtctctaggccctagggacgcgggtacccggggtaggctggagagtgcccaagctacattccaggcacacagagacaagtatgaaaagctgcgcggagatgtagctataaaacttaaatttctcgaggagaataagatcaaggtgatgcacaaacagttacttttattccataacgccgtgtcagcctacttcgctggaaaccaaaagcaactggagcagaccttgcaacagttcaacatcaagctccggccccccggggctgagaaacctagttggctggaagagcagtag

SEQ ID NO: 24270 - DNA, 912 bp, Artificial Sequence
  Description of Artificial Sequence: Synthetic coding sequence
atggtcagcgggccaaaccttaacgagacatctattgtgagcggtggttatgggggttctggagatggactgattcccactggatcgggtagacatccaagccattctaccacccctagtggtcccggcgatgaggtggcacgcggaatagcgggcgagaagtttgacattgtcaagaaatgggggatcaacacttataagtgcacgaagcaattactgtccgaacggtttggaaggggctcccgcaccgttgaccttgagctcgaactgcagattgagctactgagggaaacaaagcgtaaatacgaaagcgtgctacagctcggtagagcgctgacagcccacctgtacagcctgcttcagacgcagcatgctcttggagacgcattcgccgacctgagccagaagagccccgaactgcaggaagaatttggctataacgctgagacgcagaaattgctgtgcaaaaacggcgaaacgctactgggcgctgtgaacttcttcgtatcttcaataaatacactggtgaccaaaaccatggaagatactcttatgactgtcaagcagtatgaagccgctagattggagtacgacgcatacaggacggatctggaggagctgtcattggggccacgggatgctgggacccgcggtcggttagagagcgctcaggctacattccaggcccatagagacaaatacgagaagctgcgtggggacgtcgcaatcaaactgaagttcctcgaggagaataaaatcaaggttatgcacaagcagctgcttttgttccataatgcagtgagtgcctatttcgcaggcaatcaaaagcagctggaacaaacactgcagcaattcaatatcaaactcaggccccccggggctgagaaaccatcctggcttgaggagcagtag

SEQ ID NO: 24271 - DNA, 771 bp, Artificial Sequence
  Description of Artificial Sequence: Synthetic coding sequence
atgaaacccgctttatgtcttgtagcaatgggagctctggttatggacagctcgccccagtgcacaaaacagctgttgagcgaaagatttggcagaggcagtagaaccgttgatctggaactggagctacagattgagcttctgagagaaactaaaaggaagtatgagtcagtcctgcagctcggtagagcgttaaccgcccacttatattctctgctccagactcaacacgctctgggggatgcctttgcagacctcagtcaaaagtcccctgagcttcaggaagagtttgggtataacgccgaaactcaaaaactgttatgcaaaaacggcgagacactgctcggcgccgttaacttctttgtttcctccattaacacacttgttacaaagacaatggaggatactttaatgactgttaaacagtatgaggcagccagacttgaatacgatgcatacaggaccgatcttgaggaactgtctttgggacctcgcgatgcgggcacacgcggccgtctggagagcgcccaggcgacatttcaggcccaccgcgacaaatacgagaaactcagaggcgacgttgctattaagctcaaattcctggaggagaataaaattaaggtaatgcacaaacagctgttgttattccacaacgccgtttcggcatactttgccggcaatcagaagcagctggaacagacgcttcagcagtttaacattaagctccgccctcctggggcagaaaagccaagttggttagaggagcagtag

SEQ ID NO: 24272 - DNA, 378 bp, Artificial Sequence
  Description of Artificial Sequence: Synthetic coding sequence
atgggaaacattttcgagaagctttttaaaagcttactcggaaaaaaaaagatgcggatcctgatcctgagtctggacacggcaggaaagaccacgatcctttacaagctgaaactgggagaaacagtccctgccgttcccaccgtcgggttctgtgtcgagacagttgaatataaaaacaataccttcgccgtgtgggacgtgggatcccacttcaaaattaggcccctatggcagcatttctttcaaaataccaaggagttaagcgccagccaattcgcccagtttattaagaaactgtgcggtgtgacaggcaccaatgacgaagccagcccgggcagcttgacctcatatccctcgcatctcctggatagatag

SEQ ID NO: 24273 - DNA, 534 bp, Artificial Sequence
  Description of Artificial Sequence: Synthetic coding sequence
atgggcaacatcttcgaaaagctgttcaagtccctcctgggaaaaaagaagatgcgaattctcatcctgtccttggataccgccggcaagaccacgatcctgtataagttaaagctaggagaaacagtgcctgcggtccctactgtgggattctgcgttgaaacagtggaatataagaacaatactttcgctgtgtgggacgtgggctctcacttcaagataaggcctctttggcagcactttttccagaatacaaaaggcgccagatctccagggtcaacacatcagggttcattggcaagcggggtcctgccaataaagtgctctcatgttgagttcggaatgtggaagggaggacggagtcatccctttctcccacattcatctcggtgcgccgggagcgggggccagctggactctatcctaccccaccaatctcccgcgtggggaccctgggggtgtaaagacctaagttccggcttcccgagctttttgacatcctccatcctgtggaaatcagctgtagtgaagtag

SEQ ID NO: 24274 - DNA, 612 bp, Artificial Sequence
  Description of Artificial Sequence: Synthetic coding sequence
atggggaatatctttgagaaattgtttaaatctttgctgggaaagaagaaaatgcgtatcctgattctgtccctagatactgcaggcaaaactacaatcctttacaagcttaaactcggtgaaacagtgccagccgttcccacggtgggtttctgtgtggagaccgtggagtacaaaaacaacacctttgctgtgtgggatgtcgggtctcactttaagatacgtcccctgtggcaacactttttccaaaacaccaagggagcaagaagtcccggttctacacaccaggggtcactcgcctctggagtgttaccaatcaagtgttctcatgtggaatttggcatgtggaaaggtgggcgcagccaccccttcctgccccactcatcacggtgtgccgggtccggaggccagctcgactcaatcctgccccatcagtctcccgcttggggaccatgggggtgcaaagatctgtcatcgggtttcccaagcttcctgactagcagcatcctgtggaagagcgctgtttcttatcaactgccaagccttcataatagtagtcgtaattatgcgggtagcccagctcagatgatgcgacacctcctggaggcctag

SEQ ID NO: 24275 - DNA, 393 bp, Artificial Sequence
  Description of Artificial Sequence: Synthetic coding sequence
ggtgctagaagtccaggctccactcaccaaggttctctggccagcggggttctgcccatcaaatgtagccatgtggagttcgggatgtggaaaggagggagaagtcaccctttcctcccccattcatctaggtgcgctggctctgggggccaactcgattcaatcctgcctcaccagtcccctgcctggggcccatgggggtgcaaagatctgtcctccggctttccctcatttttgacatcctcaatcctgtggaagtcagcagtcgttagggaacctcacatcagccctcaccaggctccaccgtacaaaacctcagactgcatcacggctatcagttttcccgtctgtacaattcaccaggaaatcatgcgtggccaccgccacaaatag

SEQ ID NO: 24276 - DNA, 378 bp, Artificial Sequence
  Description of Artificial Sequence: Synthetic coding sequence
atgggcaatatctttgagaagctatttaaatcactgttaggaaagaagaagatgaggatcctgattctgtctttagacactgccggtaaaacgacaatcctgtacaagctgaaattgggcgagactgtcccagccgttcccaccgtcgggttttgtgtagagacggtcgagtataagaataacacctttgccgtttgggatgtgggctcccactttaaaattcgccctctttggcagcatttctttcaaaacactaaggagttatctgcctctcagttcgcccagtttattaagaagctgtgcggagtgacaggaaccaacgacgaagcctcaccaggatccctcacctcctacccctcccacctgcttgaccgttag

SEQ ID NO: 24277 - DNA, 378 bp, Artificial Sequence
  Description of Artificial Sequence: Synthetic coding sequence
atgggaaacattttcgagaaactgtttaaatccctcctgggaaaaaaaaagatgcgcatccttattctgtccctcgacacggcaggcaagaccactatcctgtacaaattgaaattgggggagacagttccagccgtgcccacagtgggtttttgtgtggaaaccgttgagtacaagaacaatactttcgcggtatgggacgttggatcccacttcaagattcgccccctgtggcagcatttctttcaaaataccaaagagctctccgcgagccagtttgcccagttcataaagaagctgtgtggcgttaccggtacaaacgacgaggcctctcctgggtctttgacaagttatcccagccatttactggatcgctag

SEQ ID NO: 24278 - DNA, 393 bp, Artificial Sequence
  Description of Artificial Sequence: Synthetic coding sequence
ggcgctcgctcaccgggctccactcaccagggatccctggcttctggtgtgctccccattaagtgcagtcatgtcgaattcgggatgtggaagggcggcagatcccatcccttcctccctcattcatcaaggtgcgcgggaagcggcggtcagcttgactctattctgccccatcaatccccagcatggggaccttggggctgtaaggatctgtcatcagggtttccgtcctttctgacaagttcgattctttggaaatccgcagtagtgagggaaccccacatcagcccgcatcaggcaccaccatacaaaacaagcgattgcatcacagccatttccttcccagtctgcacaattcaccaggagattatgaggggacactggcataaatag

SEQ ID NO: 24279 - DNA, 534 bp, Artificial Sequence
  Description of Artificial Sequence: Synthetic coding sequence
atgggaaacatctttgagaaactcttcaagagccttctgggtaaaaagaagatgaggatcctgatactgagtctggacaccgccggaaagaccaccatcctgtacaaacttaagctgggggagacagtccctgctgtacctacagtgggattttgcgttgagacagtggagtataaaaataataccttcgcggtttgggacgttggaagccatttcaagattcgtcctttgtggcagcactttttccagaataccaagggagctcgttcccctggaagcacgcaccagggatcactcgcatcgggagtgctcccgattaagtgtagtcacgtagagttcggtatgtggaaaggcggtcggtctcatccatttcttccccactcctctaggtgcgctggcagcggagggcagctggactccatcttgccccaccagtctcccgcttggggaccatggggttgtaaggacctgtcaagcgggttccctagttttttgaccagttcaatcctctggaaatccgccgttgttaaatag

SEQ ID NO: 24280 - DNA, 612 bp, Artificial Sequence
  Description of Artificial Sequence: Synthetic coding sequence
atggggaacattttcgaaaagctgttcaaatctctgctcggcaaaaagaaaatgcgtatccttatacttagtctagacacagccggcaaaacaacaatcctgtataaacttaagctgggcgagactgtgccagcagtgccaactgtcggtttttgtgtagaaacagtggagtacaagaacaacacctttgcagtttgggatgtagggtctcactttaagattcggccactctggcagcactttttccagaacacgaagggggctcggtcccccggctccacccatcagggaagtcttgcgagcggggtgcttcccattaagtgttctcatgtggaattcggtatgtggaaaggaggacggtcccaccctttcctgccccattcctctagatgcgcgggtagtggaggccagctggattccatcttgcctcatcagagtcccgcctggggcccctggggctgtaaggatctgtcttcggggttcccgtctttccttacgtcctctattttatggaaatcagccgtctcataccagctgccttcactccacaactcttctcgaaattacgcgggctccttggcacagatgatgagacacctgttggaagcgtag

SEQ ID NO: 24281 - DNA, 378 bp, Artificial Sequence
  Description of Artificial Sequence: Synthetic coding sequence
atgggcaatatctttgagaagctgttcaaaagccttctgggaaagaagaaaatgaggattcttatcctgagcctagacaccgccggcaagaccaccatcctctataaattaaagctgggtgagaccgtccctgcagttccaacagtgggattttgcgttgaaaccgtggaatacaaaaataacacatttgcagtctgggacgtgggctctcactttaagattagacctctgtggcagcatttcttccagaacacaaaggagctgtccgcatcccagtttgcccaattcattaagaaattgtgcggtgtgacaggtacaaacgacgaagcgtccccagggagtctgacctcttacccttcccatctgctggaccggtag

SEQ ID NO: 24282 - DNA, 534 bp, Artificial Sequence
  Description of Artificial Sequence: Synthetic coding sequence
atgggcaacattttcgagaaattgtttaaaagcttgttggggaaaaaaaagatgcgaattcttatactatcattggacactgccggtaagaccacgatcttatacaagctgaagctgggtgaaacggttccggccgtacctaccgttggcttctgtgtggagaccgtcgagtataagaacaacacatttgccgtttgggatgtgggaagtcactttaaaatccggcctctttggcagcactttttccagaacactaagggagctcggtcacctgggtccactcatcagggctctctggccagtggcgtgctgccgattaaatgttcacatgttgaattcgggatgtggaagggcggtaggtctcaccctttcctgccccactctagcagatgcgccggatctggcggccagctggactctattctcccacaccagtccccagcttggggcccttgggggtgtaaagacttgtcctcaggatttcctagcttcctgacatcaagcatcctttggaagtcagcggtggtaaagtag

SEQ ID NO: 24283 - DNA, 330 bp, Artificial Sequence
  Description of Artificial Sequence: Synthetic coding sequence
gctcgttcacctggtagcacccaccagggctccctggcgagcggggtgctgcctatcaagtgttctcacgtggagttcgggatgtggaaagggggcaggtcccatccattcttgccccactccagtcgatgcgctggtagcggcggccagctggacagcattttgccacaccagagtcctgcttggggaccttggggctgcaaagatttgagcagcggatttccaagttttctaacatctagcatcctctggaaaagcgcagtggtgcgagaaccacacatctccccacaccaggcacctccgtataaaacaagcgattgcattacatag

SEQ ID NO: 24284 - DNA, 603 bp, Artificial Sequence
  Description of Artificial Sequence: Synthetic coding sequence
atggggaacggtttatccgaccagacctccatcctctctaacctgccaagctttcaatccttccacattgttatcctcggcttggattgcgcgggaaaaactacagtactgtaccgactccaattcaacgaatttgtaaataccgttcccactaaggggttcaatactgagaaaattaaagtcaccctgggtaactcaaagaccgtgactttccacttttgggacgtgggtggacaggagaagcttagaccattgtggaaatcgtacacgagatgtactgatggcattgtgttcgtcgttgactccgtagatgtggaacggatggaggaagcaaagacggaattgcacaaaattacacgcatatctgaaaatcaaggcgtgccggttctaatcgtggctaacaagcaggacttacggaacagcttgagccttagcgaaatagagaaactgctggccatgggagagctgtcctcaagcaccccttggcatctgcagcccacctgtgccattatcggcgacgggctaaaagaaggactcgagaaactgcacgatatgatcataaaacgccggaagatgctgcggcagcagaaaaagaaaaggtag

SEQ ID NO: 24285 - DNA, 603 bp, Artificial Sequence
  Description of Artificial Sequence: Synthetic coding sequence
atggggaacggcttgagtgatcaaacaagtatcctgtccaacctgccatccttccagtcctttcacatagtgatactcggcctggattgtgctggcaagactactgtattatacaggctgcagttcaatgaattcgtgaataccgtccctacaaagggtttcaatactgagaaaattaaagtcaccctagggaatagtaagactgtgaccttccacttttgggacgtgggcggtcaagagaaactgaggcccctctggaagtcctacacaagatgtaccgacggaattgtgtttgtggtcgacagcgtggacgtcgagaggatggaagaggccaaaactgagctgcacaagatcacgcgtatatcagagaatcagggggtgcctgtgctcatcgtggcgaacaagcaggatctacgcaatagtttgtccctgtcagagatcgaaaagctgctggcaatgggggagctgtcatcttccaccccatggcatctacagccaacctgtgcaattataggcgacgggctgaaggaaggactggaaaaactgcatgacatgatcattaagagaaggaaaatgcttcggcaacagaagaagaagagatag

SEQ ID NO: 24286 - DNA, 603 bp, Artificial Sequence
  Description of Artificial Sequence: Synthetic coding sequence
atgggcaatggattgtccgatcagacgtctattctgagtaacctgcccagtttccaaagttttcatattgtaatcttgggcctggactgcgccggtaagaccacagtgctgtaccgtctccagttcaacgaattcgtgaataccgtccccacaaaaggcttcaatactgagaagatcaaggtgacgcttggcaatagcaagacagttacatttcacttttgggatgttggagggcaggagaagcttcgccccctatggaaatcctacaccagatgcacagacggaattgtgttcgtggtggacagtgttgacgtggaaaggatggaggaagccaaaaccgagctgcacaagatcacacggatcagcgagaaccaaggagtaccggttctgatcgtcgccaacaagcaggatctgcgcaactcgctcagcttgagcgaaatcgagaagcttttggctatgggagagttatcatcatcaacgccctggcacttgcagccgacatgtgcaataatcggagacgggttaaaggagggactggagaaactgcacgacatgataattaaacgtcgtaaaatgttgaggcagcagaagaagaagcgatag

SEQ ID NO: 24287 - DNA, 603 bp, Artificial Sequence
  Description of Artificial Sequence: Synthetic coding sequence
atgggtaacggcctgtccgaccagactagcatcctgtctaacctgcctagtttccagagctttcatattgtcatcctcgggctagactgtgctggcaaaacgacggtactttacaggttgcagtttaacgaatttgttaacaccgtccccaccaagggcttcaacacagaaaagatcaaagtgacactgggcaattcgaagacagtcacttttcacttttgggacgtgggggggcaggagaaactacgccccttgtggaagtcgtacacgagatgtaccgatggcatagtgtttgtggttgacagtgtcgatgtggagcggatggaagaagccaagacagagctgcacaaaattactagaattagtgaaaaccagggcgtccctgtccttattgtcgctaataagcaggacttaaggaacagcctgagcctgtccgaaattgaaaagctactcgccatgggcgagcttagttcttccacgccttggcatctgcagccgacgtgcgcgattatcggggacggactcaaagaggggctcgaaaagctgcatgacatgataattaagagaagaaaaatgttgcggcagcagaaaaagaagaggtag

SEQ ID NO: 24288 - DNA, 603 bp, Artificial Sequence
  Description of Artificial Sequence: Synthetic coding sequence
atgggtaatggcctgtcagaccaaacctcgattctcagtaacctgccgtcttttcagagttttcatatcgtaattctcggcctggattgcgctggcaagactacagtcctctataggctccagtttaacgaatttgttaataccgtgccaaccaaaggatttaatactgaaaagatcaaagtaaccttaggcaatagtaaaaccgtcacgtttcatttttgggatgtaggtgggcaggagaaactgcggccgctctggaaaagttacacacgatgcaccgatgggattgtgttcgtggtggactccgtggacgtcgagaggatggaagaggctaagactgaactgcacaagatcacacgcattagcgaaaatcagggcgtgccagttctgatcgtcgcgaacaaacaagatctgagaaattcactatccctaagcgagattgaaaagcttctggcaatgggggaactgtcttcctccacaccatggcacctccagcccacctgcgcaatcatcggagacggattaaaggaggggttagagaagctgcatgatatgatcattaaacggcggaaaatgcttaggcagcagaagaaaaagaggtag

SEQ ID NO: 24289 - DNA, 156 bp, Artificial Sequence
  Description of Artificial Sequence: Synthetic coding sequence
atgggtaacgggctcagcgatcaaaccagcatcctctccaacttaccatcattccagagttttcacatcgtgatccttgggcttgactgtgcggggaaaactaccgttttatacaggctccagtttaatgagtttgtgaataccgtccctacgtag

SEQ ID NO: 24290 - DNA, 606 bp, Artificial Sequence
  Description of Artificial Sequence: Synthetic coding sequence
atggggaacatctcctcgaatatttcagccttccaatccctgcacatcgtcatgttggggctggatagtgctgggaaaaccacggtgctgtaccgtcttaagtttaacgagttcgttaataccgtacccaccatcggcttcaacactgagaagatcaagctatcaaacggcaccgccaaggggattagctgccacttttgggacgttgggggccaggagaagctgagacccctctggaagtcttattctcgatgtaccgacggaataatctacgttgtagacagcgtggatgtcgacagactagaagaggctaaaacagagctgcacaaggtcacaaaattcgccgagaatcaaggcacacccctgttggtgattgccaataaacaggatttgcccaaaagtctgcctgtggccgagatagagaagcagctcgcattgcacgagctaattccggcaaccacgtaccacgtccagccagcgtgcgctatcattggcgaggggctgactgagggaatggacaaattatacgaaatgatactgaagagaaggaagtccctgaagcagaagaagaagagaacgggagacctccgatcatgtgaagtttag

SEQ ID NO: 24291 - DNA, 579 bp, Artificial Sequence
  Description of Artificial Sequence: Synthetic coding sequence
atggggaacatttcctccaatatttcggcctttcagtctctgcatatcgtaatgctagggctcgacagcgctggtaagacaaccgtgctctatcgtctgaagttcaatgagtttgttaacacagtgcccaccatcgggtttaatacagagaagataaaactttcaaacggcactgcaaaggggatatcctgtcacttttgggatgttgggggccaagagaagctgaggccgctttggaaaagctatagtcggtgcaccgatggcatcatttatgtcgttgattcggtggacgtcgaccgtctggaggaggctaagaccgagctccacaaagttacaaagttcgctgaaaaccaagggacgcccctgctagtcatcgcaaataagcaggacctcccaaaatcactccctgttgccgagattgaaaaacagctggcactccacgagttaatccccgcgaccacgtaccatgtccaaccagcatgcgccattattggtgagggactgactgaggggatggataagctgtatgagatgatcctaaaacgcagaaaaagcctaaaacaaaaaaagaagagatag

SEQ ID NO: 24292 - DNA, 612 bp, Artificial Sequence
  Description of Artificial Sequence: Synthetic coding sequence
atggctgagggcgacaatcggtccacaaacctgctggccgctgagaccgcctccctggaagagcagttgcaaggttggggcgaagttatgttgatggccgataaggtgcttcggtgggaacgtgcctggtttcctccggcaattatgggagtggtgagtctcgtgttccttatcatttattaccttgacccctccgtgctctccggagtgtcttgctttgtcatgttcctctgcctggctgactatctggtgccaattctagcaccccgtatatttggcagcaacaagtggactactgagcaacagcagcggttccatgaaatttgtagcaacctcgtgaaaacacggcgtcgcgctgttggatggtggaagaggctctttacgcttaaggaagagaaacccaaaatgtacttcatgaccatgatcgtatccctcgctgccgtcgcatgggtcgggcagcaggtccacaatctcttgctcacctatctgattgtgacaagcctcctgctgctgccaggcctgaatcagcacggtattatcctgaagtatataggaatggctaaaagggaaatcaacaaactcctgaagcagaaggagaagaaaaacgaatag

SEQ ID NO: 24293 - DNA, 468 bp, Artificial Sequence
  Description of Artificial Sequence: Synthetic coding sequence
atgggagtcgtgtcactcgtctttttaatcatctattacctggatcctagcgtgctgtctggagtgagctgcttcgtgatgttcttgtgcctggcagattaccttgtgccaatactcgccccgcggatctttggaagtaataagtggaccaccgaacagcaacagcgtttccacgagatttgctcaaacctggtgaagaccaggcggcgcgctgtgggatggtggaaacgcttattcacccttaaagaggagaagcctaaaatgtattttatgactatgattgtcagcctcgccgctgtggcctgggtaggacagcaggtacataatctcctcctgacgtacttaatcgtaaccagcctcctgctgctccctggacttaaccagcacggtatcatcctcaaatatatagggatggcaaagcgggaaatcaacaaactgctaaaacagaaagagaaaaaaaacgagtag

SEQ ID NO: 24294 - DNA, 525 bp, Artificial Sequence
  Description of Artificial Sequence: Synthetic coding sequence
atgcttatggccgataaagtgcttcggtgggagcgcgcatggtttccacccgccatcatgggcgttgtcagccttgtttttctgattatctattatctggacccttctgtcctgtctggcgttagctgttttgttatgttcctatgtctggctgattacctggtgccgatcttggctccaagaatcttcggttctaacaagtggactaccgagcagcaacaaagatttcatgagatctgctcaaacctggtgaagactcggcgccgagcggtgggttggtggaaacgcctcttcaccctgaaggaagagaagcctaagatgtactttatgaccatgattgtgtcgctcgcagctgtggcctgggtgggccagcaggttcacaatcttttgctgacctacctaatcgttaccagccttctgctactccccggtctgaatcagcacggcataatcctgaaatatattggcatggctaagagagagattaataagctcttaaaacagaaggagaagaaaaatgagtag

SEQ ID NO: 24295 - DNA, 561 bp, Artificial Sequence
  Description of Artificial Sequence: Synthetic coding sequence
atgatcgcattattcaataagctactggactggttcaaagccctgttctggaaagaagagatggagctaacccttgttggattgcagtactctggaaagactacctttgttaacgttatagcttcaggccaattcaatgaggacatgatccccaccgtggggtttaacatgagaaagatcaccaagggaaacgtgactattaaactgtgggacatcggcggacaaccccgcttcagaagcatgtgggagaggtattgtcgcggggtatccgccatcgtgtatatggtcgatgctgccgatcaggaaaagatcgaggcttctaagaacgaactgcataacctccttgacaagccgcaactgcaaggtatacccgtcctggtgctcggaaacaagagggacctgccgggggccttagatgaaaaggaactgattgagaagatgaacctgtcagccattcaggatagagagatctgctgctatagtatctcctgtaaggaaaaggataatatcgatatcactctgcagtggcttatacagcattcaaaaagccgaaggtcatag

SEQ ID NO: 24296 - DNA, 561 bp, Artificial Sequence
  Description of Artificial Sequence: Synthetic coding sequence
atgctggcccttatcagtcgcctgctggattggttccgctccctcttctggaaagaagaaatggaacttacactggtcggtttgcaatattcaggcaaaacaacctttgtgaatgtcatcgcctcagggcagtttagcgaggacatgatccccaccgttggcttcaatatgagaaaggtcactaaggggaacgtgacgattaagatctgggacattgggggccagcctaggttccggtctatgtgggagagatactgtagaggcgtgaacgcgatcgtgtacatgattgatgccgctgatcgggaaaaaattgaggccagcaggaatgaactgcataacctgctggacaagcctcagctgcagggtatccctgtcttagttcttggaaacaagcgcgatctgccaaatgcactggacgagaagcaactaatcgagaagatgaacctgtctgccatacaggaccgcgaaatctgttgctacagcatcagctgtaaagaaaaagataacattgacatcaccttgcaatggttaatccaacatagtaaatcacgaaggtcttag

SEQ ID NO: 24297 - DNA, 492 bp, Artificial Sequence
  Description of Artificial Sequence: Synthetic coding sequence
atgctcgctctgatttcacgactgttagactggttccggtctctgttctggaaggaggagatggaactcacattagtcgggctccagtacagcggcaaaacaaccttcgtaaacgtcatcgcttccggtcagtttagtgaagatatgatccctaccgtcgggttcaacatgcgcaaggtcacgaaaggcaatgtcactataaagatctgggatattgggggccagcctcgcttccgaagcatgtgggagcgctactgtaggggcgtgaacgccatcgtctatatgatcgatgctgctgatcgcgagaaaattgaggcttccagaaatgagcttcataacctgctggataagcctcaattgcaggggatccctatctcccatttttcaggcctgttcagcatccagaatctggaggaagccgaggcctcccccgaggtgttccagtcatttctggctattattttagaactgctttctgttccactcaaatag

SEQ ID NO: 24298 - DNA, 717 bp, Artificial Sequence
  Description of Artificial Sequence: Synthetic coding sequence
atgatccgtagtgcgagttgggtctggcttctgcctccagcgggagtcaggccttgccgcgcgggcgctcctcgatctcgttggcgggtcagggcagaagctcggagctgtgggtccagacccagtagtagaccgttttcattgcccgccgctattatgctggcactaatttctcgactgctcgactggttcaggagcctgttttggaaggaggagatggagcttacactggtggggctacaatacagcgggaagacaacctttgtcaacgtgatcgcgtccggccaattctccgaagatatgattcccactgtgggattcaatatgaggaaagtgaccaagggaaatgtgaccattaaaatctgggatatcgggggccagccaagattccggtctatgtgggagcgctactgtagaggggtcaatgccattgtgtatatgattgacgccgccgatcgcgaaaagatagaggccagcagaaatgagctgcacaatctgttggacaaaccgcagctgcaaggaattcctgtgctggttttgggaaataagagagatctccccaatgctttggatgagaagcaactgattgaaaagatgaacctaagtgcaatccaggacagagagatctgctgttacagcattagctgtaaggaaaaagataatattgacattaccctgcagtggttgatccagcacagtaagtcaagacggagttag

SEQ ID NO: 24299 - DNA, 681 bp, Artificial Sequence
  Description of Artificial Sequence: Synthetic coding sequence
atgagcttcgcggagtctgggtggcgttcagccctgaggcgccgcggcccagggacccccgggcccgtggcaaggccctcttattcctctttcacccagggcgactcctggggtgagggggaggtggatgaggaggaggggtgtgaccaggtagccagggacctccgcgcagagttttccgctggcgcctggtccgagccaagaaaacgatccgtccttccacccgatggcaacggcagtccagtgcttcccgacaagcgaaatggaatattccctgccgcggcagggagcagggctcaacccagacgttggccagtgcaagtgttgtcaattttgtgctcattattgttcgcaatcctactggccttcttattggctatagcttacctcattgttaaagagttgcatgccgagaacttgaagaacgaggacgacgtggatactggcctcctgggtttctggacgctgctgatcatcagcctgaccgccggcttctcatgttgcagcttctcttggaccgtgacttacttcgattcttttgaaccaggcatgttccccccgacccccctctccccagcacggttcaaaaagctaaccgggcactcgtttcacatgggatatagcatggcaatcctcaacggcatcgtggctgctcttaccgtggcatggtgcctcatgtag

SEQ ID NO: 24300 - DNA, 3492 bp, Artificial Sequence
  Description of Artificial Sequence: Synthetic coding sequence
atgaatagagaagatagaaatgtactgcgcatgaaagagcgggaaagaagaaaccaagagatccagcagggggaagacgcgtttccacctagcagccctctgtttgccgaaccttataaagtcacctctaaggaagacaagctgtcttcacgcatacagtctatgctcggcaactatgatgagatgaaagacttcatcggggataggagtattcctaagcttgtggcgataccaaaacccaccgtgccaccatctgcggacgaaaaaagcaatccaaatttctttgagcagcgtcatggagggtcacatcagtcatcaaaatggactccagttggccccgcgccctctactagtcagagtcaaaagcgaagcagtggtctgcaatcaggacactcaagccagagaacatcagctggaagttcaagtggcacaaatagcagcggacagcgtcacgaccgcgaatcatacaataattctggctctagctcaagaaagaaagggcaacatggcagcgaacatagcaagtctcgctcctccagtcctggaaagccccaagcagtgagctccctgaatagcagccattcacgctcgcacgggaacgaccatcacagcaaagagcatcaacggagtaagtctccgagggaccctgacgcaaattgggatagccctagcagggtgcccttctcttccggccagcacagcacccagagttttccaccatcacttatgtccaagtctaattccatgctgcagaagcctacagcttacgtgagaccaatggacgggcaagagagcatggagccaaagctgagcagcgagcactactcttctcagagtcatggaaactctatgactgagctgaaaccctcatctaaggcacatctgactaaactgaagatccccagccagcccctcgacgcatctgcctccggcgacgtgtcttgtgtcgatgagatcctgaaggaaatgacccactcctggccaccccctttgaccgccatccacacaccttgcaaaactgaaccctccaaattcccctttcccactaaggagtcccaacagagcaatttcggcacaggggagcagaaacgctataacccctccaagacctcaaatgggcatcagtctaaaagtatgctgaaggacgatcttaagctgagttcctcggaggattccgacggggagcaggattgcgataaaaccatgccgaggtccacacctggatcaaactctgaacctagtcatcacaactccgagggggctgataacagccgggacgattcttcttcgcactcaggatcagagagcagctccggatcagacagcgaaagcgagtcgagcagctcagactcagaggccaatgagccctcacagtctgcctcccctgagccggagccgccacctacaaacaaatggcagctggacaactggctgaacaaggtgaatcctcacaaggtgtctccggcgagcagcgtcgacagtaacattcctagctcccaggggtataaaaaagaggggcgagagcagggaaccggtaattcatacaccgacacctcagggcctaaagagacaagctcggccacaccggggagagactcgaagacaatccagaagggaagcgaatccggcagaggacgtcagaaatcccccgcccagtcagacagtacaactcaaagacggaccgtgggaaagaagcagcccaagaaggccgagaaggcggccgcagaggagccacggggcggcctgaagatcgagtcagaaacgccagtggatttggcttcatctatgcctagctcacgacacaaggcggcgacgaaaggatcacgaaaaccaaacatcaagaaggaatccaaaagttctccccgacctaccgcggaaaaaaagaagtacaagtccacctctaaatcctcccaaaaatcacgcgagattattgagacagacacttctagcagtgactcggatgagagcgagagtctgccaccttctagccagactccaaagtacccagaaagcaacaggactccagtgaagccgtcttcagtggaggaagaggactcgttttttaggcagcgaatgttctcaccaatggaggaaaaagaactactgtctcccctgtctgagccggacgacaggtatcccctgatcgtgaaaatagacttaaacctgcttacacgtattcccggtaagccctataaggagacagagcctcccaaaggggagaaaaaaaatgtaccagaaaagcacacgcgcgaagcgcagaaacaggcgagtgagaaggttagcaataagggcaagagaaagcataagaacgaggatgataacagggccagcgagtcaaagaagcccaagaccgaggataagaactcagccggccataaaccaagttctaacagagagtctagcaaacagtccgccgctaaggaaaaggatctcttgccttcgcccgcagggcctgtgcccagcaaagatcctaagaccgaacacggtagtagaaagaggaccattagccagtcttcctctctgaagagctctagcaactcgaacaaggagacctccggctcttctaagaatagctcttctacttctaagcagaaaaaaacagaagggaaaacttcctccagctccaaagaagtaaaagaaaaggcaccttcatcctcgagcaattgtcccccctcagcgcctaccttggattccagcaaaccaaggcgcactaagctggttttcgatgaccgcaattactcagcagaccattatctacaagaagctaaaaagctcaagcataatgctgatgctctttccgaccgcttcgagaaagcagtgtactaccttgatgctgtggtcagcttcattgaatgcggaaacgcccttgaaaagaacgcacaagaaagtaagtccccatttcctatgtactccgagacagtggacctgatcaaatacacgatgaaacttaaaaactatctagctcccgacgcaaccgctgcagacaagcgcctgaccgtgctgtgtctgcggtgcgagtcattactctaccttaggttgttcaaactcaaaaaagagaatgccctgaaatactcaaagaccctcacagaacacttaaagaactcctataataactcccaggccccctcaccgggcctgggcagcaaggcagtggggatgccaagtcccgtctcacccaaattatccccgggcaacagtggtaactacagttcaggggcctccagcgcgagtgcttcaggttcttctgtgacgatcccccagaagatccaccagatggctgcgagctacgtacaagtgacaagcaactttttgtatgccactgagatctgggaccaagccgagcaacttagtaaagagcagaaggaattctttgccgagctggacaaggtgatgggtcctcttatttttaacgctagtattatgactgatctggtgagatatacgcgtcagggcctccactggctgcggcaggatgccaaattaattagctag

SEQ ID NO: 24301 - DNA, 447 bp, Artificial Sequence
  Description of Artificial Sequence: Synthetic coding sequence
atgaaccgggaggataggaacgtgctgaggatgaaagaacgcgagcgacgtaaccaggagatccagcagggcgaggacgcatttcccccctcctctcccctctttgccgagccatataaggttacttccaaggaggacaaactttcgtcacgaattcaatctatgttgggcaattacgacgagatgaaagacttcattggggaccgaagcatccccaaattggtggccatcccaaagcccactgtcccaccgagcgctgacgagaagagtaatcctaatttcttcgaacagcgacacgggggatcccatcagagcagcaagtggaccccagtggggcctgcccccagcaccagtcagagccaaaagaggagcagtggcctccagagtggtcacagctcacagcgcaccagtgctggcagctcatccggtactaacagctccggttag

SEQ ID NO: 24302 - DNA, 1059 bp, Artificial Sequence
  Description of Artificial Sequence: Synthetic coding sequence
atgttgaggttgttggccagcggctgtgcgcgtggcccaggccctggagtgggcgcgcgcccagccgccggcctgttccatccagggagacggcaatctaggcaggcctctgacgccccaagaaaccagccaccaagtcctgagttcgtagcacggcctgtgggcgtgtgttctatgatgaggctgcccgtccagaccagtccagaaggcctagacgctgccttcatcggagtgcctctggacacagggacatcaaatcgtcctggcgcacgcttcggacctcggcggatccgcgaagagagcgtgatgttagggaccgtgaatccatcgactggagcactaccatttcagtctctgatggttgctgatttgggagatgtgaatgtaaacctgtacaacctgcaagattcatgccgtaggatccaagaggcatacgagaagatcgttgctgctggttgtatccccctcactctgggcggcgaccatacaattacctatcccatcctgcaggccatggctaaaaaacacggccccgtcggcctcctgcacgtggatgcacacacagacaccacggacaaagcacttggagagaagctgtaccacggagccccatttaggagatgcgtggacgagggcttgctcgactgcaagcgagtggttcaaatcgggataaggggcagcagtactacactggacccctacagatacaacaggagccagggttttagggtggtgctagcagaggactgttggatgaagtcactggttccactcatgggtgaagttagacagcagatgggtgggaaacctatctacatatcctttgatatcgatgccctagaccctgcctacgcccccggaacgggcacccctgagatcgctgggctgaccccatcccaagctttagagataatccgcggttgtcaggggctcaacgtcatgggctgcgacttggtggaagtttccccaccttacgacctttccggtaataccgccctcctggcagccaacctcctcttcgagatgctttgtgcactgccaaaggttacaacagtgtag

SEQ ID NO: 24303 - DNA, 1617 bp, Artificial Sequence
  Description of Artificial Sequence: Synthetic coding sequence
atggaacggctcggtgagaaagctagtcgattacttgaaaagttcggccgaagaaagggggaaagttcgcgatccgggtctgatggcacccccggaccaggaaagggtcgactcagtgggctgggggggcctcgcaagagcggacccaggggtgccacaggcggcccaggcgacgaaccacttgaacctgcacgggagcagggctcgctggatgctgaacggaaccaaagaggatctttcgaagcacctcgctatgagggttcattccctgccggcccaccccccacccgtgccctaccactgccacagtcactccctccagatttccggctagagccgacagccccggccctatcaccacgctctagcttcgcttcgagcagcgcgagtgacgcctctaagccctcttcacctagagggagtctcttgctcgacggcgccggcgccgggggtgcgggaggctcaagaccttgttccaaccgcacgagcggtatcagcatggggtacgatcaacggcatggcagcccacttcctgctggcccatgcctctttgggccacctctggccggcgctcccgctgggtactctccagggggggttccgtcagcttaccccgagctgcacgccgcattggatcgactatacgcacagcgccctgccggatttggctgccaggagagcaggcactcctacccaccagctcttgggtcgccaggtgcgttagccggagcaggcgtgggggctgctggcccactggaacgtcggggggctcagcccggcaggcattccgtgacaggctatggcgactgtgccgtgggagctcgctaccaggacgagttgacggccctgctccggctgaccgttggaacaggaggaagggaggctggggcccgcggcgaacccagtggtatcgagccctccggactagaggaacctccagggccgttcgtccccgaagccgcccgcgcccgtatgagagaacccgaggcaagagaggactattttgggacatgcatcaaatgcaacaaggggatatatgggcagagtaacgcctgccaagcattggattcactgtaccacacacaatgtttcgtttgctgtagctgcggtagaaccttacggtgtaaggccttctattctgtcaatggatccgtctactgcgaggaggactaccttttcagtggctttcaagaggcagcagaaaagtgctgcgtgtgtggtcatctgatcctggagaaaattctgcaagccatgggcaaatcataccatcctggctgtttccggtgcatcgtttgcaacaaatgcctggatggaatccccttcacagtggatttctccaatcaggtctattgtgtcaccgactatcacaagaactacgcccccaaatgcgctgcatgcggccagcctattttgccaagcgaaggctgtgaagatatcgtgagagttatcagcatggacagggactaccattttgaatgttatcactgtgaggactgccgcatgcagttgtccgacgaggaagggtgttgctgttttcctctggacggacacctattgtgtcatggttgtcacatgcaaaggctcaatgcccgacaacctcctgcaaattatatttag

SEQ ID NO: 24304 - DNA, 1617 bp, Artificial Sequence
  Description of Artificial Sequence: Synthetic coding sequence
atggaaagattaggggagaaagcatcccgtctgctcgagaaattcggacggaggaagggcgagtcgtctagatctggctccgacggaaccccaggtcccgggaaagggcggctgtccggactagggggcccccgaaaatccgggccacgcggagccactggggggccaggtgacgagccactggagcccgccagggaacaagggtccttggatgctgaacgaaaccagcgcgggagtttcgaagcccctcgctacgagggcagtttccctgctggaccccccccaacacgggccttaccacttccccaatccctgccacccgatttcagactcgagcccaccgctccagccctatcacctcgatcaagttttgcatcaagctccgcatcggatgcctccaagccctcatccccgcgcggtagccttctgcttgatggcgcaggagcagggggcgctggcggcagccgcccatgttcaaataggacctcaggtatcagtatgggctatgatcagaggcacgggtcgcctctgcctgctggaccttgcctattcggtccgccgctggccggggctccggcggggtattctccggggggtgtcccctctgcttaccccgaattacatgccgctttagaccggctgtacgcccagaggccagctggcttcgggtgccaggagtccagacattcctacccccccgcattaggttctcctggcgccctggctggcgccggtgtcggcgcggcaggacccctcgagcgcagaggcgcccagcctggccgccactctgtgaccggatacggcgattgcgctgtgggagctcgctatcaggacgaactcacagccctgcttcggctgacagttggcaccggaggcagggaagctggggcccgtggcgagccctctggtatagagcctagcggcctagaggaaccaccaggaccctttgtgccggaagctgcaagagctaggatgcgcgagccagaggcacgggaggactattttggcacctgcattaagtgcaacaaaggtatttacggacaaagtaacgcctgtcaggctcttgactccttgtatcatactcagtgttttgtctgttgctcttgcggtagaacactgcggtgcaaagcattctattctgtaaacgggtctgtatactgtgaggaggattacttgttctccggcttccaagaggctgccgaaaaatgctgcgtctgtgggcatctgatcctggaaaaaattctacaagccatgggtaaatcctaccaccccggatgtttcaggtgtattgtttgcaacaaatgccttgacgggataccttttacggttgattttagcaaccaggtctactgtgtaacggattaccacaaaaactatgcacctaaatgtgccgcatgcggtcagccaattttaccaagcgaggggtgtgaagacatagtccgggtcattagcatggatagggattatcactttgaatgctatcattgtgaggactgtagaatgcagctgtccgatgaagaaggctgctgttgctttcccttggacgggcatctgctgtgtcatggctgccatatgcagcgactgaatgctagacagcccccagccaattacatctag

SEQ ID NO: 24305 - DNA, 366 bp, Artificial Sequence
  Description of Artificial Sequence: Synthetic coding sequence
atggggaaatcctaccatccaggttgtttccggtgtattgtgtgtaacaagtgcctggacggcataccattcactgtcgacttctctaatcaggtgtactgcgtaaccgattatcacaagaactacgctcccaaatgcgctgcatgcggtcagccgatcctgccatcagaagggtgcgaggatatagttcgggtaatctcaatggaccgggactaccactttgagtgctatcactgcgaggattgtaggatgcaactatccgatgaggagggatgttgctgttttcctctcgatggacatctgttgtgtcacggctgtcacatgcagagattgaacgcccgacagccacccgccaattacatatag

SEQ ID NO: 24306 - DNA, 243 bp, Artificial Sequence
  Description of Artificial Sequence: Synthetic coding sequence
atgggaaaatcttaccatcccggctgtttcaggtgtatcgtttgcaataagtgtctggacggcataccatttactgtggatttcagtaatcaggtgtactgtgtgactgactaccacaagaactacgcccccaaatgcgcggcatgtggtcagcctattctgccttccgaaggttgtgaagacatagtacgggtcatatcaatggaccgggattaccatttcgaatgctaccactgtgagtag

SEQ ID NO: 24307 - DNA, 198 bp, Artificial Sequence
  Description of Artificial Sequence: Synthetic coding sequence
atggggaaatcttatcaccccgggtgctttagatgcatagtatgcaacaaatgcctggatggcatccccttcacagttgacttttcgaaccaggtgtactgtgtcaccgactaccataagaattatgctcctaaatgtgcagcttgcgggcagcccatcctcccttctgagggatgtgaggacatagttcgcgtgtag

SEQ ID NO: 24308 - DNA, 243 bp, Artificial Sequence
  Description of Artificial Sequence: Synthetic coding sequence
atgggaaaatcctatcaccccggctgctttagatgcattgtgtgtaacaagtgtctcgatgggatcccctttactgtggatttctcaaatcaggtttactgcgtaaccgattatcacaaaaactacgcccctaagtgtgcagcttgtggacagcccatacttcccagtgaaggatgtgaagacatcgtccgcgtgatctccatggatagagattaccacttcgagtgttatcactgtgagtag

SEQ ID NO: 24309 - DNA, 309 bp, Artificial Sequence
  Description of Artificial Sequence: Synthetic coding sequence
atggctaacacccagctggatcatcttcactacaccactgaattcacgcggaacgatcttttaattatttgcaagaaatttaacctgatgctgatggatgaagacataattagcctgctcgcaatctttatcaagatgtgtctgtggctgtggaagcagttcctaaagcgtggctcaaagtgttccgaaacttctgagctgcttgagaaggtgaagctgcagctcgctttcacagcatacaaatatgtggatatctgcttccccgaacagatggcttactctcggtacattcgctggtatatccactag

SEQ ID NO: 24310 - DNA, 1500 bp, Artificial Sequence
  Description of Artificial Sequence: Synthetic coding sequence
atgtgcgagctctactctaagagagatacattgggcctgcgcaaaaaacatattgggcccagttgcaaagtcttctttgcctcagatccaataaagattgtgagagcccagagacagtacatgttcgatgaaaacggagagcaatatctagactgcattaacaatgtcgctcatgtcggacactgccatcccggcgtggtgaaggcggccctaaaacagatggaacttttgaacacaaactctaggttcctccatgataacatcgtggaatacgctaaacgcctcagcgctactctgccagaaaaattatctgtttgctatttcaccaattccggaagcgaagccaatgatctcgctttgcgcctggctagacaatttcgcgggcatcaagatgtaataaccctggaccacgcctatcatggacatttgtcctcattgattgaaatatctccctataagttccagaaaggcaaggacgtgaaaaaggagtttgtccacgtcgcccccacccctgatacctataggggaaaatatagggaagaccatgccgacagtgccagtgcttacgctgatgaagtaaaaaaaataattgaagatgcccacaactccgggcgaaagattgctgctttcatcgctgagtccatgcagtcttgcggcgggcaaatcatcccacccgccgggtatttccagaaagttgcagaatacgtccacggagccggaggggtctttattgcggacgaggtgcaggtgggtttcggccgagtagggaaacatttttggtcttttcagatgtacggggaggatttcgtgccagatatcgtaacaatgggaaagccaatgggcaatggccaccccgtggcctgtgttgtgacaacgaaggagatcgcagaagccttcagtagttcgggcatggaatactttaatacatacggtggtaaccccgtctcatgcgctgtgggcctcgcggttctggacatcatcgagaacgaagacctccaggggaatgctaagagggtcggcaactatctcacagaattactgaagaaacagaaggcaaagcacacactcattggggacattcgaggcataggtctgtttataggaatcgacttagtgaaggatcatcttaagcggacgccagcaacggcggaggcccagcatataatttacaagatgaaagaaaaacgcgtcctactatccgccgacggcccacatcgtaatgtattgaagatcaagccgcccatgtgttttaccgaggaagatgcaaagtttatggtggaccaattggaccggatcctcaccgtgctcgaagaagccatgggtacaaaaacggagtccgtcacctctgagaacaccccatgcaagaccaaaatgctgaaggaagcccatattgaactcctgagagactctacgacggatagtaaggaaaatccgtcacggaaaagaaatgggatgtgcaccgacacccatagccttcttagcaaacggttgaagacatag

SEQ ID NO: 24311 - DNA, 1482 bp, Artificial Sequence
  Description of Artificial Sequence: Synthetic coding sequence
atgtgtgaactgtattccaagcgcgacacactggggctgcgcaagaagcacatcgggccatcctgtaaggtcttcttcgcttctgatcctatcaaaatcgttagggctcagcggcagtatatgttcgatgaaaacggggagcagtatctcgactgtatcaataacgtggctcacggcgtcgtgaaagcagcattgaaacaaatggagctgctgaacacaaactctcgatttctgcacgacaacatagtagaatacgccaagagactctcagctacgttgccagaaaagctgtctgtctgctattttacaaactctggcagcgaagccaatgacctggcccttcgcctggcacgtcagttccgggggcatcaggacgtgattaccctcgaccacgcgtatcacggtcatctcagtagcctgattgagatcagcccgtacaagttccaaaaaggtaaagatgttaaaaaggagtttgtccacgttgccccgacccccgacacgtatagaggaaaatatcgagaggaccacgcggattctgctagcgcgtatgctgatgaagttaagaaaatcatagaggacgcacacaattcaggtcggaaaatcgctgctttcattgctgagagtatgcagtcatgtggaggccagataattcccccagccggttacttccagaaagtggccgaatatgtgcacggggcgggaggggtatttattgcggatgaagtgcaagtgggcttcggcagggtcggtaagcacttttggtcttttcaaatgtacggcgaggactttgttcctgatatcgtgaccatgggtaagcccatgggcaacggccatcctgtggcctgtgtcgttaccaccaaagagatcgccgaagcattctcttcgagcggcatggagtactttaatacttacggcggaaaccctgtgagttgcgccgtgggcttagccgtcctggacatcatcgagaatgaggatctgcagggtaacgccaagcgtgtgggcaattaccttaccgaacttctgaaaaagcaaaaggctaagcacaccctcataggcgacataagagggatcgggctttttattggaatcgacctcgtgaaagaccacttaaagcgaactcccgcaaccgccgaagctcagcacatcatatacaaaatgaaagaaaaaagggtgctgttgtctgcggacggcccccaccgaaatgtcctgaaaatcaagcccccaatgtgctttaccgaggaggatgcaaagtttatggtcgaccagctcgaccgaatcctcacagtgctggaggaagcaatgggaactaagacagagtcagtgaccagcgaaaacacaccctgcaagaccaagatgcttaaggaagcgcacatcgaactgcttagagatagtacaactgattctaaggagaaccctagccggaaacggaacggtatgtgcactgacacccacagcctattgtcaaaacgcctcaaaacatag

SEQ ID NO: 24312 - DNA, 1326 bp, Artificial Sequence
  Description of Artificial Sequence: Synthetic coding sequence
atggggcattgccacccaggcgtggtgaaggccgctctgaagcagatggagttgctaaatactaatagtcgatttttgcatgacaacattgtggagtacgctaagagactctctgctacgctcccagagaagctgtcagtctgctactttacaaatagcggatctgaagcaaacgacctcgctcttcgactggcaagacagttccgagggcatcaggacgtgataacactcgatcacgcttatcatgggcatctgagttctttgatcgaaatctctccttacaaatttcagaaaggtaaagacgtgaagaaagagttcgttcacgttgctcccacacctgacacatacagaggtaagtatcgtgaggatcacgcagattcagcttcagcatacgctgacgaagtcaaaaagatcatagaagacgcccacaattccgggagaaaaatcgcagctttcatcgccgagtcaatgcagagctgtggtgggcagatcatacctccagccggctactttcagaaagtcgcagagtacgttcacggtgccggtggggtcttcattgcagacgaagtccaggttggcttcggcagggtcgggaagcacttttggtcttttcaaatgtatggcgaagacttcgttccagatatcgtcacaatgggcaaaccaatggggaatggccaccccgtagcatgtgtggtgacaacgaaagagattgcagaagcctttagctcaagtggcatggagtacttcaacacttacggtggcaaccccgtgtcctgtgcagtgggtctggccgtgctcgatattatagaaaacgaggacctgcaaggcaacgcgaagcgcgttggtaattacctgaccgaactgttgaagaagcagaaagccaaacacaccctcatcggggatatccggggaatcggcctgttcatcggaatcgacctggtgaaagaccatctcaagcgaacacctgcaactgccgaggcccagcatattatctacaagatgaaggagaaacgcgtgttgctctcagcagacggaccacaccgtaacgtcctgaagattaagcctccgatgtgttttactgaggaagacgccaagttcatggtggatcagctggatagaattctgacagttctggaggaggcaatgggcacaaagacggaatctgtaactagcgagaacaccccctgcaaaaccaagatgcttaaggaagctcacattgagctccttcgggattcaacaacggatagcaaggagaatccctcccgcaagcgcaatgggatgtgtaccgacacacactctctgctcagtaaaaggctgaagacttag

SEQ ID NO: 24313 - DNA, 1353 bp, Artificial Sequence
  Description of Artificial Sequence: Synthetic coding sequence
atggctgctgaccagaggccaaaagcggatacgctggccttacgtcaacgcctcatttcgagttcctgccggctcttcttccccgaggaccccgttaaaattgtcagagcccagggtcagtatatgtacgacgaacagggcgcggaatacattgactgcatttcaaatgtggcccacgtggggcactgccacccacttgtcgtgcaggccgctcacgagcagaaccaggtgctgaacaccaacagcagatacctgcatgataacatcgtggactacgcccagcgcttgagtgagaccctgccagaacagctgtgcgtattttacttccttaactcagggtcagaagcaaatgacctggcactgcgcctagctaggcactacacaggccatcaagatgtagtcgtgctggaccatgcgtaccacgggcatctgtcctctttgattgatattagcccctataaattccgcaaccttgatggtcagaaggagtgggtacatgtcgcaccactgccagacacatacagaggaccttacagagaggaccaccccaatcccgccatggcttatgctaacgaggtaaaacgagtcgtgagcagtgcccaggagaaagggcgtaagatcgctgctttctttgcggaaagcctcccctccgttgggggccaaattattcccccagctgggtatttttctcaggtggctgagcacatcaggaaagcagggggggtgttcgtggccgacgaaatccaagtcgggttcggcagggtaggaaaacacttttgggcatttcaactgcaagggaaagatttcgtcccagatatcgtcactatgggcaagagtatcggcaatggacatcctgtcgcgtgcgttgcagcaacacagccagtggccagggcattcgaggccacaggtgtggagtacttcaacacatttggcggctctcccgtatcctgcgccgtgggattagcggtgctgaacgtgctcgaaaaagagcagctccaggaccatgctacttctgtgggttccttcttgatgcagctgttaggccagcagaagatcaagcatcctattgtcggcgatgtccgtggggttggtctgtttataggggttgatctcatcaaagacgaggccaccagaaccccagcgaccgaggaggcagcctatctcgtgtctcgactcaaagaaaactatgtactcctgtctactgacggcccagggcgtaacattctgaaatttaagccacccatgtgcttttccctggataacgccagacaagtcgtcgcgaagcttgacgctatcctgacagacatggaagaaaaggtgagatcctgtgagacactccgcctgcagccctag

SEQ ID NO: 24314 - DNA, 519 bp, Artificial Sequence
  Description of Artificial Sequence: Synthetic coding sequence
atgatttactcttgctgcatcttcgtgtactgcatgtttgaatgttttaagatcaagaatagcgtcaactaccacctgctcttcacactggtcctgttctcacttattgttacaactgtctacctaaaagtgaaggaacctatctttcaccaggtaatgtacggaatgctggtatttacactggtgctaagaagcatatacattgtaacgtgggtgtatccctggctccgcggcctcggctacacttctctggggatctttctcctaggcttcctgttttggaatattgataacatattctgcgagtctctgcggaattttagaaaaaaagttcccccaatcattggcatcaccacccaattccacgcctggtggcacattctcactgggctcggatcttatctgcacatcctgttcagcctgtacacaagaaccctgtacctgcgatatcggcccaaggtgaaatttttatttggaatttggccagtaattttgtttgagcccctacggaaacactag

SEQ ID NO: 24315 - DNA, 804 bp, Artificial Sequence
  Description of Artificial Sequence: Synthetic coding sequence
atggctcccgccgcagatcgagagggctattgggggccaacaacctctaccctcgactggtgcgaagagaattatagcgtcacctggtacatcgcggaattctggaacactgtgtctaacctgataatgattattccacctatgtttggtgccgtacagtctgtgagagacggtctggagaagcggtatatagcaagttacctggctctgacagtggttggaatgggctcctggtgcttccacatgacgctgaaatatgagatgcagctgctcgatgagctgcctatgatctactcgtgctgcattttcgtatactgcatgtttgaatgcttcaagatcaaaaatagtgtgaattaccatctgctgtttaccctggttttattctccctaatagtcacaaccgtgtacttgaaggttaaggaaccaattttccatcaggttatgtacgggatgcttgtgttcacactggtattgcggtctatttatatcgttacatgggtttatccctggttgcgcggactcggatatacttccctcggaattttcctgttaggatttctcttctggaacatcgataacatcttttgtgaatcactgcggaacttccgcaaaaaggttccacctattattggcataacaacccaattccacgcctggtggcacatcctcacaggactgggaagttacttacacattcttttcagcctgtatacaagaacactgtatctgagatacaggccaaaagtgaagttccttttcggcatctggccagtgatattgtttgagccccttcggaagcactag

SEQ ID NO: 24316 - DNA, 693 bp, Artificial Sequence
  Description of Artificial Sequence: Synthetic coding sequence
atggctccggcagcagatcgagaggggtattggggccctacgacctccaccctggattggtgtgaggaaaactattcagtgacctggtacatcgctgaattcttagtgggcatggggtcctggtgctttcatatgacactaaaatacgagatgcaacttctggatgagcttccgatgatctactcctgttgcatttttgtgtactgcatgttcgagtgcttcaagatcaaaaacagtgtcaattaccatttgctgtttactttagtcctcttcagccttattgtcacgacagtctacctgaaagtgaaggagcccatcttccatcaggtgatgtacgggatgctcgttttcacactggtcctaagatccatctatatcgttacatgggtgtacccctggctccgtggtctgggctataccagcctagggattttcctgctcgggtttttattctggaatatagacaatattttctgcgagtcccttcgcaacttccgtaaaaaagtaccccccatcatagggattaccacccaatttcacgcatggtggcacatccttaccggcctggggagctatttgcatatccttttcagtctgtatactcggacactgtacttgaggtatagacccaaagtgaaatttctgtttggcatttggcccgtgattttgttcgagccactgcgcaagcattag

SEQ ID NO: 24317 - DNA, 678 bp, Artificial Sequence
  Description of Artificial Sequence: Synthetic coding sequence
atgatcatccctcccatgttcggagccgttcaaagtgtgcgggatgggcttgagaagcgctacatcgcgtcctatttggctctgactgtagtgggaatgggatcttggtgcttccacatgacactgaaatatgaaatgcagcttctcgatgagctgcccatgatatactcgtgctgtatctttgtgtactgtatgttcgagtgctttaagatcaagaattcggtaaactaccacctgctctttaccctggtgttgttttccctgattgttacaaccgtttatctcaaagtcaaagagccgattttccatcaggtgatgtacggcatgctggtgttcacgctggtcctccgcagtatctacatagtgacatgggtttacccctggctcagagggttaggatacacatccttaggaatttttctgctgggtttcttattctggaacattgacaatattttctgcgagtctttgagaaattttcgcaaaaaggttccaccaatcatcggcatcactacacagttccatgcctggtggcacatcttgaccgggttgggcagttacctgcacatcctgttcagtctgtatacccgaacactgtatctccggtatagacccaaagtgaagttcctctttggtatctggcctgtcatcctttttgaacccctccggaagcactag

SEQ ID NO: 24318 - DNA, 405 bp, Artificial Sequence
  Description of Artificial Sequence: Synthetic coding sequence
atggcgcaatctcggttgataggtactagcacgtcccaagtcatgtatggcatgctggttttcactctagtcctgagatctatttatatcgtgacatgggtttacccatggttaagagggcttgggtacaccagcctgggcatatttctgttggggtttctgttctggaatattgataacattttttgtgaatcactgcgtaacttccgcaaaaaggtgccacccatcatcggcatcacaacccagttccacgcctggtggcacatccttacaggcctggggtcttatctgcacatcttattcagcctttacactcggactctgtacctaagataccggcctaaagtcaagtttttgttcggaatatggcctgttatcttgtttgagcccctccggaaacactag

SEQ ID NO: 24319 - DNA, 453 bp, Artificial Sequence
  Description of Artificial Sequence: Synthetic coding sequence
atgtccggagaactcagtaatagatttcagggaggcaaggcgtttggccttctgaaggcccgccaggaaaggaggctggccgagataaacagggaatttctgtgcgaccaaaaatatagtgatgaggaaaatctccctgagaagttgacagccttcaaggagaagtacatggagttcgacctgaacaacgaaggcgagatcgatctgatgtcattgaagcggatgatggagaaattgggggtgccaaaaacccacctcgagatgaaaaaaatgatctccgaggtgactggaggagtgtcggacaccatctcttatcgtgattttgtgaacatgatgctgggtaagaggtctgcagtgctgaagcttgtcatgatgtttgagggcaaggctaacgaaagctctccaaagcccgtcggtcctccccctgagcgagacattgccagtctgccgtag

SEQ ID NO: 24320 - DNA, 309 bp, Artificial Sequence
  Description of Artificial Sequence: Synthetic coding sequence
atgtctggagaattgagcaatcgatttcagggtggtaaggcgtttgggctccttaaggcccgtcaggaaagacggttggccgagatcaaccgggagtttctttgtgatcagaaatattccgatgaggagaacctgccagaaaagctgacagctttcaaagagaaatacatggagtttgacctgaataatgagggcgagatagacctgatgtccctgaagagaatgatggagaagcttggggtgcctaaaacccacctggaaatgaaaaagatgatctcagaagttacaggcggcagccacgatgtatag

SEQ ID NO: 24321 - DNA, 285 bp, Artificial Sequence
  Description of Artificial Sequence: Synthetic coding sequence
atggaatttgatctgaataatgaaggagaaattgaccttatgtctttgaagcggatgatggaaaaacttggtgtaccaaagacacatctcgagatgaaaaagatgatttctgaggttaccggcggcgtgtctgataccatttcctatagggatttcgtgaacatgatgctgggaaagaggagcgccgtgctgaagttggtcatgatgttcgagggcaaggcaaatgaaagcagccccaagcccgtaggccccccccccgaaagagatatcgctagcctgccgtag

SEQ ID NO: 24322 - DNA, 429 bp, Artificial Sequence
  Description of Artificial Sequence: Synthetic coding sequence
atgtctggtgaactcagtaacaggttccagggaggcaaagctttcggcttgctcaaggcgcggcaagaacggcgtttagccgaaatcaatcgcgagttcctgtgtgatcagaaatactccgacgaagaaaatttacctgagaagctgacagcgtttaaggaaaaatacatggagttcgacctcatgtctctgaagagaatgatggaaaagttgggtgtgccaaagactcatctcgagatgaaaaaaatgatctccgaggtaactggtggggtttctgacaccatctcgtacagagattttgtcaacatgatgttggggaaacgctctgccgtgctcaaactggtcatgatgtttgaaggcaaggcaaacgagtcttctcctaaacctgttggcccgccacctgaaagagacatagccagcctgccatag

SEQ ID NO: 24323 - DNA, 531 bp, Artificial Sequence
  Description of Artificial Sequence: Synthetic coding sequence
atgtctggggaactttccaatcgatttcagggtggaaaggctttcgggctgctgaaggcgcggcaggagcggcggctcgccgagatcaacaggtactgcgcagggcgcgaaccgcagctgcagaggatttcttgcagccagcactcttgcctgctggccttactcttccaggagtttctttgtgaccaaaaatactccgatgaagaaaacttgccagagaaattgactgccttcaaagagaaatacatggagtttgatctgaacaatgaaggcgagattgatctcatgtcacttaaacgaatgatggaaaagttgggcgtaccaaaaacacacctggaaatgaagaagatgatcagtgaggtcacaggaggcgtgagcgatacaatcagctacagagactttgtaaatatgatgctgggaaagcggagcgccgtcctgaaactcgtcatgatgttcgaagggaaggcaaatgagtcatcaccaaaaccggtcggaccacccccagagcgagacatagcctctctgccttag

SEQ ID NO: 24324 - DNA, 468 bp, Artificial Sequence
  Description of Artificial Sequence: Synthetic coding sequence
atggccagcaaaatggtgatcagtgcccaccccaaaatcctgctgcagctcattcagaaagacaagccaggcggacccggggccagggtacgacagaaggttcttgaggaattcctatgcgaccagaagtattctgacgaggagaacctgccagagaaactgaccgccttcaaggagaaatacatggaatttgacttaaacaacgaaggcgagatcgatcttatgagtttaaagcggatgatggagaaactcggagttccgaaaactcacctggagatgaaaaaaatgataagtgaagtgaccggcggtgtatctgataccattagctatagggattttgtgaacatgatgctgggcaagcggtcggctgtcctgaaattagtgatgatgttcgagggaaaagcaaatgagagcagccctaaacctgttggcccccctcccgaacgtgacatcgcatccctgccctag

SEQ ID NO: 24325 - DNA, 1023 bp, Artificial Sequence
  Description of Artificial Sequence: Synthetic coding sequence
atgcgcaaagaattacagctctctttgtcagtgacccttttgttggtgtgtggcttcctgtatcaattcacacttaaaagcagttgtctgttttgtttgccgtcctttaagagccaccagggattggaggccctgttgtctcatcgccgtgggatcgtgttcttggagaccagcgagagaatggagccacctcacttggtttcttgctccgtggagtccgcagccaagatctaccctgagtggccagtggtgttttttatgaagggtctcaccgacagcaccccaatgccaagcaattccacataccccgctttttctttcctgtctgccatcgataacgtgtttttgttcccgttggatatgaagaggttgctggaagatactccgttgttctcatggtataatcagataaatgcgtccgccgaaaggaactggctgcacatcagtagcgacgcaagccggctggcaatcatctggaaatatggtggtatttacatggatacagatgtcatttccatccgccctataccagaagaaaatttcctagcagcccaggcatccaggtacagtagcaatgggatcttcggtttcctgccccatcatccttttctgtgggagtgcatggaaaatttcgttgagcactataattctgctatttggggtaaccagggccccgagctgatgaccaggatgcttagggtgtggtgcaagctggaagattttcaggaggtttccgatctgcgctgcctgaacataagctttctacatccacagcggttctatccgatctcataccgtgagtggcggcgatactacgaggtctgggacacagagccctcttttaacgtgtcttatgcactgcatctctggaaccacatgaaccaggagggcagagctgtcatcagaggctccaataccctggttgaaaatctctaccggaagcactgcccacggacatatcgggatttaattaagggtccagaaggcagtgttaccggggagctcgggccaggaaataagtag

SEQ ID NO: 24326 - DNA, 1518 bp, Artificial Sequence
  Description of Artificial Sequence: Synthetic coding sequence
atggaacagacggaaaagtccaaggtctatgcagaaaacggcctgctagaaaaaatcaagctctgcctcagcaagaagccgctgccgtcccccacagagcggaagaaatttgaccatgacttcgcaatcagcacaagctttcatggtatacataacatcgtccagaaccggtcaaagattaggagagtcttatggctggtggtggtgctgggtagcgtgtcactagttacttggcaaatatacatccggctgctgaactacttcacctggccgaccaccacctcaatagaggtccagtacgtggaaaagatggaatttcctgcggtgacattctgtaacctcaataggttccagacggacgctgtggctaagttcggcgtgattttctttctgtggcacatcgtctctaaggtgcttcacttgcaggaaattacagctaactctactgggagtcgagaagctaccgacttcgccgcctctcatcagaattttagcatcgtagagttcatcaggaacaagggcttttatttgaacaactctaccctactcgattgtgaattttttggcaagccgtgtagccccaaagactttgcccatgttttcactgagtatgggaactgcttcacgtttaatcacggcgagacactccaggcaaagaggaaggtctctgtctcgggtagaggactctctctcttgtttaacgtaaaccaagaagccttcactgataatccagccttaggctttgtagacgccggaatcatctttgtcattcacagcccaaagaaggtccctcagttcgatgggttagggttgttgtctcctgtgggtatgcacgccagggtgacgattcggcaggtcaagactgtccaccaggagtatccatggggcgaatgtaaccccaatattaaacttcagaacttcagttcgtactcaactagtggatgtttgaaagaatgtaaggctcagcacatcaagaagcaatgtggttgcgttcccttcttgctgcctgggtatgggatcgagtgcgacctccagaagtacttttcttgtgtgtcgcctgtgctagaccatatcgagttcaaggacctgtgcacagtaggcacccacaacagttcatgtcctgtcagctgtgaagaaattgagtacccagcaacaataagctactccagctttccttcccaaaaagcattaaaatatttaagtaagaagctgaatcagtctagaaagtacattcgggagaacctcgtcaagatcgaaatcaactacagcgatttaaattacaagatcacacagcaacagaaggcagtaagcgtctccgaactgttggcggatctcggcgggcagctaggcctcttctgtggggcctcactgatcacaattattgagataatagaatatctattcactaacttctattggatttgcatatttttcttgctgaagatatccgaaatgacgcagtggacacccccaccacagaaccacttggggaacaagaatcggattgaggaatgctag

SEQ ID NO: 24327 - DNA, 2973 bp, Artificial Sequence
  Description of Artificial Sequence: Synthetic coding sequence
atgggtcccccttccagctcaggcttctacgtgagtcgagccgtagcactgctgcttgcaggtctggtagcagctctcctcctggccttggccgtgctagccgccttatacgggcattgtgaacgcgtcccgccatcagagctcccaggtttgcgggacctggaagcggagagctccccaccgttgcgtcagaagccaacacccacgcctaagcctagctccgccagggaattggccgtgaccaccactcctagcaattggcggccgcccggaccctgggatcagttgaggctacccccctggttggtgcctctccactatgatctcgagctctggccccagctccgccctgatgaactccccgcaggttccttgccctttaccgggagggtcaacattactgtgcggtgcacagtggccacaagtagactgttactgcactccctctttcaagactgcgagagagcagaagtgcggggcccgttatctccgggcacaggcaatgctacagttggcagagtgcccgtggatgacgtatggtttgctctggataccgaatatatggtgctggaactgagcgagccacttaagccaggttcgagctacgaactacagttgagtttttccggtcttgttaaagaagacctgcgagaggggttgttcttaaatgtttacacagaccagggggagagacgggctctcctggctagccagctggagccaacctttgctcggtatgttttcccttgcttcgacgagccagcactaaaggcaacctttaacatcaccatgatccatcaccctagctatgtcgctctgagcaacatgccaaagttgggccagtctgagaaagaagacgtgaacggttccaagtggacagtcaccactttttcaacgacccctcacatgcccacatatctggtagctttcgtaatatgcgactacgatcacgtgaatcggacagaaagagggaaagagatacggatctgggcccggaaagatgccatcgctaacgggagcgccgatttcgctctgaatatcaccggcccaatcttcagttttctcgaggacctgtttaatatatcttatagccttccaaaaactgacatcatagcactgccaagctttgacaaccacgctatggaaaactgggggcttatgattttcgacgaatctggactattgctggagcctaaggatcagctgaccgagaaaaagacacttatttcttacgtggtttctcacgagattgggcaccagtggttcgggaacctagtaaccatgaactggtggaacaatatctggctgaacgaaggttttgcctcctattttgaatttgaggtgatcaactatttcaaccccaaattgcctaggaatgaaattttcttctcaaatattctccataatattctgcgcgaggatcacgctttagtgacccgcgctgttgctatgaaggttgaaaatttcaagaccagcgaaatacaggagctcttcgacatttttacatacagcaaaggtgcatctatggcccggatgctgtcgtgcttcctgaacgaacacctgttcgtgtcagccctcaagtcatatttaaaaaccttttcttactcaaatgcagagcaggacgacctctggcgccactttcagatggcaattgatgatcagtcgactgtgatccttcctgctactataaaaaatattatggactcctggacgcaccaaagcgggttcccagtgattactctgaatgtttcaacaggtgttatgaagcaggagcccttttatctggagaacatcaagaataggaccttactgactagcaacgacacttggatcgttccaattctgtggataaaaaacggcacaactcagcctctggtctggttagatcagagcagtaaagtcttcccagaaatgcaggtgtccgacagcgaccatgattgggtgattctgaatctgaacatgacaggctactatagggtgaactacgacaaactcggctggaagaagctcaatcagcaacttgaaaaagacccaaaagctatcccggtcatccacaggctgcagctgattgacgacgctttttcgctgagcaagaataactatatcgagatagagaccgccttagaacttacaaaatatctggccgaggaggacgagatcattgtctggcatacggtcctggttaacttggtcacgcgcgacttggtttccgaagtgaatatctatgatatctacagcttgctgaagcgatacctgctcaagcgcctcaacttgatttggaacatttacagtacgattattagagaaaacgtcctggctcttcaggatgattacctcgccttgatctcgctggaaaagctgtttgtgaccgcctgttggctggggctggaagactgcctgcaactgagcaaagaactctttgctaaatgggtcgatcatccagagaatgaaatcccctaccccatcaaagatgtagtgctctgctacggaattgccctcggcagcgacaaggaatgggatattctgctcaacacctataccaacactaccaataaggaagagaagatccagctggcgtacgccatgtcctgcagtaaggacccttggatcctaaatcggtacatggagtacgctataagcacaagccccttcaccagcaatgagactaacatcatcgaggttgtcgcaagtagcgaggtcggaagatacgtcgcaaaggatttcctggttaataactggcaagctgtgtctaagcggtacggaactcagtcccttataaacctgatatatactatcggccggaccgtgacaacagacctacagattgttgaactgcaacaatttttcagtaacatgctggaggagcaccagcggattcgagtgcacgccaacttgcagacaatcaagaacgagaatctgaaaaacaagaagctcagcgcgagaattgccgcatggcttcgcagaaatacctag

SEQ ID NO: 24328 - DNA, 2940 bp, Artificial Sequence
  Description of Artificial Sequence: Synthetic coding sequence
atggggcctccctcttcaagtgggttctatgtctctcgagctgtggcattgttgctggccggtttagttgccgcactgctgttagctctcgccgtgctagccgctctgtacggccattgtgaacgcgtgcctccttcagaactgcctggattgagggacctcgaggctgagtcaagccctcctctccgtcagaagcccacaccaaccccaaagcccagttccgcgagagaactagccgtaactaccacacctagtaattggcggccaccaggcccttgggaccagctgcggcttccaccttggcttgttccactacactacgatttggaactgtggccccaacttaggcccgacgagctgccagccggatcactccctttcacaggacgcgtcaacatcaccgttcgctgcactgtggccacttcccgcttattactgcactctctctttttgagcccaggaaccggcaacgccaccgtgggaagggtaccggtggacgatgtgtggttcgcattagatacagagtacatggtattggaactcagcgaacctctaaagccaggctccagctatgagctccagctgagttttagtggactagtgaaggaggatctcagagaaggcctattccttaacgtttatactgaccagggcgagaggagagctctccttgcaagccagctggaaccaacattcgctaggtacgtattcccatgttttgacgagccagccctgaaagccacatttaacatcactatgatccaccatccatcatatgtggccttaagtaatatgcccaagctggggcagtccgaaaaagaggacgtcaacggctccaagtggaccgtcacaacattttcaacaacacctcacatgccgacataccttgtggcattcgtgatctgtgattatgaccacgtgaacaggaccgaacgcggaaaagaaatcaggatctgggccaggaaagacgctatcgcgaatgggagcgcagatttcgccctcaatataacgggcccaatcttctcttttctagaggacctttttaacatctcttattccctcccaaagaccgacatcatcgcgctcccgtcctttgataaccacgctatggagaattgggggctcatgatctttgacgaatctggactcctcttggaacctaaagaccaactgaccgagaaaaaaactctaataagctacgtggtgtcgcacgaaattgggcaccaatggttcggcaatctggttaccatgaactggtggaacaacatatggctgaacgaaggctttgcctcctacttcgagttcgaggtcataaactacttcaaccccaaactgccaagaaacgagatcttcttctccaatattttgcataatattctcagggaggatcacgccctggtcacccgagccgtggctatgaaggtggagaactttaaaactagcgaaatccaagaactctttgacatatttacgtattccaagggggcttcgatggcacgcatgctctcctgctttctcaacgaacacctgtttgtttctgcgttgaaatcttacctcaagacttttagctattctaacgccgaacaggatgacctgtggcgccacttccagatggcaatcgacgatcagagtaccgtcatattgcccgctaccattaaaaatataatggattcttggacacatcagtccggcttccctgtgataacactgaatgtgagcactggggttatgaaacaggagccattttatctggagaacattaaaaacagaacactgctcacctccaacgatacatggattgtgccaatattgtggattaaaaacgggaccacacagccgttagtgtggctagaccagtccagcaaagttttccccgaaatgcaggtaagtgactcagaccatgactgggtaatcctgaacctcaatatgacaggttattatcgagtgaactatgacaaactcggatggaagaagcttaaccagcaactggaaaaagatccgaaggccattcccgtaattcacagacttcagttgatcgatgacgccttctcactgtcaaaaaataactatattgagatcgaaacagccctggagctgacaaagtatctcgccgaagaggacgaaattattgtgtggcatactgtactggtgaacctggtgacgcgagatctggttagtgaggtaaacatctatgatatctactcactgctgaagcgctacttgctgaagcgcttaaatctcatctggaatatatacagcaccatcatccgtgagaacgttctcgcactgcaggatgactacttggctctgatatcactggaaaaactgttcgtgactgcctgttggttagggttagaggactgcctgcagttgagcaaagagctgtttgcgaagtgggtggaccacccggaaaatgagatcccctatcctatcaaggacgttgtgttatgctatggcatcgctctgggttccgataaggaatgggatattctccttaacacgtacacaaacacaactaacaaggaggaaaaaattcagcttgcgtatgccatgtcttgctccaaggatccatggatcctgaataggtacatggaatacgcaatatccacttcaccctttacttcgaacgaaacaaacattatcgaagtggtggcgagctctgaagttggaaggtatgtggccaaagacttcctcgttaacaattggcaggcagtgtccaagaggtatggcactcagtcccttataaacctcatttacactatcgggaggaccgtaaccaccgacttgcaaatcgtcgaactccagcaattcttctcgaacatgcttgaagagcaccagaggattcgggtacatgccaacctgcagacgatcaaaaacgagaacctgaaaaacaaaaaactatccgccagaatagcagcctggcttcgccggaatacctag

SEQ ID NO: 24329 - DNA, 681 bp, Artificial Sequence
  Description of Artificial Sequence: Synthetic coding sequence
atgaaggtggaaaattttaagaccagcgagatacaggagctttttgatattttcacgtactcaaaaggggcgagcatggcaagaatgctgtcctgctttctgaatgaacatcttttcgtctcagccctcaagtcgtaccttaagacatttagttacagcaatgccgagcaggatgacctctggcggcattttcagatggctatagacgatcagagcacagtgattcttcctgccacgataaagaacattatggatagctggactcaccaaagcggcttccccgtgatcaccttgaacgtgtccacgggcgtaatgaagcaggaaccattttacctggaaaacattaagaataggactctgctcacaagcaacgacacatggatcgtacccatcctgtggattaaaaacggcaccacacagcccctcgtctggctagaccaatcttctaaagtctttcccgagatgcaagtgtctgactccgaccacgattgggtgatcctcaacctgaatatgaccggttactaccgcgtgaactacgacaagctaggttggaagaagctgaaccagcagcttgaaaaggacccaaaggccataccagtgatccatcggttgcaactgattgacgacgctttctccctttcaaacctacaagacttcggccacctgaaggtccctaactag

SEQ ID NO: 24330 - DNA, 519 bp, Artificial Sequence
  Description of Artificial Sequence: Synthetic coding sequence
atgggagagtcttcggaagacatcgatcagatgttctccaccctgctgggagagatggatcttttaactcaaagtcttggggtcgataccttgccaccacctgatcctaaccctcccagggcagagtttaactactcagtgggatttaaggatttaaacgagtcccttaacgcactagaggaccaagatttagacgcactgatggctgatctcgtcgccgatatcagtgaagctgagcaaaggaccattcaagcccaaaaggagtctctgcagaaccagcaccactcggcatcattgcaagccagcattttttccggggccgccagccttggatatggcactaacgtggctgctacgggcatttctcagtacgaagacgatctgccccctcctccagccgacccggtgctggacctgcctctgccacccccaccaccggagcccttatcgcaggtctctatgtgggaccagaggtggcaggatcaccagccactcttaccaataacagacgtaccctag

SEQ ID NO: 24331 - DNA, 2001 bp, Artificial Sequence
  Description of Artificial Sequence: Synthetic coding sequence
atgggggaaagctccgaggacatcgatcagatgttcagcacgctgctcggcgaaatggatctgctgactcaatcattaggagtagacacgcttcccccaccagaccccaaccctccaagggcagagtttaattatagcgttggattcaaggacctgaacgaaagcctcaacgccctggaggaccaagatctggatgcattgatggctgacctggtggccgacatttctgaggctgaacaacgcactatccaggcacagaaagaatctctgcagaaccaacatcattctgcttcgctgcaagcaagtatcttctcgggtgccgcttcactggggtatggcaccaatgtggctgccactgggatatcccagtacgaggatgacctgcccccccctcccgccgatccagtgttggatcttccgctgcctccgcccccaccagagcccctgtctcaggaggaggaagaagcccaggccaaggcagataaaatcaagctagccctggaaaaattgaaggaagcgaaagtgaagaagctggttgtgaaggtccacatgaatgataatagtacaaagtcactcatggtggatgagagacaactggctagggacgtgctggacaacttgttcgaaaaaacacactgcgattgcaatgtggactggtgcttatatgaaatctatccggaactgcaaatcgagaggtttttcgaagatcacgagaatgtggtggaggttttatccgattggacacgggacactgagaacaaaattctgttccttgaaaaggaagagaagtacgccgtatttaagaacccccagaatttttacctcgataacagagggaagaaagaaagtaaagaaaccaacgagaaaatgaacgctaagaataaagagagccttcttgaggaaagtttttgtgggacttccattatcgtgcctgagcttgagggggccttgtatttgaaagaggatggcaagaaatcctggaaaaggagatatttcctgctcagggcctcaggtatctactacgtgcctaagggaaagacgaaaacaagcagagatcttgcctgctttattcagttcgagaatgtaaatatctattacggaacccagcataagatgaagtacaaggcccccactgactactgctttgtcctcaagcatcctcagattcaaaaagaaagtcaatacattaagtacttgtgttgtgacgatacacgcacattaaaccaatgggttatggggatcaggattgccaaatacggaaaaaccctgtacgacaattaccaaagagccgtggcaaaggcaggactggcgagccgctggactaacttagggaccgtgaatgccgctgctcccgcccaaccaagcacagggcctaaaaccggtacaacacaaccaaatgggcagatacctcaggccactcactcagtgtctgctgtactgcaagaggcacaacgacatgccgaaaccagtaaagataagaaacccgccctgggcaaccatcatgaccccgccgtccccagagctccccacgccccaaagtcttcgcttcccccgcctcccccagtaaggcggagctctgatactagtggcagtccagcaacaccactgaaggccaaagggactggtggaggggggttaccggcccctcctgatgatttcctgccaccccctccgccccctccccccctcgatgatcccgagctgcctccacccccacccgatttcatggaaccccccccggatttcgttccaccgccacccccatcttacgccgggatcgcgggctcagaattacctcccccgccccctccccctcccgcacctgcgccagcacccgtccccgattcagctaggccccctccggctgttgcgaaaagaccaccggtcccaccaaagcgccaggagaatccaggccacccaggaggtgccgggggtggggagcaggacttcatgtcagacctaatgaaggcgctccaaaagaagagagggaatgtgtcttag

SEQ ID NO: 24332 - DNA, 1908 bp, Artificial Sequence
  Description of Artificial Sequence: Synthetic coding sequence
atgggtgagagcagcgaagacatcgaccagatgtttagcacactcctgggtgagatggacctactgacccagagcctgggcgtagatactcttccaccccccgaccccaatcccccacgtgctgaatttaattattcggtgggatttaaggatctgaacgagtctttgaatgctttggaagaccaggacctggatgccttgatggcagatcttgtagccgatatatccgaggcggagcagaggactatacaggctcagaaagagagtttgcagaatcagcaccattctgcgagtctccaggccagtatcttctctggtgctgccagcctcggctatgggaccaatgttgcagcgacaggcatctctcagtacgaagacgacctgcctccaccacccgcagatcctgtgctggatcttccactgccccccccaccccccgagcctctttcccaggaagaggaggaagctcaggccaaggctgataagattaaacttgccctggaaaagctgaaggaagccaaagtcaaaaagctggtagtcaaggtgcacatgaacgacaatagtacaaagagtctcatggttgacgagcgccaactcgcgcgagacgtgctcgacaacctgtttgagaagacccactgtgattgcaacgtggactggtgtctgtatgagatctatccggagctgcaaattgagaggttctttgaggatcatgaaaacgtagttgaggttctcagtgactggactagagatacagagaacaaaatccttttcttagagaaggaagagaagtatgccgtgttcaaaaacccacagaatttttacctcgataaccggggcaagaaggagtcaaaagaaacgaacgagaagatgaacgctaagaacaaggaatcactgctggaggaatctttttgtggcacctctattatcgtcccagagctcgagggcgcactgtatcttaaagaagatggaaagaagtcctggaagaggagatacttcttgctgcgcgcaagcgggatatactacgtgccaaaaggaaaaaccaagacctcaagggacttagcttgcttcattcagtttgaaaacgtcaacatctactatggcacgcagcataaaatgaagtataaggcacccacagattattgctttgtgctcaagcacccgcagatacagaaagaaagccagtatatcaaatatctatgctgtgacgacacacgcaccctcaatcaatgggttatgggaattaggatcgcaaagtacggcaagaccttatatgacaattatcagagagccgtggccaaggcagggctcgcctcaaggtggacaaatctgggcactgttaatgccgctgctccagctcagcctagcacaggtccgaaaacagggactacccaaccaaacggccagatcccgcaggctacccactccgtgtctgcagtcttgcaggaggcacagaggcatgctgagacaagcaaagacaaaaagccagcccttggtaatcaccatgatccggccgtgcctcgcgcgcctcatgcgcctaagtcctcacttcctcctcccccccccgtgaggcggtcttctgacacttctggctctcccgcaactccgcttaaggcaaagggcactggaggcggcgggcttcctgctgcccgagcacgggccaggccaagaccaagattgcggcaagctgcgcccagaggcggccaggaggcaagctgtgccccccaggaggctcgggaacccagagcacctaggaggtctcggcggcggggggcccggttccacgtgagaccgcacgaaagcttcgcaaaggaagagagacagcgcgtgctcggcacaggcatgatgtccgtcccagaaggcgaggcgtctctgaccccatcggctggcttcgcgagtcggctgccctag

SEQ ID NO: 24333 - DNA, 738 bp, Artificial Sequence
  Description of Artificial Sequence: Synthetic coding sequence
atggcgcttgtgccctgccaggttttgaggatggccatcttactgtcttattgctccattttgtgcaactacaaggctatcgaaatgccaagtcaccagacttacggagggtcctggaagttcctcacctttatcgacttggtcatacaagcagttttttttggcatctgtgtgctcactgatttgtcttccctcctgaccagagggagcgggaatcaagagcaggagcggcaactcaagaaactgatttccttgcgggactggatgctcgctgtgctggcctttccagtgggagtcttcgtggtggccgtgttttggattatatacgcctatgaccgcgagatgatctaccctaagctgctcgacaacttcataccggggtggctgaatcatggaatgcatacaactgttctgccctttatcctgatcgaaatgcggaccagccaccatcagtacccgtcacggagctcaggccttacagccatctgcactttcagcgtgggatatatcctgtgggtgtgttgggtccatcacgtgaccggcatgtgggtgtacccatttctggagcatattggaccaggggcccgtattatctttttcgggagcaccacaatcttaatgaacttcttgtacctccttggggaggttctgaacaactatatctgggatacacaaaagaagcccccttcatggcaagatatgaagatcaagttcatgtacctcggaccatcatcctag

SEQ ID NO: 24334 - DNA, 561 bp, Artificial Sequence
  Description of Artificial Sequence: Synthetic coding sequence
atggcactggtgccctgccaggtgttacgtatggccatcttgctatcatattgtagcattctatgcaactataaggcgatcgaaatgcccagtcatcagacctacggaggtagctggaaattccttaccttcatcgacctgttcgttgtggccgtgttctggatcatatacgcctatgatcgagagatgatctatcctaagctcctggataacttcatcccaggttggctgaatcacggaatgcacacaaccgtgctccccttcattctcatagaaatgaggacgagccatcaccagtacccttctagatctagcggactgaccgccatatgtactttcagcgtcgggtatatcctgtgggtctgttgggtgcaccacgtgactggcatgtgggtatatcccttccttgagcatatcggacccggtgcccgaatcatcttctttggctccaccacaatactgatgaacttcttgtatctcttgggcgaagtgctgaataattacatctgggatactcagaaaagtatggaggaggaaaaggaaaaaccgaagctggagtag

SEQ ID NO: 24335 - DNA, 717 bp, Artificial Sequence
  Description of Artificial Sequence: Synthetic coding sequence
atggcccttgtcccatgccaagtgttgagaatggcgatcttgctctcttattgtagcattctgtgcaactacaaagccatcgaaatgccttcccatcagacgtatggcggatcctggaagtttctgacctttatcgatctcgtcattcaggccgtgttcttcgggatctgtgtgcttacggacctgagctcgttgctgacaaggggctctgggaaccaggaacaggagcgtcaactgaagaagctgattagtttgagggactggatgttggccgtgctggcattccccgtcggagttttcgtggtcgcagtcttttggatcatatatgcctatgacagggagatgatctaccccaagttgctagataatttcatccccggttggctcaatcacggaatgcacacaaccgtgctgccatttatactaatcgagatgcgaacatctcatcaccagtatcccagccgatcatctggtctaactgccatttgcactttctctgtcggctatatcctgtgggtgtgctgggtgcatcacgtgactgggatgtgggtatatccttttttggaacacatcgggcccggcgcccggattatcttctttgggtcgaccacaatactcatgaacttcctgtacttgttgggtgaggtgctgaataattacatttgggacactcagaaatcaatggaagaagagaaagaaaaacccaaactggagtag

SEQ ID NO: 24336 - DNA, 144 bp, Artificial Sequence
  Description of Artificial Sequence: Synthetic coding sequence
atggctttggtcccttgtcaggttctccgaatggccatcctgcttagctactgtagcatcctctgtaattacaaagctatcgagatgccgtcccatcagacatacggtggatcctggaagttcttgacgttcatcgacctgtag

SEQ ID NO: 24337 - DNA, 405 bp, Artificial Sequence
  Description of Artificial Sequence: Synthetic coding sequence
atggcacttgtcccgtgccaggttctgcgcatggccattcttttgagctattgtagcattctgtgcaactacaaagcgatcgagatgccaagccaccagacctatggaggcagctggaaatttctgacgttcatcgatcttgtgatccaggccgtgttttttggcatctgtgtgctgactgacttgagcagcctgctgacacggggtagcgggaaccaagagcaggagagacaactgaaaaaactgattagcttgcgggattggatgttggccgttctggcatttccagttggagtcttcgtggtagcagttttctggatcatttacgcctatgacagagagatgatttatcctaagctgctggacaacttcataccaggctggctgaatcatgggatgctgtag

SEQ ID NO: 24338 - DNA, 579 bp, Artificial Sequence
  Description of Artificial Sequence: Synthetic coding sequence
atgactaaggtgctccgcatggcaatactgctctcttactgttcaatactgtgcaattacaaagccattgagatgcctagccaccaaacatatggggggtcctggaagtttctgacatttattgacctggtcatacaagccgtctttttcggaatctgcgtgctcacagatctgagcagcctacttaccagggggtccgggaatcaggaacaggagcggcagctgaaaaaactaatcagtctgcgtgattggatgctggcagtgctcgcttttccagtcggcgtgtttgttgtcgccgtgttctggataatctatgcctatgacagagagatgatatatcccaaacttctagacaactttatccctgggtggctaaaccacggtatgcatactacagtgctcccattcatcttgattgagatgaggacgtcccaccaccagtaccccagtagatcgtctgggcttaccgcaatttgtacgttttcagtgggatatatcttgtgggtgtgctgggtacaccacgtaacaggtatgtgggtctacccattcttggaacacatcggacccggcgccaggtag

SEQ ID NO: 24339 - DNA, 705 bp, Artificial Sequence
  Description of Artificial Sequence: Synthetic coding sequence
atgactaaagttctgaggatggcgatccttctgtcctattgcagcatcctctgcaactacaaagctatcgagatgcctagccatcagacgtatggcggctcatggaagttcctgaccttcattgacctagtaatccaagccgtcttctttggcatctgtgtactcacagacttgtcttcactcttgactcgggggtccgggaatcaggagcaggaacggcaactcaaaaaattgatatccctgcgtgattggatgttggctgtccttgcgttccccgtgggcgtatttgtggtggcagtgttctggattatctatgcttacgaccgggagatgatttatcctaaattactggacaatttcattccaggctggttgaatcatgggatgcataccacagtcctgcctttcattctgatcgaaatgagaacatcccaccatcagtatccttctcgcagttctgggctgacagccatttgcacgttttctgtgggctatatcttatgggtgtgctgggtacatcacgtgacaggaatgtgggtttatcccttcttagagcatatcggcccaggcgcgcggataatcttttttggaagcaccactatcctgatgaattttctgtatctgctgggggaggtcctgaacaattatatttgggatacccaaaaaagcatggaagaagaaaaggagaagccgaagctggaatag

SEQ ID NO: 24340 - DNA, 375 bp, Artificial Sequence
  Description of Artificial Sequence: Synthetic coding sequence
atggcactcgtgccatgtcaggtgctgagaatggctatcctgctatcctactgctctatattgtgcaactacaaggccattgaaatgccatcgcaccagacatacggaggctcttggaaattcctaaccttcatcgatcttttcgtcgttgccgtgttttggataatttatgcgtacgaccgggagatgatataccctaaactgttggataattttatcccagggtggcttaaccatgggatgcataccaccgtactccctttcattcttattgagatgaggaccagccaccatcaatacccatcaaggagttctggactgaccgccatctgtacgttcagtgttggctatatcttatgggtttgctgggtctag

SEQ ID NO: 24341 - DNA, 417 bp, Artificial Sequence
  Description of Artificial Sequence: Synthetic coding sequence
atgttggccgttttggcgtttccagtcggggtgtttgtcgtcgctgtcttctggatcatctatgcttatgacagggagatgatctacccgaaattgcttgacaattttatccccggatggctcaaccacggaatgcatacaaccgtgcttccctttattctcatagagatgcgcacatctcatcaccaatatccttctcgctccagtggtctgacggcaatctgtacatttagtgttggctacattctgtgggtatgttgggtgcatcacgtgacaggtatgtgggtgtacccctttctggagcatatcggccctggcgccaggataatctttttcggctccacgaccatccttatgaacttcctatacctcctcggagaggtgttaaacaactatatttgggacacgcagaaatag

SEQ ID NO: 24342 - DNA, 1305 bp, Artificial Sequence
  Description of Artificial Sequence: Synthetic coding sequence
atggagtccgagagcgaatcaggggcagctgccgataccccaccactggaaacactgagctttcacggggacgaagagatcattgaggtggttgaactggatcccggaccaccagacccggacgatctggcccaagaaatggaagacgtcgactttgaggaagaggaagaggaggaagggaacgaggaaggctgggtgctagagccccaggagggagttgttggctctatggaaggcccggatgacagcgaggtcactttcgccttgcatagtgcctccgtgttctgcgttagtctggatcccaaaacaaatactttggctgttacaggcggagaagatgacaaagcatttgtatggcgcttgtcagacggggagctgctctttgaatgcgccggacataaagactccgtgacctgtgcaggcttttctcatgactccacactggtggcgacaggcgatatgtctgggctgttaaaagtctggcaggtggacaccaaggaagaggtgtggtcgttcgaagccggagatttggagtggatggagtggcatcctagagcccccgtgctattggcagggaccgccgatgggaatacatggatgtggaaggtgcctaacggcgattgcaagacctttcaggggccaaactgcccagcaacatgtggacgggtcctccccgatgggaaaagagccgtagtgggatacgaagatggtacaattcgtatttgggatctcaaacagggtagccccatacacgtcctgaaaggcaccgaaggccaccagggtccccttacgtgcgtggcagccaaccaggacggctccttgattctcaccggttctgttgactgccaggccaaactcgttagtgctactaccggtaaggtggtgggggtttttcggccagagacagtggcgagtcagcctagccttggcgagggcgaagaaagcgaatccaattccgtggagtcattaggcttctgctccgtcatgccgcttgccgctgtgggctatcttgacggtacactggccatctacgatctcgcaacacagaccctgaggcatcagtgtcaacaccaaagcggaatcgtgcaattgctgtgggaggcaggcacagctgtcgtttatacttgttcattagatggcattgttcgcctctgggacgcaagaacaggccgcctcctcactgactaccgtggtcataccgctgaaattctcgattttgctctgagtaaagatgcttccttggtggtgaccacttccggggatcataaagcaaaggtcttttgtgtgcagcgccccgatcggtag

SEQ ID NO: 24343 - DNA, 2721 bp, Artificial Sequence
  Description of Artificial Sequence: Synthetic coding sequence
atgtggcgtgccaagctccgacgtgggacctgcgaacccgctgtcaaggttgaagacccactgtgcaattttcactcaccgaacttcctccggatatctgaggtcgaaatgcgcggatctgaggatgccgcagcaggcaccgtcctccaacgtttgatacaggagcaactgaggtacggtacccccaccgaaaacatgaatctcttggccatccagcaccaggccaccggctctgcagggccagcccatcccactaacaacttctcttcgactgagaacttgacccaagaggatccccaaatggtgtaccagagcgcccggcaggagccgcaggggcaggagcatcaggttgacaacactgtgatggagaaacaggtgcggtccacccaacctcagcaaaacaatgaggagttgccaacctatgaggaggcaaaagctcagtctcagttctttcgggggcagcaacaacagcagcagcagcaaggggccgtgggtcacgggtactacatggcagggggaacctctcaaaaatcacgaaccgagggtcgacccacggttaacagagctaactccggacaggcacataaggatgaggcactgaaagaactgaagcagggacacgtccgcagcttgagtgagcgcattatgcagctgagcttggaaagaaatggggccaaacagcacctgccagggagcggcaatgggaaggggttcaaagtaggtgggggcccgagccctgcacagcctgctggtaaggtacttgacccaagaggacctcccccagaatatccattcaagacaaagcaaatgatgtcaccagtatccaagacgcaggagcacggcctcttttatggggaccaacaccccggaatgctccatgagatggttaaaccgtatcccgcccctcaacccgttaggaccgacgtcgcggtgctccgctatcagccaccacctgagtacggggttaccagtagaccatgccagttgcctttcccctctacgatgcagcaacatagccccatgtcgtctcagactagctccgcatctggacccttgcactcagtttccctccctctgccattacccatggctcttggcgccccccagccaccccctgccgcatcaccgtcccaacagctcggccctgacgctttcgccatcgtggaaagagctcagcagatggttgagattctgacggaggaaaatagggtgctccatcaggaacttcagggctattacgacaacgccgacaagctgcacaagttcgagaaagagctccaacgtatatctgaggcatacgaatcccttgtgaaaagtaccacaaagcgggaatccctggataaggcaatgagaaataaactggaaggcgagattcgtagactgcatgactttaatcgcgacctcagagatcgattagaaactgccaataggcagctctcctctcgcgaatatgagggtcacgaggataaggctgccgaaggccactacgcatctcaaaataaggaatttttaaaagagaaggagaagctcgaaatggagctcgctgctgtgaggaccgctagcgaggatcatcgcaggcacatagagatactggaccaggctctcagcaacgctcaagcacgtgtgatcaagctggaggaagagcttcgggagaagcaggcctatgtggaaaaagtcgagaagctgcagcaggctctgacccaattgcagagcgcttgtgagaaacgcgaacagatggagcgacgcctgcgaacatggttggaacgggaacttgacgcactgcgaacacagcagaagcacgggaacggtcagcccgccaacatgccggagtacaatgcacctgccctgctcgagcttgtgcgggaaaaggaagagcgcattctagctttggaggccgacatgaccaagtgggaacagaagtatcttgaggagagcactatccgacacttcgctatgaatgccgcagcaactgccgcggctgaaagggatacaaccataatcaatcactcccgtaacggaagttacggtgagtcaagccttgaagcccacatctggcaagaagaagaagaggttgtccaggctaatcggcggtgtcaggacatggagtacaccatcaaaaatctacatgccaagataatagagaaggatgctatgatcaaggtgctgcagcagcggtcccggaaagacgcagggaagactgattctagtagcctgaggcccgcacgctcagttccctcaattgccgcagcaactggtacacacagccgccagacctccctgacgtcctcccagctggccgaggagaagaaagaggaaaaaacttggaaggggtccatcggtctgctactgggaaaggaacatcatgagcatgctagcgcccccctgctgcctcctcctcctacaagcgctttgagttcaatcgccagtaccacggcggcttcatctgctcatgccaaaacaggcagcaaagattctagcacacagacggataaatccgccgaactgttttggccaagtatggcttccctcccatccagaggccggctcagcactacgcctgcccactcccctgttcttaagcaccctgcagcgaagggcactgccgagaaactggaaaattctccaggacacggcaaatcacctgatcacaggggcagagtgagcagtctgctacacaagcctgagttccccgatggtgaaatgatggaggtgctgatatag

SEQ ID NO: 24344 - DNA, 1632 bp, Artificial Sequence
  Description of Artificial Sequence: Synthetic coding sequence
atgtggagagccaaactgcgacggggtacatgcgaacccgcggtgaagggttccccttcggcgtgttattcaccaagtagtccagtccaggtgttggaggacagtacatacttttccccggactttcagctctattctggccgtcatgagacttccgccctgacagttgaggcaacatcaagcattcgcgagaaagtagtggaagatcccctgtgcaatttccactctccaaacttccttcggatctcggaagtagagatgaggggcagcgaggatgctgctgctggaaccgttctccaacggctgatccaagaacagctgcggtacggcaccccaactgagaatatgaatctgctggccattcagcaccaagccaccggtagcgcgggacccgcacacccaaccaataattttagttctacagaaaacctgacacaggaggatccccagatggtctatcagtctgctcgacaggagcctcagggccaggagcaccaggtggacaatactgtcatggagaaacaagtgagatctacccagccacagcaaaataatgaagaactgcctacgtacgaagaggccaaagctcagtcccagttctttaggggtcagcagcaacagcaacagcagcagggggcggtgggccatggctattacatggcagggggaactagtcagaaatccaggaccgaggggagaccaactgtcaatcgtgccaattccggccaggcccacaaagacgaggcactaaaggaactcaagcaaggacacgtgcgcagtctcagtgagagaataatgcagctgtcattggagcggaacggcgcaaaacaacacctgcctggaagcggaaatggtaaggggttcaaggtgggcggtggtccaagtcctgcacagcctgcaggcaaagtcttggatcctagaggcccacccccggagtacccgttcaagaccaaacaaatgatgtcacccgtgagtaagacacaggaacacggactgttttacggtgatcaacatcctggcatgttgcacgaaatggtgaagccataccccgcgccccagcctgtgcgaacagacgtggcagttttgcggtatcaaccacctcccgagtatggagtgactagcagaccttgccaactcccttttccttcaactatgcagcagcattcacccatgaatttcaggacgagcctaaccagtagtcagctcgccgaagaaaagaaagaggaaaagacttggaagggctcaattggtttactgctgggcaaggaacaccacgaacacgcaagcgctcctctgcttcctcccccaccaacgagcgccctctcttcaatcgcatccactacggcggcatccagcgcacacgctaaaacgggatctaaggactcctcaacgcaaacagacaagagtgctgagctgttctggccatcgatggcttccctgccatctcgaggccgcctgagtacaacacctgcccatagccctgtgctcaagcaccctgcagcgaagggcactgccgaaaagcttgagaacagtccaggtcacggtaaatcaccagaccaccggggtagagtgagctccctcctgcataagcccgagttcccggatggcgaaatgatggaagtgcttatctag

SEQ ID NO: 24345 - DNA, 2871 bp, Artificial Sequence
  Description of Artificial Sequence: Synthetic coding sequence
atgtggagggctaaactgcgcagaggcacctgtgaacccgccgttaagggaagcccgagtgcatgttattctccctcatcacctgtccaagtcctcgaggactccacttatttttccccggacttccagttgtatagcggccggcacgagacaagcgccctgacagtagaggctacttcttctatccgcgaaaaggtggttgaggaccccttgtgtaactttcacagtccaaacttcctgcggatcagcgaggtcgaaatgcgaggatcggaggatgccgcggccggtaccgtgctccaaaggctgattcaggaacagcttagatatggcacgcctactgaaaacatgaacctcttagctatacagcaccaggccaccggctctgccggccccgcccaccccactaataatttttcctctaccgaaaacctgactcaagaggacccacaaatggtgtatcagagcgcgagacaggaaccccagggccaggaacaccaggtggataacaccgtaatggagaagcaggttcggtctacgcagccccagcagaacaacgaagaactgccaacatacgaagaggctaaagcccagtcccagtttttcagaggccagcagcagcagcagcagcaacagggggcagtgggtcatggatactacatggccggtggcacgagccagaagtcccgcactgagggaagacccacagtaaacagggccaattccggccaggcccacaaggacgaggctctcaaggagctcaagcaagggcacgttcgctcactgtccgaacgcattatgcagctctcgctggagcgcaacggagcgaagcagcacctgccaggaagcggaaacggcaagggattcaaagttggcggtgggccctccccagctcagccggccgggaaggtgctggatcccagaggccccccccccgagtatccctttaaaactaagcagatgatgagccctgtatccaaaactcaggaacatggtctgttttacggtgatcaacatccagggatgcttcacgagatggtcaagccgtatcccgctccacaaccggttcgcaccgacgtggctgtccttaggtatcagccacctcccgagtacggtgtgacgagccggccctgtcaacttccctttccttccactatgcaacagcattcccctatgtctagccagacaagcagtgcgagcggccctctgcattcggtcagtctgcccctgcccctccccatggcccttggcgccccacagccaccgcccgcagcctctccatctcagcagctggggccagatgcctttgcaattgtcgaaagggcccagcagatggtggaaatattgacggaagagaacagggtgcttcatcaagaactgcaaggctattatgataacgccgacaaactccataaattcgagaaggaactgcagagaatttcggaagcctacgaatcactggtgaaaagcacaacgaaaagggaatctctcgacaaggccatgcgtaataagctggagggtgaaattcgacgcctgcacgacttcaaccgcgacctgcgggaccgcctagagaccgcaaataggcagctatcgtctagagagtacgagggccatgaagacaaggccgccgagggacactacgcatcacagaataaagaattcctgaaagagaaagagaagttggaaatggaattggccgcagtgagaactgcctccgaggaccacaggcgccacatagaaatactggaccaggcactttccaatgcacaagcccgggtaattaagcttgaagaagagctccgagaaaaacaagcatacgtcgaaaaggtggaaaaattacagcaggccttaacacagctgcaaagtgcctgcgaaaagcgcgagcagatggagcgccggctaagaacctggctggagagggagctggacgcactaagaactcagcagaagcatggtaacggacagcctgctaacatgcccgagtacaacgcccctgcccttttggaactagttcgcgagaaggaagaacgaattctggcgcttgaggccgacatgactaagtgggaacagaaatacttggaggagagcaccatacgccattttgccatgaatgccgccgccaccgctgccgcagagcgagatacaaccatcataaatcactccaggaatggttcctatggcgaatcttcactggaggctcatatttggcaggaggaagaagaggtggtccaagctaatcgtcgttgccaggatatggaatacactattaagaatctacacgctaaaatcattgagaaagacgccatgattaaggtcctgcagcagcgcagccgcaaagacgccgggaaaacagactctagttcgctgcgcccggcccgttctgtgccgagtattgctgcagcaacaggaacccatagtcgacagacatctttgaccagcagtcagctggccgaagaaaagaaggaagaaaaaacctggaagggaagcataggcctgcttctgggaaaggagcaccacgaacacgcttcagcacccctgctccctccacctcccacctccgcactctcctcaatcgctagcacgacagctgcatcttcagcccacgctaagacaggaagcaaagactcatccacccagacagacaaaagcgcagagttattttggccaagtatggcgtcgctaccctctaggggcagactcagcactactcctgcacacagtccggttctgaaacatcctgctgctaagggcactgcggaaaagctggagaattcacctggccacgggaagtcccccgaccatagaggccgtgtaagctctcttctgcacaaaccggagtttcctgatggtgaaatgatggaggtgcttatctag

SEQ ID NO: 24346 - DNA, 1836 bp, Artificial Sequence
  Description of Artificial Sequence: Synthetic coding sequence
acaagccatgatcgactcatgtggcgagccaagctgagacggggcacatgtgagccagccgtcaagggctcgccaagtgcgtgctatagccctagctctccagtccaggtactggaagattccacctacttttcccctgattttcagttatactccggacgccacgaaacaagcgctctaacagtggaggccacctcctccattcgcgaaaaggtcgttgaggaccctctctgcaatttccacagccctaatttcctgagaataagcgaagttgagatgagggggtccgaagatgccgctgcgggtactgtgctgcaacggttgatccaggagcagctgaggtacgggacccctaccgagaatatgaatcttctggccatccagcaccaggccactgggtcagccgggccagctcaccccaccaacaattttagttcgaccgaaaatctcacacaggaagatccccagatggtttaccagagcgcccgacaggaaccacagggtcaggaacaccaagtggataacaccgtaatggaaaagcaagttcgaagcacacaacctcaacagaacaacgaggaattgcctacttacgaagaggctaaagcccagagtcagttctttaggggccagcagcagcagcaacaacagcagggcgccgtcggacacggttattatatggccggaggaaccagccaaaagagcagaacagaaggcagacccaccgtgaaccgcgccaacagcggccaggcccataaagacgaggccctgaaagaattaaagcagggccatgtaaggtccctgtccgaaaggattatgcagctttccctggaacggaatggcgctaagcagcatctgcctggatcagggaatggaaaggggttcaaggtgggcggtggccccagccctgcccagcctgctggcaaagtgttggacccaagaggaccacccccagagtatccattcaagaccaaacagatgatgtccccggtgagcaagactcaggaacacggtctgttttacggggaccagcatccaggcatgttgcacgagatggtgaaaccctatcccgctcctcagcctgtgaggactgacgttgccgtgttgcggtaccagccccctcccgagtacggggttacctctcgaccatgccaactgccattcccttctactatgcagcagcattcacctatgagcagtcaaacctccagtgcctcaggaccactccatagcgtctcccttcctctacccctccccatggctctgggcgccccgcagccacctcccgccgccagccccagccagcagctgggccccgacgcatttgcaatcgtggaaagagcacagcaaatggtggaaatcctgacagaggagaacagagtgcttcaccaggaattacaaggatattacgataacgccgacaagctgcacaagtttgagaaagagcttcaaagaatttccgaggcctacgagtctctcgtcaagagcaccaccaagagagaatctctggacaaggctatgcgaaacaaactcgagggggaaataaggcggttgcatgacttcaatagagacctcagagatagattggaaactgccaaccgacagctctccagccgcgaatatgagggtcacgaggataaggctgctgagggacattacgcatcccagaataaggaattccttaaggagaaagagaagctcgaaatggaactcgcagcagtaagaactgctagcgaagatcataggcgccatattgagatcctagaccaggctctctctaacgcccaggccagacaccaagcgggaagaggagtgacccgggaggcatccatctgttag

SEQ ID NO: 24347 - DNA, 2343 bp, Artificial Sequence
  Description of Artificial Sequence: Synthetic coding sequence
atgagaacattggaagacagcagtggtacagttctgcacaggttgatccaagaacagctgaggtacggtaatctgacagagactagaacccttttggccattcagcagcaggctcttcgtggcggcgctggaaccggaggtacagggagcccccaggccagtctggagatcctggcaccggaggacagccaggtgctgcagcaggctactaggcaagaaccacagggtcaggaacatcagggcggggaaaaccacttagctgagaatacattatatcgactgtgcccccaaccatccaaaggcgaagagctgcctacctacgaagaagcgaaggcacacagtcaatattatgctgcccagcaggccggcaccagaccgcacgcaggagatcgggacccccggggagctcccgggggaagccgcaggcaggatgaggccctcagagaattgcgacatggacacgtgagaagcctgagtgagcggttgttgcagctctccctcgagcgaaatggagcccgtgcgccatctcatatgagttcaagccactccttcccccagctggctcggaatcagcaaggcccccccttgcggggaccccccgctgagggtccggaatcccgagggcctccaccacaatacccccatgtagtcctggctcatgaaacaaccaccgcagtgacagatccgcggtatcgagcacggggaagcccacatttccagcacgccgaagtgcgtattctgcaagcacaagtgccgcctgtgtttctgcagcagcagcaacaataccagtacttgcagcagagccaggagcaccctcccccaccgcaccccgctgctctcggccatggacccctgagctccctgtcccctccggccgtggaaggacctgtgagcgcgcaggctagctctgcaaccagtggttcggcacacttagcacagatggaggccgtgctgcgggagaatgcccgactgcagcgggacaatgagagactccagagagaacttgaaagtagtgctgaaaaagctggtcgcatcgagaagctagaatcagaaattcagaggctctccgaagcccacgaatcgctgaccagggcctcttccaagcgcgaagcccttgagaaaactatgagaaataaaatggacagcgaaatgaggaggttacaggattttaatcgggatctcagagaacggttggaatctgctaacagaagactggcgtctaagacacaggaagctcaagcaggcagtcaggacatggtcgccaaacttttggcccaaagctatgaacaacagcaagaacaggagaagctggagcgagagatggcactcctacgcggcgctattgaggatcagcgtcggagagccgagctcctggagcaggctctcggtaacgcacaggggcgcgccgctagggctgaggaagaactcagaaagaaacaggcctatgtggaaaaggttgagcgcctccaacaagcgttagggcagctgcaggccgcttgtgaaaagcgagagcagctggaacttcggctccgaacacggctggaacaagagctgaaagctctcagggctcagcagcgacaagctggcgctccaggcggctcatcggggtcaggtggtagccccgagttgtccgctctgcgcctgtccgagcaactcagagagaaggaggaacaaatcttagcacttgaagcagatatgactaaatgggagcagaaatatctagaagagcgtgctatgcgccagttcgcgatggatgccgctgccaccgccgccgcccagagggacacaaccctcatccggcatagcccccagccttcccctagttcttcctttaacgaaggtctgttgacgggcggtcatcggcaccaggaaatggagtcacggttgaaggtcctgcatgctcagatcctggaaaaagacgccgtaatcaaagtgctccagcagaggtctcgacgggaccctggaaaggctatccaagggagcctgaggcctgccaaaagtgttccctcagtatttgccgctgctgccgctggaacacagggatggcaaggcctctcatcatctgagcgccagactgctgatgccccagcacggctcacaacagcggatcgcgcacccacagaagaacccgtggtcaccgccccccccgccgcgcatgctaaacacgggtctagggatggctctacacagactgaaggaccacccgatagtacaagtacttgcctcccaccagaacccgattctctcctgggttgtagcagttcacagagagccgctagcttggactctgttgccacgtctagggtgcaggatctgtctgacatggtggagatactaatttag

SEQ ID NO: 24348 - DNA, 2340 bp, Artificial Sequence
  Description of Artificial Sequence: Synthetic coding sequence
atgagaaccctggaggactctagcgggactgtattacatcggctgatccaggaacagctgagatatgggaacctaaccgaaacacggactcttcttgcaatccagcagcaagcactccgcggaggggctggcacgggcggcactggaagccctcaggcttcactagagatccttgcgcctgaggattcacaggttctccaacaggccaccaggcaggagccgcagggacaggagcaccaaggcggtgaaaaccatttagcggagaacaccttgtatcggctatgcccgcagccgtcgaagggagaggaactgcccacatacgaggaggccaaggcgcattcacagtactatgccgcccagcaggccggaactcgccctcatgcaggtgatagagatcctagaggagcaccagggggctcaaggcggcaagacgaagcattgcgcgagctccggcatggacacgtgcggtctctttctgagagactgctgcaactcagtctcgagcggaatggcgccagagccccttcccacatgagtagtagtcactctttcccccaacttgccagaaaccagcagggacctcccctccgcggacctcccgctgaaggtccagagagcagaggcccacctcctcagtatcctcatgtagtcttagctcatgaaactacaactgctgtgactgatcccagataccgggcccgtggatccccacacttccagcatgccgaggtgcggatactgcaggcccaggtacccccagtttttctgcagcagcagcaacagtatcagtacctacaacagtctcaagagcatcccccacccccccatccagcggctctaggccatgggcctctgtcgagcctgtctcccccagccgtagaggggccagtaagtgcacaggcaagttctgctacgagcggaagcgcccatttggctcagatggaggccgtcctacgcgagaacgctcgcctgcagagagacaacgaaaggcttcaacgggagctggagagcagtgctgagaaggcgggaaggatagaaaaactggagtcagagatccagcggctcagcgaagcacatgagtccttaactcgcgcgagtagcaaaagagaggccctagagaagacaatgaggaacaagatggactctgagatgagacggctgcaagactttaacagagatttgcgggaacgcctggagtcagccaatcgcagattggcatccaaaacccaagaggcgcaagccggctcccaggacatggtagctaagcttcttgcccagagctatgagcagcagcaggaacaggaaaagttggagcgggaaatggcactgttgagaggagcgatcgaagaccaacgcaggcgggcagaacttcttgagcaggctctcggaaacgcccaagggcgcgccgcaagagccgaggaggagcttcgcaaaaagcaagcttacgttgagaaagttgagcgcctccagcaggcccttggtcagctacaggccgcctgcgaaaagagagagcagctggagttgaggcttcgtactcgtttggaacaggagctgaaggcccttcgggctcagcagcgccaggcaggcgcgcccggcgggtcgagcggctctggaggtagccctgagctctctgccttacggctgtcggagcagttgagggaaaaggaagaacagatcctggcgctggaagcagacatgaccaagtgggagcaaaaatacctcgaggagagggccatgcggcaatttgctatggacgccgccgccacagcagcagctcagcgggatactaccctcatccgccactctcctcagccatcgcctagctccagctttaacgaaggtttgttaacaggaggacacagacaccaggaaatggagtcacgcttaaaagtgctgcacgcacagatcttagagaaggacgctgtaattaaggtcttacagcaaaggagtcgtcgtgatcctgggaaagctatacaggggagtctgaggccggctaagtctgtgccaagcgtttttgctgccgcggcggcaggcacccaggggtggcagggtttgtccagttccgaacggcagacggccgatgcccctgcaagactaaccacagatagggcaccaacagaggagccggtcgtgaccgccccaccggcagctcatgctaaacacggctcgagggatggttcaacccagactgaaggcccccctgattctacctccacctgtctcccgcccgaacccgattcacttctgggatgtagcagctctcagagagccgcaagccttgactccgtcgccaccagcagagtgcaagacctttcggacatggtagaaattctgatttag

SEQ ID NO: 24349 - DNA, 102 bp, Artificial Sequence
  Description of Artificial Sequence: Synthetic coding sequence
atgcgaacccttgaagatagtagcggcactgtactccaccgcctgattcaagaacagttaagatatggcaacctaacagagacacgcacgctgctcgcctag

SEQ ID NO: 24350 - DNA, 456 bp, Artificial Sequence
  Description of Artificial Sequence: Synthetic coding sequence
atgcggacgttggaggactccagtggcacagtgctccacaggcttatccaggagcagcttaggtacgggaatttgaccgaaacccggacactcctggctattcagcagcaagcccttcgcggaggggctggcaccggtggtacaggctccccgcaggcatcccttgagatcttggctcccgaagacagtcaggtcctgcagcaggcgacccggcaagagccgcaaggccaggagcaccaggggggggaaaatcacttagcggagaatactctttaccgtctatgccctcaacctagcaagggagaagaacttcctacatacgaagaagctaaagcccacagccaatattacgctgctcaacaggccggaaccaggcctcatgcaggggacagagaccctcgtggtgcacctgggggatcccgccggcaagatgaggccctccgcgagctacgatag

SEQ ID NO: 24351 - DNA, 435 bp, Artificial Sequence
  Description of Artificial Sequence: Synthetic coding sequence
atgcggacactcgaagactcctccggaacagtccttcacagactgattcaagaacaactgaggtatggtaacttgaccgaaactcggacgcttttggctatccaacaacaagcactacgtggcggagcagggacgggaggaacaggttctccccaggcatctctagaaatcttggcacctgaggatagccaggtgcttcagcaagctactcgccaagaaccacagggccaggaacatcagggaggggagaaccacttggcggagaacacgttataccggctctgtccacaaccaagcaaaggcgaagagctgcccacttacgaagaggctaaggcccatagccaatactacgcagcacagcaggccgggacccgcccccatgctggtgatcgggacccaagaggtgcccccggaggtagccggagacaggactag

SEQ ID NO: 24352 - DNA, 384 bp, Artificial Sequence
  Description of Artificial Sequence: Synthetic coding sequence
atgaggaccttggaggactctagcggcaccgtgttgcacaggttgattcaagagcaattaaggtacggcaacctcaccgagacccggactcttctggcgatccagcagcaggctctgcgaggaggcgccggaactggcgggactggtagtcctcaggctagcctcgaaatccttgctcctgaggactcacaggtgctgcagcaggcaactcgacaagaacctcaaggacaggaacaccagggcggggaaaaccatctcgccgaaaacaccttgtatcgcctgtgccctcagccaagcaaaggtgaggaactgcccacctatgaagaggcaaaggcccattctcaatactacgctgcccagcaggccggtacaagaccacactag

SEQ ID NO: 24353 - DNA, 597 bp, Artificial Sequence
  Description of Artificial Sequence: Synthetic coding sequence
atgaggacactggaggactcaagtggcaccgtgctccaccggttgatccaggaacagctgcgctatggcaatttgacagaaaccaggactttactggccattcagcaacaagccttaagggggggcgcaggtaccggcggcacaggctctccacaagcaagcctggagattctcgcgcctgaggatagccaggtcctccagcaggcaacacggcaggagccccaagggcaggaacaccagggtggggagaaccatctggctgaaaacacgctgtacagactttgcccccagcctagcaagggagaagagctgccaacgtacgaggaggcaaaagctcacagccagtattacgcagcccaacaagctggcactcggcctcacgcaggcgatcgtgatcctcgcggggcccctggagggtctcgcaggcaggatgaggcccttcgagagctacgacacggccacgtgagatctctttccgaacggctactgcagctgtctctagagaggaacggcgcccgagcaccatcccacatgagcagctcccactcatttccacagctggccagaaatcagcagggaccccccctcaggggatag

SEQ ID NO: 24354 - DNA, 2334 bp, Artificial Sequence
  Description of Artificial Sequence: Synthetic coding sequence
atgagaaccctggaagacagctcagggacggtcttgcatcgcctgattcaggaacagcttcggtacggaaacttgactgagactagaacactgctagccattcagcagcaagcactgagggggggcgctgggactggcggaacgggctccccccaggcttcacttgagatactggcccccgaagacagccaggtgctgcagcaggcaaccaggcaggagcctcagggtcaggagcaccagggaggcgagaatcatctcgccgagaacactttatatcgactatgcccacagcctagcaaaggagaggaattacctacatatgaagaggccaaagcccattcccagtattacgctgctcagcaggccggtacaagacctcacgccggggaccgggaccccaggggcgcgcccggtgggtccaggcgtcaggacgaagcgctgagggaacttagacatgggcacgtccggagcctgagcgaacgcctgctgcagctctcactggagagaaatggcgcaagagcaccctcccacatgtcaagctctcacagcttcccacagctcgcgcgtaatcaacaaggtcccccacttagaggtccaccagcggaaggccctgaatctcgtggaccgcccccccagtaccctcatgttgtcttagcacacgagaccacaaccgctgtcacagatccgaggtatagggccagaggctcccctcacttccaacatgctgaggtacgaatcctccaggctcaggtacctccagtgttcctccaacagcagcagcagtatcaatatcttcagcagtcccaggagcatccaccccctcctcatcccgccgcgctgggacatggccccttgagcagtctgtcaccgcctgccgtggaaggtcctgtatcagcccaggcctcttcagccacgtccggtagtgcacacttggcccagatggaggctgtccttcgggaaaacgcccggctccagagagacaatgaacgtctccaaagagagctcgaatcatctgcagaaaaggctggacggattgagaaacttgagtctgagatacaaaggctcagcgaagctcatgagagcctgactcgcgctagttcaaagagagaagcgctcgagaaaacaatgagaaacaagatggacagcgaaatgcggaggctacaggattttaatagagacctcagggaaagactggaatctgcaaacagaaggctcgcatcgaaaacacaagaggcacaggcgggatcacaggacatggtggctaagcttctcgcccagtcctatgaacagcagcaagaacaagagaagctggagagagaaatggcccttcttaggggagccattgaagaccagagacggcgggccgagctcttggaacaggccctaggcaacgctcaaggcagagctgcacgcgcagaggaggaactgcgtaagaagcaggcctatgttgaaaaggtggaaaggcttcaacaagcactgggacaactccaggccgcctgtgagaaacgcgagcagctggagttgcgtctaagaaccagattggagcaggagctgaaagccttgcgggctcagcaggccggcgcgccagggggatcctcgggctccggcggttcccccgaattaagtgcacttcgactgtcagaacagctgagggagaaggaagaacagatcctcgccctggaagctgacatgactaagtgggagcaaaagtacctggaagagcgggccatgcgtcagttcgcaatggacgcagccgcaacagccgctgctcagcgagataccaccctgatccggcattcaccccaacccagcccttcatcctcgtttaacgaggggctgctaacaggggggcacagacatcaggaaatggagtcaagactaaaggtgctccacgcacagatcctggaaaaggacgctgtgatcaaagtgcttcagcaaagaagccgacgcgatcctgggaaagcaattcagggcagccttagaccagcaaaatctgtgccaagcgtatttgccgctgctgcagcagggacccagggctggcaagggctgagctctagcgaacggcagactgcggatgccccagccaggctcacgaccgaccgagcgcctaccgaagagccggtggtgaccgcacccccggcggctcacgccaagcacggttcgagagacggctcaactcaaactgagggtcctcccgactcaaccagcacgtgccttcctcctgagcctgatagcttactaggatgtagttcttcacagagggctgctagcctggactcggttgcaacatcacgcgtccaggatctgagcgacatggttgagatcctgatctag

SEQ ID NO: 24355 - DNA, 2514 bp, Artificial Sequence
  Description of Artificial Sequence: Synthetic coding sequence
atgaccgggaggaaggcaagtgggggaacaccctgcacattacggaagggcgcccctattatcacactaggtaagaactggactgagaggctcgccgccggcgatagcgtcggatgcagtggtgctagatgtcacaggcctctgagcagacagctttgtgctagccaaaggagcatgcgcaccctcgaagatagcagtggaacagtcctgcatagattgatccaggagcagctgcggtacgggaatctcaccgaaactcggacccttctggcaattcaacagcaggccctgagaggcggggcggggactggcggtacaggcagtcctcaggcctcccttgaaatccttgccccagaagacagccaggtcctgcaacaggccacgaggcaggaacctcaggggcaggagcaccagggtggggagaatcatctggccgaaaatactctgtacagactgtgtccacaacctagcaagggcgaggagttgcctacatatgaggaggctaaagcgcatagccagtattacgcggcccagcaagccggaacccgcccccatgccggagacagggaccctcggggagctccaggcggaagcagacggcaggatgaagccctaagagaactcaggcacggtcacgttcggagtctgagtgagaggctgctccaactttccctggaacggaacggcgcccgggccccatctcacatgtcttcctcacactcgtttcctcaattggccaggaaccagcagggccctcctcttcggggacctccagccgagggtccagagtctagaggcccccccccccagtacccacacgtagtgctcgcgcatgaaactacaacggcagtgacagaccctaggtatcgcgcccgcggcagcccacatttccagcatgcagaggtgcgtatcttacaggcacaggtgcctcccgtctttttacagcaacagcagcagtatcagtatctccagcagtcacaggagcatccacccccgcctcaccccgctgcccttgggcacggcccgctgagcagcttgtcccctccagcggtggaggggccggtgagtgctcaagctagttccgccaccagtggctctgctcacctggcccagatggaggccgtgcttcgagaaaacgcccgtcttcaacgcgacaatgagcgcctgcagcgcgagttggagagcagcgccgaaaaggccggacggattgagaagctcgagtccgagatacagaggttgtccgaagctcacgagagcttgacgcgagccagctctaaacgtgaggccctcgaaaagaccatgagaaataagatggattctgagatgcgcaggctacaggacttcaaccgggacttgagggaacgcctggagtctgcaaataggcgcctggcctccaagactcaagaggcccaagctgggtcccaggatatggtggcgaagttgcttgctcaaagttacgaacagcaacaggagcaggaaaagttagagagagaaatggcactccttcggggggccatcgaggaccagcgacggagagccgaactcctcgaacaggcattggggaacgctcaaggacgcgcagctcgggcagaggaggagctgagaaagaagcaggcatatgtggagaaggtagaaagactccagcaggcgttgggtcagctgcaggctgcctgcgaaaagagggaacagcttgagttgaggttaaggacccgtctcgagcaggagctgaaagccttgcgcgcccagcagagacaggctggcgcccctggtggctcctcgggctctggcggctcccctgagttgagcgcattgcggctgtctgaacagttgagagagaaggaggagcagattctggccctggaggctgatatgacaaaatgggagcagaaatacttggaagagcgggccatgaggcagttcgcgatggatgcggccgccactgccgccgcacagagggacaccacacttatccgccacagcccccagccttccccaagctcgtccttcaacgagggcctcctgactggcgggcaccgtcaccaagagatggaatctaggcttaaagtgttacacgcgcaaattctggagaaggacgctgttatcaaagtgctgcagcaacggtcccgaagagaccctggaaaggcgattcaaggtagcttgcggcccgcaaagtccgtgccaagcgtatttgccgcagccgcagccggcactcaggggtggcaggggttgtcttcttcagagagacagactgccgatgcaccggctcgcctcactacagatcgagctcctactgaggagccagtggtcactgcccccccagcggctcatgcgaagcatgggagcagggacggaagtacccaaacggagggcccgccagatagcacctctacttgcctgccacccgaacccgattcactcttgggctgctcaagcagccagagggcggcctccctggatagcgtagccacctcaagagtccaggatttgagcgacatggtggagattttaatttag

SEQ ID NO: 24356 - DNA, 372 bp, Artificial Sequence
  Description of Artificial Sequence: Synthetic coding sequence
atgagaactttggaggattcctccggcaccgtgttacaccggctgatccaggagcaactccggtacggcaatttaacagagacgcgaaccctgttggctattcaacagcaggcgttgaggggtggtgcaggaactggcggtaccggttccccgcaggctagtctcgagatcctcgcccctgaggactcccaggtgcttcagcaggccaccaggcaggagccccagggtcaggagcaccagggcggggaaaatcacttggcagaaaatacactttacagactgtgccctcagccatctaagggagaagagctcccgacatacgaggaggctaaggctcatagccaatactacgccgcacaacaggcgggatag

SEQ ID NO: 24357 - DNA, 480 bp, Artificial Sequence
  Description of Artificial Sequence: Synthetic coding sequence
atggagctgccagccgtgaatctgaaggtcatccttctgggtcattggctcctgaccacttggggatgcatagtgttcagcgggagctacgcctgggccaattttacaatcctcgccctgggagtctgggccgtagcccagcgagatagtattgatgcgattagtatgttcctgggcggcctcctcgctaccatctttctggatatcgtccacatctcaatcttttatccaagggtttctcttacggatacaggtcgcttcggggtaggtatggctatccttagcctcctactcaagccgctgagttgttgtttcgtgtatcacatgtaccgggagcgcgggggcgaactactggtacataccggcttcctcggctcatcgcaagaccgctctgcatatcaaaccatcgatagtgcagaggcccctgccgatccttttgccgtgcctgagggcagatcacaggacgcacggggttactag

SEQ ID NO: 24358 - DNA, 459 bp, Artificial Sequence
  Description of Artificial Sequence: Synthetic coding sequence
atggagctgccagccgtcaacctgaaggtgatccttctcggtcactggctgctaacaacatggggctgtattgtgttttcggggtcttatgcctgggccaacttcaccatcctcgcgttgggcgtgtgggctgtagctcagagagatagtatcgatgcaatctccatgtttctgggaggccttctagcaaccatttttctggacatagtccacatcagtatattctaccctagggtgagccttacagacaccggacgcttcggtgttggaatggccatactcagtttgttgctaaagcctttgagttgctgcttcgtatatcacatgtatagggagcgcggaggcttccttggaagcagtcaggatagaagcgcctatcagaccattgacagtgcagaggcacccgctgaccccttcgccgtccccgagggacgctcccaggacgctcggggatattag

SEQ ID NO: 24359 - DNA, 336 bp, Artificial Sequence
  Description of Artificial Sequence: Synthetic coding sequence
atggagttacctgccgtcaatctgaagggtctgcattgtatcctgcggctgctgtgtctgggccaactccatcaccccggactgggcagggtcggctgtggctctgctgggctgcacaggcggcacaaacatgtgtctggctggctggctggccatcatctccctgggcatcgagcgcatcagcatctgctgcctgcaggccaacctcacggacacgggccattgtggaggggtcacgggcatcctcagctcgctgctcaggcggccttgctgctccttcggcttcctcacgtgccaggagcaagaggctttccatgggtttttagcgggccttag

SEQ ID NO: 24360 - DNA, 444 bp, Artificial Sequence
  Description of Artificial Sequence: Synthetic coding sequence
atggagctgcctgcagtcaatctgaaggttatcctgcttggccactggctgcttacgacctgtttctggaggcacttcagtgcaaagccccgcctggagaccatcgagttgacttgtgctctgtgcaaactgaggtctgcagcgcacagagccacggcagggttacactgcatccttcggttactttgccttggacaattgcatcatccaggacttgggagggttgggtgcggttccgccggtctgcatagacgtcataaacacgtgtctggatggctggcaggccaccacctgccaggacacagagcccaccaacatctcttacctgcaggacaacctcacgggcatgggcccctgtggcgtggtcatgggcacccccagttagccgctcaagccgcccttctgctactgcggttgccccatgtgccaggcgctcgcggttag

SEQ ID NO: 24361 - DNA, 468 bp, Artificial Sequence
  Description of Artificial Sequence: Synthetic coding sequence
atggagctcccggctgtgaacctgaaggttattttactggggcattggctactgacgacctgtttttggaggcactttagcgccaaaccgaggctcgagaccattgaactgacctgtgccctctgcaagctgaggagcgctgctcatcgggccaccgccggattgcattgtatactccgcctgctgtgtctgggtcagctgcaccatccaggattagggcgagtgggctgtggctccgcaggactacaccgcagacacaagcacgtttcaggctggctggccggacatcatctgcctggccatagggctcatcagcacctccttccagctgggcagcctcacggacacggtcctctctggcggggccatggacatcctcagctcgctgcccaggctgcgttacttctcctccggctgccccatgttcctggggcgagagggtttccatgggtgttttcaggcccatag

SEQ ID NO: 24362 - DNA, 2406 bp, Artificial Sequence
  Description of Artificial Sequence: Synthetic coding sequence
atgaagtacgcggagaatataatgttgaagttgacgttctccaccactcaaatccagcagtacgagaacgtgtttatttttgagaccggatactggctcacaaatgcgattaagtataaccaggattacctggacatttgcacttatcaacgcctgcaacagagattgtatctgcagaaaaaaattatccagaagcactttgagaaaaagaaggatatccgccggggtatcggatacttaaagttgatctgcttcctaatcccttttctcctttctttaaaaaaaaagatgaaggtgccctatctgagctcactgctgcagcccttctctgacgataaagtgaaaacagagagagagttgccgccattcatctatggaagggattttaaatgtcagaacttccactacaaagagaaccaatattttcacgttcacggtggaatcgagttcgacatcagcacgcctagcattgagaatgccttggaagactttcagaagaatttggaaaagatccgcgactgcgccgccaacacgtttatcgaagactctgggtataaggagtactattccatacctgtgatggagttccacgggaagtcttactacgtgatctacttcgagttggaaactttctaccaacagctgtataaaacacagtggtggggtgccatcaatgaaatcgtcaataacctgcgactaaagaggctgccactaactgacgcacagctgcacgagcagttcaaaaagaagctagggtttaagcgcgccatgaagtgcaagtccatcccatttggtatgaagtctgctgtggagagggggttgtccgctgtttttcacaccttctcccgcaaaacaagttcaagcacaattaacgtctccgacgaggccgggtacacaattttccaccacgccgctctacacaatcgggtctcgattatttgtcaactttgtaatgccaacttcaaggtaaatcagcgcaggttcgtcacattttcacagggccctacaccactccatctcgctgcccaggcatgctcattggaaactacagtgtgcctcctttgtagtaaagctgactacacactgtctgagaaacgcggatggatgcccatccacttcgctgccttctacgacaatgtgtgtatcattattgccttgtgtagaaaagatccctccctgctggaagcagaggccaccgccgagaaccagtgtacaccgctgctgttggctgcgaccagcggtgcccttgatacaatccagtacctgttctccattggggccaattggagaaagacagacatcaagggcaataatattatccacctgtcggtcctgacatttcacacagaagtactcaagtacatcatcaagctgaacatcccagagttgcctgtgtggaagaccttggtggagatgttacagtgcgaatcttacaagaggcgtatgatggcagtcatgagcctagaagttatctgcttagccaatgatcagtactggcggtgcattttggacgctggaactatccctgccctgatcaatctgctgaaatcaagcaagattaaactccagtgtaaaacggttgggctccttagtaacatctctactcataagtctgcagttcatgctctagtggaggctggagggattccctcactaattaacctccttgtgtgtgacgagcccgaggtgcacagcaggtgcgcggtgattctgtacgatattgcgcagtgtgagaataaggacgttatagcaaaatacaacgggattccatctctaataaacctgctcaacctgaatatcgaaaatgtgctggtcaacgtcatgaattgtatacgggtgttatgcattggcaacgaaaacaaccaacgcgccgtgcgcgaacacaaggggttgccataccttatccggttcttatctagcgattccggcctttttaacctgtttttaaattcatttgaagatgttctgaaagcggtgtcctctgccgcaatagcggaagtagggcgtgacaataaagagatccaggatgcaatcgcaatggagggggccatcccccctctggtggccctgtttaagggtaaacagatctccgtccagatgaagggtgctatggcagttgagagtctggctagccacaacgcactcatccagaaggcttttctcgagaagtctctgacaaagtatctccttaagctgcttaaagcatttcagatcgacgtgaaggagcagggcgctgtggcactgtgggccctcgccggacagacactgaagcagcagaaatacatggcagaacagatcgggtacagcttcatcatcaacatgctgcttagccccagtgcgaagatgcagtatgtgggttacctcctgaaatcacgcctttgtattaacacattctgtttgcaatag

SEQ ID NO: 24363 - DNA, 4305 bp, Artificial Sequence
  Description of Artificial Sequence: Synthetic coding sequence
atgctgaggctcccaaagaaagggttgcctcgcttcgaacaggtgcaggatgaggatacatacctggagaatctagccattcagaggaacgcctctgctttctttgagaagtatgaccgaagtgaaatccaggaactcctcaccactgccctagtgtcttggctctccgccaaagaggatgttcggagccaggttgatctcccctgtgggataatgtctcagatgaataatgtcgggttctctactgccatcctactgaccccagttgacccaacagccctcttggactaccgtgaggtgcaccagatgatccgcgaattggctattgggatttactgcttgaatcagataccttcgatttctcttgaggccaattatgaccaatcgtcctcatgccagttaccccctgcttattacgacaccagaatcggccagattctaatcaacatcgactatatgttaaaagctttatggcatggtatctatatgcctaaagagaagagggctagattcagtgagttgtggcgcgctattatggatatcgaccccgatggaaagccacaaacaaacaaggacatcttttcagagttttcctctgcagggttaaccgacatcactaaggacccagactttaatgagatctatgatgaggatgtcaatgaggaccctacttacgacccaaattccccagaggaaaccgccgttttcatgaagtacgcagaaaacataatgctcaagctgaccttctctactactcagatccagcagtacgagaatgtatttattttcgagacaggctactggctaacgaatgccattaagtataatcaggattaccttgacatctgcacgtaccagcgattgcagcagaggttgtacttgcaaaagaagattatacagaaacacttcgagaagaagaaggacatcagacgaggcattggctacctgaaactgatatgctttttgatcccatttctactgtctttgaaaaagaagatgaaagtaccttatctgagcagcttactccagccgttctcagacgacaaagtgaagactgagcgggagctgccgcccttcatctacggtagggactttaaatgccaaaactttcattacaaagagaatcagtatttccacgtccatggagggatcgagtttgatatcagcaccccctcgatcgagaacgccctggaagatttccagaagaatctggaaaagatcagggactgcgccgccaacaccttcattgaggatagtggctataaggagtactacagcatccccgtgatggagtttcatggcaagtcgtattatgtgatttacttcgagttggagactttctaccagcagctctacaaaactcagtggtggggcgcgataaacgaaatcgtgaacaacctacgcctcaagagactccccctcactgacgctcagctgcacgagcagtttaagaagaaacttgggttcaagcgggctatgaaatgtaaatcaatcccgttcggcatgaaaagcgcagttgaacgtggattaagtgctgtatttcacactttctcaagaaaaaccagcagcagcacaatcaacgtcagcgacgaagctggctacaccatattccatcacgccgccttgcacaacagagtgtccataatatgccagctgtgcaatgctaacttcaaagttaatcaaaggcggttcgttacgttctctcaggggcccactccactccacttagcagcacaagcttgtagcttagagacaaccgtgtgcctgttatgttctaaagccgattataccctctctgaaaaacgcggatggatgccgattcactttgctgcattttatgacaacgtttgcattatcatcgccctgtgtaggaaagatccaagtttgctggaggccgaagcaacagccgagaaccagtgcacacccctcctactcgccgctacgtccggcgctttagacacgattcagtacttgttttccataggggccaactggaggaagacggatatcaagggcaataacattattcatctgagtgtgctcacattccacaccgaagtgctgaagtatataattaaactgaatattcctgagctgccggtctggaagacgttagtcgagatgctgcaatgcgaatcctacaaaaggagaatgatggcggtgatgagtcttgaggtaatatgcctggctaatgaccagtattggcggtgtatcctcgatgccgggaccattcccgccctgatcaatctgctgaagagtagtaaaatcaagctgcagtgcaaaaccgtgggccttctttctaacattagtactcacaagtccgccgtgcatgcactggtcgaggcgggggggatcccaagtttgatcaacctgcttgtgtgcgacgaacccgaagttcacagcaggtgcgcggtgatcttgtacgatattgcacaatgtgagaacaaagatgtgatcgctaagtataatggaatcccatcattaattaacctgttaaacctgaatatcgagaatgttctggtcaatgtcatgaattgtatccgggtgctgtgcataggaaatgaaaacaaccagagggctgtgcgtgaacataaaggcctgccctatctcatacggttcctttcaagcgattccgatgttctgaaagctgtgagttccgctgccatcgcggaagttggccgggacaacaaagagattcaggatgccattgccatggaaggtgcaatacctccactggtggccctgtttaaagggaagcagatatctgtgcagatgaagggggctatggccgtcgaatccctggcatctcataatgcgcttatccagaaggccttcttggaaaagtcactgaccaagtatcttcttaagctactaaaagcctttcaaatagacgtgaaggaacaaggtgccgtggctctctgggccttagcaggccagactctaaaacagcaaaagtacatggcagaacaaatcggttattcttttattatcaatatgctgttgtctccatccgcaaaaatgcaatatgttggaggagaagctgttattgccttaagtaaggactccagaatgcaccaaaatcagatatgcgaagggaatggaattgcccctctcgtcagattgctccgcatctccactatagccgagggcactttgctgagtgtgatccgcgctgttggaagcatctgcataggggttgcccataccagcaaccctgtttcgcaacagctggtagtggacgagaacgcttttccggtgttaatccaactcctgagaaatcaccctagtcctaatataaaggtagaggtagcatttagcctcgcctgcatcgtcctggggaacgatgtgctgcagaaggacctacatgagaacgagggcttcgaatacgcggacgttttgtacttactgcactccaccgagaaggatatttgcctgagggccggctatgcgttaactctattcgcttttaataacagattccagcagtatctcatcttggaatcgggcattatgaccataagcatcttcgaaagatttttggaaagcacggtggagactgaaaaagcaatggctgccttccaaatcgtggtgctcgccaaggttatccgtgatatggaccacatcaccctgagcgctcgcggggtgaccatcctggtcgattcactgtactcagtgcagacgtctacaatcgtgctcacaggaaatctaatcgcgagcctggctcactccagggcaggcatcccagaagcctttacaacccttggaaccatccaacgcctgtgttaccatctgtattcaggcatcgaggaggtgcgagccgcctgctctagcgctctgggatatctcacttacaatgctaacgcattccggatcctgctgaaagagtgtcgaaataagcctaaccagtttatcaggattaaaaataacattagtcgcgacgcctctatcaatcccgcttttctcaaagagttccaaatgcaacaaacgctggtaggcctccctagtttaagcttggagaagaacggaggaccatccattataccaatctttaaaagaggcaaagaacaccgcagaaagctgaagcccaagattcagcccaaagatagtcttacgctgctgcctcctgttaccaacttcatggggctctttaaagccactaaaaagactaaagacagccataacattttttctttctcgagcacaataacctcggatattactaatgtttctcggcctaggattgtgtgtctgaaccagctcggaaagcacgtacagaaggcaaatcccgaaccggctgaaggatag

SEQ ID NO: 24364 - DNA, 1080 bp, Artificial Sequence
  Description of Artificial Sequence: Synthetic coding sequence
atgaaaggggcgatggcggtggagtccctcgctagccataatgctttaatccaaaaggcatttcttgaaaagtctttgacaaagtatttgttgaagctgctcaaggctttccagatcgatgtcaaggaacagggtgccgtggccctgtgggccttggctggccagaccctcaaacaacaaaagtatatggctgagcagattggctattccttcattattaacatgttgcttagtccaagtgccaagatgcagtacgtgggtggggaagccgtcatcgccctgtctaaagacagcaggatgcatcagaatcagatatgtgagggcaatggcatcgccccactggtgcgcctgttaagaataagcactatagctgaaggaacattactatctgtgatccgtgcggtcggatccatttgtataggcgtcgcccatacatccaaccctgtaagccaacagttggtagtcgacgagaacgcttttcccgttctcattcaactccttaggaatcatccctctccgaatataaaggtggaggttgccttttccctggcctgcatcgtcctagggaacgacgtactccagaaagacttgcacgagaatgaggggtttgaatacgctgacgttctgtacctcctgcactctacggaaaaagacatctgcctgagagccgggtacgcacttacactctttgctttcaacaacagattccaacagtatttgattctcgaatcaggtattatgactattagcatatttgaaaggtttctggaatctactgtggagactgagaaagccatggctgcatttcagatcgtagtacttgctaaggtgatcagggatatggaccacataactcttagcgctcgcggtgttactattctggtggatagcctgtacagcgtgcagactagcaccattgtgctgaccggaaatttgattgcgagtctggcccacagccgagccgggattcccgaagccttcaccactctgggaacaatccagcgtctctgctatcatctttacagtggcatcgaggagagtggcgaggaatggcgcaccatacacaattcgtacctttag

SEQ ID NO: 24365 - DNA, 4092 bp, Artificial Sequence
  Description of Artificial Sequence: Synthetic coding sequence
atgtctcagatgaataacgtgggtttcagcactgcaatactgctgacccccgttgacccgacagcactcctcgattaccgcgaagtgcatcagatgatacgggaactggcaattggcatatactgtctgaaccagatccctagtatatccctagaagccaattacgatcagagttcctcatgccaattacctcccgcttactacgacactcgaatcggacaaatattgatcaatatagactacatgttaaaggccctgtggcacgggatatacatgcctaaggaaaaacgggcccggttcagcgagctgtggcgggccattatggacatcgaccctgacgggaagcctcagactaataaggatattttttccgaattctcctctgcaggcctaacggacattacaaaagatcctgatttcaacgaaatctacgacgaggacgtcaacgaggaccccacgtatgatcctaatagcccagaggagactgccgtcttcatgaagtatgcggaaaacattatgctgaagctgacattcagcaccacgcaaattcagcagtacgagaacgtgtttattttcgagactggttactggcttacaaatgccataaaatataaccaggactatctggacatctgtacgtatcaaaggctccagcagagactgtatctgcagaagaaaatcattcaaaagcactttgaaaagaaaaaggatatccgaagaggcatcggataccttaagttgatttgcttcctcatcccctttctgctctcgctgaaaaagaaaatgaaggttccctacctgagctctcttctgcagccattctcggatgacaaagtcaagacggagcgggaactgcctccctttatttacggcagggacttcaaatgtcagaatttccactataaagagaatcagtacttccacgtgcacggcggcatagaatttgatatcagcaccccctctattgaaaacgccctggaagacttccagaaaaacttagagaaaatccgggactgtgcagccaatacatttatcgaggactctgggtacaaggaatactactccattcctgtcatggagtttcacggcaagtcctattatgttatttattttgaattggagacgttttaccagcagctctacaaaacccagtggtggggcgctattaatgagatcgtgaacaatcttcgcttaaagaggttacccctcacggatgcccagcttcatgaacagttcaagaaaaagttgggattcaagcgtgccatgaagtgcaaaagcattcctttcggcatgaaatctgccgttgaaaggggcctgagcgccgtattccatacattttccaggaagacatcctcctccaccatcaacgtcagcgatgaggcaggatacaccatcttccaccacgctgccctccacaatagggttagcatcatttgtcagctctgtaatgccaacttcaaggtcaatcaaagaagattcgttacctttagtcaggggccaacaccgcttcatctggcggcccaagcctgctctctggaaaccaccgtatgcctgctgtgttctaaggccgactatactctgtctgaaaagcgagggtggatgccaattcattttgcagccttctatgacaacgtgtgtattattattgcactctgtcgaaaggatccctctctgctggaggcggaggctacagccgagaatcagtgcactcctctcctcttggccgccaccagcggggcattggacacgattcagtatctcttttccataggcgccaactggcggaagactgacatcaaaggtaataatattatccacttatccgtcctgacgttccacaccgaagtgctgaagtacattatcaagctgaatatccctgaactgcctgtatggaagaccctcgtggaaatgttacagtgcgagagttacaagcggcgcatgatggcagttatgagcctggaggtgatttgcctcgccaacgaccaatattggagatgcattcttgatgcaggcacgattccagctcttatcaacctcctcaagtcctccaagatcaagcttcagtgcaagacagttggtctcctgtcaaacatcagcacacacaaaagtgccgtgcacgccctcgtagaggctggagggataccaagtctgataaatttgctcgtgtgtgatgaacctgaggtgcactccaggtgcgctgtcattctttacgacatcgcccagtgtgagaacaaagatgtgatagccaaatataatggcataccttccctaatcaacctgcttaatttgaatattgagaacgtgctggttaacgttatgaattgtattcgggtgctctgcatcgggaacgaaaacaatcaaagggcagttcgcgaacacaaaggtctgccttatctcatccgctttctcagtagtgattcggacgtgctcaaagccgtgagtagcgctgccattgccgaagtaggccgcgacaacaaggagatacaggacgctatcgctatggaaggcgcaatcccacccttggttgcccttttcaaaggcaagcaaatctccgtgcagatgaaaggtgcgatggccgtagagagcctcgcctctcataacgccttaattcagaaggcatttctggaaaaatctcttacgaaatatttgctgaaactgttaaaagcctttcagattgacgtgaaggagcagggggctgtggcgttatgggccttggccggccagactttgaaacaacagaagtacatggccgaacagatcggttacagtttcataatcaacatgctcctaagtccgtctgctaagatgcagtatgtgggcggcgaagccgtcatcgccctgagcaaggacagcagaatgcaccagaaccaaatctgcgaaggaaatgggatcgcccctcttgttcgactcctgcggatcagcactattgcagagggcacactcctctcagtcattagagcggttggctcaatatgcatcggagtcgcgcacacaagtaacccagtttctcagcaattggtggttgatgagaacgcatttccggtcctgatccagctgctgaggaatcacccatctcccaacatcaaagtggaggtggctttttcactggcttgcattgttctgggaaacgacgtactgcagaaggatttacacgagaatgaagggttcgaatatgccgatgtcctttatctcctgcactccaccgagaaggatatctgcctccgagccggatatgcccttactttgttcgcctttaacaacagatttcagcagtatttaatcctcgagtccggaatcatgactatctcaatattcgagcgttttctggagtcgaccgttgagacggagaaggccatggccgcgtttcagatcgtggtgctagccaaagtaatcagagatatggaccacattaccttatctgccaggggtgtgactattctcgtggactcactgtactccgttcaaacaagtaccattgtcctgacaggcaatcttatcgcatcgttagcccactctagagcagggatccctgaggcgtttaccaccctgggtaccatccaaagactgtgctaccatctttacagtgggatagaggaggtgcgtgcagcttgtagcagtgccctcggctacctgacttataacgctaacgctttccgcattctgcttaaagaatgcaggaacaaacctaaccagttcatcagaataaagaacaacatctccagagatgcctcaattaaccccgcctttctcaaggaattccaaatgcagcagacgctggtcggcctgcccagcctaagcctcgaaaagaacggtggcccctccattattcctatctttaagcgaggcaaggagcatcggcgcaagctgaaaccgaagatccagccgaaggactccctcacactgctgccccctgtcaccaactttatgggattattcaaagctaccaaaaagaccaaggacagtcataatatcttcagcttttcttcaacaatcacaagtgacatcacaaacgtttccagacccaggatcgtgtgccttaatcaactgggtaagcacgttcagaaggctaatccagaacccgcagagggatag

SEQ ID NO: 24366 - DNA, 3243 bp, Artificial Sequence
  Description of Artificial Sequence: Synthetic coding sequence
atgttaaggctcccaaagaagggactgccacgattcgaacaggtgcaggatgaggacacctatctggaaaacctggcaatacagcgaaacgcatccgcctttttcgagaagtacgatagatcagaaatacaggagttgttaacgactgctctcgtctcatggctgtccgccaaagaagacgtacggtctcaagttgacctgccttgtggaattatgtcacaaatgaacaacgtcggattctccactgctatcctactgacccccgtggatcctacagctcttctggattaccgcgaagttcatcagatgatccgagagttagccatagggatctactgccttaatcagatcccctccatttccctagaagcaaactacgatcagtcttctagctgtcagctcccccccgcatattacgacacaagaattgggcagattttgatcaacatcgattacatgctgaaagctctatggcatggaatctacatgccaaaggagaagcgggctcgcttttctgagctctggcgcgcaataatggacattgaccctgatggcaaaccccagactaataaggacatcttttccgagttctcgtcagcagggctcactgatatcactaaagatcccgacttcaacgagatatacgatgaagacgttaatgaagaccctacctacgaccctaactctcccgaagagacagcggtttttatgaagtacgccgaaaatatcatgctaaaactcacattctccacaacccagatccaacagtacgaaaacgtgttcattttcgagacgggttactggctcaccaacgctatcaagtacaatcaggactatctcgacatttgtacctaccagaggctacagcaaagactgtacctccagaaaaaaatcatccaaaagcactttgagaaaaaaaaagatatacggaggggaatagggtacctgaaactgatctgtttcctgatacctttcctactgagcctgaagaaaaagatgaaagtgccatacctgagttccttgctgcaacctttctctgacgataaggtaaaaacagaaagagaacttccaccatttatatacggaagggacttcaaatgtcagaactttcactataaagaaaaccagtactttcacgtacatggaggtattgaattcgacatctccacaccctccatcgagaacgctttagaagattttcagaagaacctggaaaaaatccgggactgcgccgccaacacatttatcgaggattcagggtacaaggaatactactccatccccgtgatggaatttcatgggaagtcctactatgtgatatacttcgagctagagacattttaccagcagctgtacaaaacacagtggtggggtgctatcaacgagatcgtgaacaatctacggctgaagcgcctgccactaactgacgcccagctgcacgaacagttcaagaagaagctgggcttcaagcgggcgatgaagtgtaagtcaatcccattcgggatgaagagtgccgtcgagagagggctgagtgctgtattccacacattttcacgcaaaacttcttcgtccaccatcaatgtgagtgatgaggctggttatacaatattccaccatgccgcgctccataatagagtctcaattatttgccagctgtgcaatgccaacttcaaggtgaaccagcgaagattcgtcacttttagtcagggtcccacccctctccacctggctgctcaggcctgcagcctcgaaacaactgtctgtctcctgtgcagtaaggctgattatactctgtctgaaaaaaggggttggatgcctattcacttcgcagccttttatgataacgtgtgcataattattgcgctgtgtaggaaggacccaagccttctcgaggccgaagcaacagcagagaaccagtgcacgccattattgctggccgcaacttctggagcgttggatacaatacagtacttgttttcaatcggcgcgaactggcggaaaacagacatcaaaggaaataatatcattcacctatcagtgctgacctttcacactgaagtgttaaagtacataataaagctcaacatacccgaattgccagtgtggaaaacactagttgagatgctgcagtgcgaatcatataagcggcgaatgatggctgtcatgagtctggaagtgatctgtcttgctaatgaccagtattggcgatgtatcctggatgcagggacaatccccgccctcataaacctcctcaaaagctcgaaaattaaactgcaatgtaaaacggtgggactgctctctaatatctcaactcacaagtctgccgttcacgctctggtagaggcaggaggcatcccatccttaatcaaccttcttgtgtgcgatgaaccagaagttcatagtaggtgtgccgtgattctctatgatattgcccagtgtgaaaacaaagacgtgatcgcaaagtataacggtatccctagcctgatcaatctcttgaatctgaacattgaaaacgtgttggtgaacgtgatgaattgtattcgtgtcctttgtattggaaatgaaaataaccaaagagcagttcgcgaacacaaaggtctgccatacttgatccgctttctgtcttcggatagcgacgtgttgaaagctgtcagctctgctgccatcgcagaggtggggcgagataataaagagattcaggacgcaattgcgatggagggagcaataccccctctcgtggccttgttcaaggggaagcagatcagcgtccaaatgaaaggcgccatggcggtggagagcctggctagccacaatgccctgatccaaaaagcattcctcgagaagtccttaacaaagtacttgctgaagctactgaaagccttccagatcgatgtcaaagaacaaggcgccgtggcactgtgggcactggctggacagactttaaaacagcagaaatacatggctgagcagattggctatagctttatcattaacatgttgttgtccccaagcgccaagatgcagtacgtgggtggcgaagccgtaatcgcgttgtcgaaagactctaggatgcaccagaatcagatctgcgagggaaatggcattgctcccctcgtaaggctgcttcggatatctaccatcgctgagggtacacttctgagcgtaatccgcgctgtcggttctatatgcatcgggtacctcctcaagtctcgcctgtgtataaacacgttctgtctgcagtag

SEQ ID NO: 24367 - DNA, 4305 bp, Artificial Sequence
  Description of Artificial Sequence: Synthetic coding sequence
atgctgcggctccctaagaagggactaccacgatttgaacaggtgcaggacgaggacacgtacctagaaaacctagctatccaaaggaacgcttcagctttttttgaaaagtatgatcggagcgaaatccaggagctgttaacaacggcactggtctcttggctgagtgctaaggaggatgtgcggagccaggtggatctgccttgcgggataatgagccagatgaataatgttgggttttcaacagctatattattaacgccagtagatcctactgcgctgctggattaccgagaagtgcatcaaatgatcagagagttagcaattggcatctattgcctgaaccagatcccaagcatatccctggaggccaactatgatcaatccagctcatgtcaactgccgccagcttattacgacacacgaattggtcagattcttatcaacattgactacatgctaaaagccttgtggcacggcatctatatgcctaaagagaaaagggcccggttctccgagttatggcgcgctattatggacatcgaccccgacgggaagcctcaaactaacaaggacatcttcagcgaattcagcagcgccggactcaccgacatcaccaaggatcccgatttcaatgaaatctacgacgaggacgttaacgaggacccgacatatgacccaaacagccctgaggagacagcagtctttatgaagtacgctgaaaacatcatgctaaaactgacattttctacaacccagatccagcagtacgagaacgtgttcatcttcgagacaggctactggcttacgaacgccattaagtacaaccaggattacctcgatatctgcacataccagaggttgcagcagaggctctatctgcagaaaaagatcatccaaaagcatttcgagaaaaagaaagatatcaggaggggaatcggttatcttaagctcatctgtttccttattccattcctcctctccctgaagaagaaaatgaaggtgccatacctatccagcctgctccagcccttttcggacgataaggtcaaaacagagcgtgagcttcccccgttcatctatggacgagattttaaatgtcagaatttccactacaaggaaaaccagtattttcacgtgcatgggggcatcgaattcgatatatctaccccgagcatcgaaaacgccctggaggacttccagaagaacttagagaaaatccgggactgtgctgctaacacgtttatagaagatagcggctacaaggaatactactcgatcccagtgatggaatttcacggtaagtcatactacgtgatctatttcgagctcgaaactttttatcaacaactttacaagacccaatggtggggggccatcaacgagatcgttaacaaccttcgattgaagcgcctgcccctgactgacgcacagctccatgagcaattcaaaaagaaactgggtttcaaacgggctatgaagtgcaaaagcattccattcggcatgaaatccgctgtagaaaggggattgtcagccgtttttcacaccttctcacgaaaaaccagttccagtaccataaatgtgagtgatgaggctggctacacgatctttcaccatgctgccttacacaatcgcgtgtcaatcatttgccaactgtgcaatgccaatttcaaggtcaatcaacgccggtttgtgaccttctctcagggaccgacaccgttacatctggccgcacaggcttgtagtctggaaacgacagtgtgccttctgtgcagcaaagccgattacactctttcggagaaacgtggatggatgccaatccacttcgcggcattttatgataatgtctgtatcatcatagccttatgtcggaaggacccttcacttctggaagctgaggctaccgcggagaatcagtgcacgcctctgttgctggccgccacttctggtgctctggatacgatccagtatttattttccatcggagccaactggcggaagacggatattaaagggaataatataattcacctgagcgttctcacattccatactgaagtgttaaagtatataattaaactgaacattccagagctgcccgtctggaagactcttgtcgaaatgttgcaatgcgaatcttataaaagacgaatgatggcggttatgtctttggaggtgatctgcctggccaatgatcagtattggcgctgcattctggacgctggcacaatccccgccctaatcaatctattgaagtcaagcaagattaaacttcagtgtaagaccgtcggcctgcttagtaacatatccacccacaagagcgctgtgcacgctctggtggaggcggggggtatcccatcactgattaaccttctggtgtgtgacgagccagaggtccactctcggtgcgccgtgattctgtatgacatcgcccagtgcgagaataaggacgtcatagccaagtacaatggtatcccctcactgatcaatttgttgaacctcaacattgagaatgttctcgtgaacgtcatgaattgtatccgagtgctgtgcatcggaaacgaaaacaaccagcgggcagtcagggaacacaaaggcctgccttatctgatccgtttcctatcttccgattcagacgtgcttaaagctgtttcaagtgcagccatagctgaagtaggtcgtgataacaaggagatccaggacgctatcgcgatggaaggggcgatcccccccttggtggccctgtttaaaggtaaacaaatttccgtgcagatgaagggcgccatggccgttgagagtctggcgagccacaacgccctgattcagaaagcatttctggagaagtccctgacaaagtatttgcttaaactcctcaaggcttttcagattgacgtaaaggagcagggggccgtagctttgtgggccttagccggccaaacactgaagcagcagaaatatatggctgagcagatcgggtactctttcatcatcaatatgttgctctcaccctctgcaaaaatgcagtacgtgggcggtgaggcagtcattgccttgtcaaaggactcacgtatgcatcagaaccagatctgcgagggcaatggaattgcccccctggtgaggttacttcgcatttccacaatcgctgagggcaccctgctatccgtgattcgtgccgtaggcagcatatgcattggggttgcccacacttccaatccagtatctcagcagttggtggtggacgagaacgcttttcctgtgctgatacagctactgaggaatcacccgtcacctaacatcaaggtagaggtggctttcagtctggcctgcattgtcctcggcaacgacgtgcttcagaaggatcttcatgagaatgagggatttgagtacgcggatgtactctacctgctacactccaccgagaaagacatttgtctgagagctggatatgctttgacacttttcgccttcaacaaccggttccaacagtacctcatcttggaatcgggcattatgactatctcaatctttgaaaggtttctggagtccacagtcgaaacagagaaggccatggctgcttttcaaatcgtggtgctggccaaggtgattcgcgacatggaccacattactctgtccgccaggggagtaacaatactggtagactctctgtacagcgtgcagactagcaccatcgtactcacaggcaatctgattgcctccctcgcccactccagggcaggcataccagaagccttcactaccctcggtaccattcagaggctgtgttatcatctctacagcggcatagaagaggtgcgcgccgcttgcagctccgcgttgggttacctgacatataatgccaacgcgttcaggatactcttgaaggagtgtcgcaacaagccgaaccaatttatccgcatcaagaataacattagtcgggatgcgagtattaacccagcgttcctgaaagagtttcagatgcaacaaactttggtgggactaccgagtctcagtctggagaaaaacgggggcccatcaattattccaatcttcaaacgcggcaaggagcatagaagaaagctgaaacctaagattcagcctaaagactcccttaccttactgccgccagtgacaaacttcatgggactgttcaaagcaacaaagaaaaccaaagattcccacaatattttctctttttcctcaactatcacatctgacatcaccaatgtgtcccgaccccggattgtctgtctgaatcaactgggaaagcatgtacagaaggctaatccagaaccggctgagggctag

SEQ ID NO: 24368 - DNA, 3513 bp, Artificial Sequence
  Description of Artificial Sequence: Synthetic coding sequence
atggctgaggaggaagtcgccaagttagaaaagcacctgatgttattgagacaggagtatgtgaaactccagaaaaaactagcagaaactgagaagaggtgtgccctgctagcggcacaggccaataaagagagcagtagcgagagctttatcagccggctgctcgccatcgtcgctgatctgtatgagcaagagcagtatagtgaccttaaaattaaagtcggcgaccgccacatctccgctcacaaatttgttctggccgctcgctctgattcttggagtctcgctaatctctcctccactaaggaactggacctgtccgacgctaacccagaagtaacaatgaccatgctgcgctggatttatacagatgaattggagttccgtgaggacgatgttttcctgaccgaattaatgaagttggcaaataggttccagcttcaattgctgcgggagcgctgcgagaagggagtgatgagcctcgtaaatgtgcggaactgcatccgcttctaccaaaccgcagaagagttaaacgccagcacactgatgaactattgcgcggaaattattgcttcacactgggacgatctgcgtaaagaggacttctctagcatgagcgcccaactactgtacaagatgatcaaatcaaaaaccgagtaccctctgcacaaggcgataaaggttgaacgcgaggacgtggtgtttctataccttatcgaaatggatagtcagctgccgggcaaactaaacgaggccgaccacaacggggatctggccttggatctagccttgagcagaagactggagagtatcgccacaacgttggtgtcccataaggccgacgtggacatggtcgataaatccggctggtctctccttcacaaaggcatccagcgcggagatcttttcgccgccacatttctcattaaaaatggggccttcgttaacgctgccactctgggggcccaagaaaccccccttcatctagtggccctatatagtagtaaaaagcactcagcagatgttatgagcgagatggcacaaatcgcagaggccctgctgcaagccggcgctaatccaaatatgcaggactccaaaggccgcacccctttacacgtcagcattatggccggaaacgaatacgttttctcacaactcctccagtgcaaacagttagatcttgagcttaaggatcacgagggcagtaccgccctgtggttggcagtacaacacattacagtgtcttccgatcagtccgtgaatccatttgaggacgtccccgtggtaaatggcacctcttttgacgaaaatagcttcgctgcccggctgatccagagaggatctcacacggacgccccagatactgccacaggaaactgcttactgcagagagctgcaggcgcggggaatgaagccgcagctcttttcctcgccactaacggggcccacgtaaatcaccgaaataagtggggggaaacccctttacacaccgcctgtagacatgggctggctaatctgacagccgaactgctacagcagggagctaaccccaacctgcagaccgaggaggccctacctctccctaaagaggccgcaagccttacctccctcgctgatagtgtacacctgcaaacacctcttcacatggccatcgcctacaaccatcccgacgtggtatctgtgatcctggagcagaaggcgaacgctctgcacgccacaaataatctccaaattataccagatttctccctaaaggatagcagggatcagacagttctcggcctggctctctggacaggcatgcataccatcgctgcacagcttcttggcagcggcgccgccatcaatgacactatgtctgatgggcagaccctgctgcatatggccattcagagacaagatagtaagagcgccctttttttactggagcatcaagccgatatcaacgtgtctcggacacaggatggtgaaactgccctgcagcttgctattaggaaccagctgcccttggtggtagatgcgatctgtacaagaggagccgatatgtctgtcccagacgaaaagggtaatcctccactctggctggccttggccaacaacctggaggacatagcttccactctggtgcgtcacggctgcgatgcgacctgttgggggcctggacccgggggctgcctgcagaccttgctgcatcgcgctattgatgagaataacgagcctactgcatgttttctcatcagaagtggttgcgacgtgaatagtcccaggcagcccggtgccaacggcgagggggaagaggaggcccgggacgggcagacacccctccacctggccgccagttggggtctcgaagagacagtccagtgcttactggaatttggtgccaacgtgaacgcccaagacgccgagggccgcacccctatccacgtcgcgatctctagtcagcatggagtgatcatccagttgttggtcagccaccccgacattcacctcaacgtgagagaccgtcagggactcacacccttcgcttgtgctatgaccttcaaaaacaataagagtgcagaggctatcctaaaaagagagtcgggtgctgccgagcaggttgacaacaagggccgcaacttcctgcatgtcgccgttcaaaattctgatatcgagtccgtcctctttctgatctcagtgcatgctaatgtaaatagcagagtgcaggatgctagtaagctgacaccactgcaccttgctgtgcaggctgggtcagagattatcgtgcggaaccttctgctggcaggcgcaaaggtcaacgagctgacgaagcacagacaaactgccctccatctggccgctcagcaggatctccctacaatctgttccgtgttactggaaaacggtgttgattttgctgctgtggatgaaaatggtaataacgcgcttcacctggctgtgatgcacggacgacttaacaacatcagagttctgctgacagagtgtacggtggacgcagaagccttcaacctgcgcggacaaagcccgctgcacatattaggacaatacggcaaagaaaacgcggccgcaatttttgacctgtttttggagtgtatgcccggctacccactggacaagcccgacgctgatggttccacggtcctgttgctggcctacatgaagggtaacgccaacctgtgcagagctatagtacggagcggcgccaggctgggggttaacaataaccaaggtgtcaacatatttaattatcaggtggccaccaaacagctcctattccgcctccttgacatgttgtccaaagaacccccatggtgcgacggcagctactgctacgagtgtactgctcggtttggggtaacaaccagaaaacatcactgtaggcattgcggcagacttttatgccataagtgctctaccaaggagatcccaatcattaagttcgatctaaataaaccagtccgggtgtgcaacatatgcttcgacgtgttgactcttggtggggtctcatag

SEQ ID NO: 24369 - DNA, 1464 bp, Artificial Sequence
  Description of Artificial Sequence: Synthetic coding sequence
atggcagaggaggaagtggccaagctggaaaagcacctgatgctattgaggcaagagtacgtgaaactgcaaaaaaagctggctgagaccgagaagagatgtgcgttgttagcagctcaggctaataaggaatcctcgagcgagagcttcatcagtcgactactggcaatcgtcgctgacctctatgaacaagagcagtacagcgacctcaagatcaaggttggtgataggcacatttccgctcacaaattcgtgctggcagcgagatctgattcatggagcctcgccaacctgtcaagcactaaagaactggatctgtctgacgctaatcctgaagtgaccatgacaatgctgagatggatatatacagacgaactggagttccgggaggatgacgtgtttctgacagaactgatgaagttggctaacaggtttcaactgcagctgctgcgggaacgctgcgaaaagggggtaatgagcctggtcaacgttcgaaactgcatcagattctatcagactgcggaggagctaaacgcatccacactgatgaactactgtgcagaaataattgctagtcattgggatgacctcaggaaggaagacttctcctcgatgtccgcgcagttgttgtacaaaatgatcaaaagtaagacggagtaccccttacataaggctatcaaggtggaaagggaggacgtggtgttcctctatctcatcgagatggacagccagcttccaggcaagctgaatgaggccgaccacaacggggatttggccctggacctcgccctgtcgcggagactcgagtccattgccaccactctggtctctcataaagcagatgttgatatggttgacaaatccggctggtctctactacacaaagggatccaacggggagatctctttgcagcgacttttctgatcaagaacggtgcctttgtgaacgctgccacgctgggagcccaggagaccccccttcacctggtggctctctatagctctaaaaagcactccgccgatgtcatgtcagaaatggctcaaattgctgaagcgctattacaggccggggctaatcccaacatgcaggattccaagggacggacgcccttacatgtgagtatcatggccgggaatgagtacgtgttttctcagctcctccagtgtaaacaactggaccttgagctgaaggaccacgaagggagcaccgccttatggcttgccgtccagcatattacagtaagctccgaccagtctgtgaatccattcgaggatgtaccagtggtgaatggcacttcattcgatgagaacagttttgctgcgaggctgatccagcgaggaagccacaccgatgcccctgataccgcaaccggtaaagcgcgggccagtcgtcgcggggatgcaggcgtctgtaggcggcaggaaatggcatgtaagtgcctgcatcccaagttccggaactag

SEQ ID NO: 24370 - DNA, 3336 bp, Artificial Sequence
  Description of Artificial Sequence: Synthetic coding sequence
atgagttcctgccgaaggagttggcgaagacagcgaagcgctgctctgagttggcttcgccgacagactagacgggcggcagcttcacccagcagcgctgtgtgttggccctcctggcagaccagtacctcgcggtcttctaccgatgcgaacccagaagttaccatgaccatgctgcggtggatctatacagacgagctagagttccgcgaagacgacgtattcttaaccgaacttatgaaacttgccaataggttccaactccaactgttgcgggaaaggtgcgagaagggcgtgatgagcttggtgaatgtgaggaattgcatccgcttctatcagacagcagaagaactgaacgcctcaacactgatgaactattgtgcagaaataatcgcctctcactgggacgatttgcgcaaagaagattttagcagcatgtccgctcaattactttacaagatgataaaatcaaagaccgaatatcctctgcacaaggctattaaagttgaacgggaggatgtggtgtttctgtacttgatcgaaatggacagccagttaccaggaaagttaaatgaagcagatcacaacggggaccttgcactggatttagctctgagcaggcgactggaatcaatcgctactactctcgtatctcataaagcagacgttgatatggtcgataagtctggttggagcctcctacacaaaggcatacagcgcggagacctctttgctgcaacgtttctgatcaagaatggcgcctttgttaacgctgccacattgggtgcacaggaaaccccactgcatctggtggccctgtattctagcaagaagcactcagcagacgtgatgtccgaaatggctcagatcgctgaggccttgctccaggccggcgctaaccctaatatgcaagacagcaaggggagaactcccctgcatgttagcataatggccggaaatgagtacgtgttctctcagctactgcagtgcaaacaactcgacctggaacttaaggaccacgaggggtctactgccctgtggctggcagtccagcacataaccgtcagcagcgaccaaagcgtcaaccccttcgaggacgtccccgtggtcaatggaactagttttgacgagaacagcttcgcagcacgtcttattcagaggggatctcataccgacgcgcccgacaccgctacaggaaactgtctactccagcgggcagccggcgctgggaacgaggcagcagcgttgttcctcgcaaccaacggcgcccatgttaatcaccggaacaagtggggggagacaccccttcatacggcgtgtagacatggactggccaatttgacagcggaactgttgcagcagggcgccaacccgaaccttcagaccgaggaagcgctcccactgccaaaagaagcggcatcccttacttcgctcgcagactccgttcacctgcagactcccctccatatggccattgcctataatcatcctgacgtggtgtctgtaatcctggagcagaaagctaacgctctgcacgccaccaacaatctccagattatccccgacttctctctcaaagatagtagagaccagacggtgctcggcctggcactgtggactggtatgcacaccatagcagcccagctcctagggagcggggcagccatcaacgacaccatgtccgatgggcagacacttttgcacatggcaatccagaggcaggactccaaatctgctctgtttctactcgagcaccaggccgacataaacgtgagccgcactcaggacggtgagaccgccttgcagctggccatacgtaatcagctccccctggtggtagacgctatctgcactcggggtgcggacatgagcgtccccgacgagaaaggtaatcctccgctgtggttggccttagctaacaacctcgaagacatcgccagcactttagtgcggcacggatgcgacgctacgtgctggggtccgggaccaggaggctgtttgcagacacttctgcaccgggctattgacgagaataatgagccaaccgcgtgtttcctcatcagaagcggttgcgacgtgaattcccctcgacagccgggcgctaatggagagggcgaagaagaggccagggatggccagacccccctgcatttggctgcaagctggggacttgaagagaccgtccagtgcctgcttgaattcggtgccaatgtgaacgcccaggatgcagaaggtcgtactcctatccatgtggccattagtagtcagcacggtgtcattatacaattgctggtttcacaccctgatatccacctaaacgtgcgggatcgtcagggcttgacgccttttgcctgcgctatgacattcaaaaataataaatcagcggaagctatcctgaaaagagagtcaggcgctgcagagcaggtggataacaaaggcagaaactttctgcatgtcgcagtgcagaattccgacatagagagcgtgctatttctgatctccgttcatgcgaacgtgaacagccgggttcaggacgcatcaaagctaacacccttgcacttggctgtacaggctggcagcgagataattgtgagaaacctgcttctcgccggcgcaaaagttaatgaactcactaagcaccggcaaactgccttgcatctggccgctcagcaagatctgcccacaatttgctcagtgttgctggagaacggcgtggacttcgcagccgttgatgagaatggtaacaatgcgctccatctggccgtgatgcacggacgtctgaacaatatcagggtgctcctaacagagtgcaccgtggacgctgaagcctttaacctcagaggccaaagccctctccatattctaggccagtatggaaaggagaacgcggcagcaattttcgacttgtttttagaatgtatgcctggttacccgctggacaaacccgacgccgacggctctactgttctgctcctggcgtacatgaaagggaacgcaaacctttgcagggccatcgttcgatccggagctaggctcggcgtcaacaacaatcagggcgtgaatatcttcaattaccaggtggcaactaagcagcttctcttccgtctgcttgatatgctatccaaggaacccccatggtgcgatggcagctactgctacgagtgtactgcccgcttcggagtgactactagaaagcatcactgccgccactgcgggaggttgctgtgccataaatgctccactaaggaaattcccataatcaagtttgatctcaacaaacccgtgcgagtgtgtaacatctgttttgatgttttaaccctcggcggggtgagctag

SEQ ID NO: 24371 - DNA, 3513 bp, Artificial Sequence
  Description of Artificial Sequence: Synthetic coding sequence
atggctgaggaagaggtagcaaaacttgaaaagcatctcatgctcctccgacaggaatacgtgaaactgcaaaagaaattagctgagacagagaagcgttgcgcactgctggcagcacaagctaacaaagaatcaagcagcgaatcattcatctctcggctgctggcgattgtagctgacctgtacgagcaagagcagtactctgacttgaagatcaaagtgggtgacagacatatctctgcccacaagtttgtgctggctgctcggagcgatagttggagcctagctaatctttcttcaacaaaagagctggacctgagcgacgccaacccggaggtaacgatgacaatgctcaggtggatatacactgatgagttggaattccgtgaggacgacgtgttcctaaccgagctgatgaagctggctaaccgcttccagttgcaactgctgagggagcggtgtgaaaaaggcgttatgtctctggtcaacgtgcggaattgcatacgtttttatcagacagctgaagagttgaatgccagcaccttaatgaattactgtgctgagatcatcgctagccactgggacgacttacggaaggaggatttctcttcaatgagcgcacagctactctacaaaatgatcaaaagcaagaccgaatacccactgcataaagccattaaggtagagcgtgaggatgtggtcttcctgtacctgatcgaaatggacagtcagctccctggtaagctgaacgaggccgatcataacggtgatctcgccctcgatttggctttgtcacgccgcctggagagcatcgcaaccaccctcgtctctcataaggcagatgtggatatggtcgataaatcagggtggtctttgctccataagggaatccagaggggagacctgtttgcagctacctttctaatcaagaacggagctttcgtcaacgctgctaccctgggagcgcaagaaactccactgcatttagtggcgctctattcatctaagaagcatagcgccgacgtgatgtcagaaatggcacagatcgctgaggcactgttgcaggcaggcgcgaatcccaacatgcaggatagtaagggccgcactcccctccacgtgtccataatggccggcaatgagtatgtgttcagtcagctgcttcagtgtaaacagctcgacctagaactgaaggaccatgagggttctaccgcattatggctcgccgtccagcatattacagtcagtagcgaccagagcgtgaacccctttgaagatgtgcctgttgttaacgggacatcattcgacgagaacagcttcgccgctcgcttgattcagcgcggaagtcacaccgatgcccccgatacagcaacagggaactgtcttctccagagagcagccggagccgggaatgaggcggctgccctgttcctcgccacgaatggggctcatgtgaatcatagaaataagtggggagaaactccccttcacacggcttgtaggcacggcctcgcaaaccttacagcagaactcctgcagcagggagctaaccccaacttgcaaacagaggaggcgttgcccttaccgaaagaagcggcatctctcacgtccctggcagatagtgtacacctgcaaacgcctttacacatggctattgcttataatcatcccgacgtagtgtcagtcatattggagcagaaagccaatgcactacatgccacaaacaatctgcagatcattccggacttttctctaaaggattcaagggatcagacagtgctcggactggccctgtggactggtatgcacacaatcgccgctcagctcctaggcagcggggccgccatcaatgacactatgtctgatggccagaccttattacacatggcaattcagcgacaggactcaaagtcagcgctgtttttgctggaacaccaggctgatatcaacgtctcaaggacccaggacggagaaaccgctctccaactggcaatcaggaaccagctgccgcttgtggtagatgcaatctgcactagaggagctgacatgagcgtgcctgacgagaaggggaatccaccgctgtggttggctctcgctaacaatttggaagacatcgcctcaactcttgtccgacacggctgtgatgctacctgctggggacctggccctggcggttgcttacagactcttctgcaccgggcaattgacgagaacaatgagcccactgcctgcttcctgatccggtcaggctgtgatgttaacagcccgagacagcccggggccaacggcgagggggaggaggaagcccgcgacggtcaaacaccactccatttggctgcatcatggggcttagaggaaacagtgcaatgtttgcttgaatttggtgctaatgtgaatgctcaggacgcagaaggcagaacacccatccacgtggctatctctagccagcacggcgtgatcattcaactgttggtctctcacccagacattcacttgaacgtgagagacagacaaggcctgacacctttcgcctgtgcgatgacattcaaaaataataaatcggctgaagcgatactcaagagggaatcaggagcggcagagcaagttgacaataagggcagaaacttccttcacgtcgctgtgcagaattcagatatagaatcagtactgtttctgattagtgtccacgcaaatgtcaactctagggtacaggatgcatctaagctgacccccctgcatctcgcggtacaggccggaagtgagattatagtgcggaacctgcttcttgctggcgccaaagtcaacgagctgaccaagcatagacagactgcccttcacctggctgcacagcaggatctgcctacgatttgcagtgtgctgttggaaaatggtgtagactttgcagccgtggatgaaaacggaaacaacgcccttcacctggccgtgatgcatggccgacttaataatatacgcgtactacttaccgaatgcactgttgacgctgaggctttcaacctccggggccaaagtcctcttcatatcctcggccagtacggaaaggaaaacgccgcagcaatctttgacctctttctggagtgcatgcccggctatcctttagacaaaccagacgcagacggaagcaccgtgcttctgctggcttacatgaagggtaacgccaatctgtgtagagcgatagtgaggagtggcgctcgcctgggggtgaataataaccagggtgtaaacattttcaattatcaggtggcaacgaagcaactgctcttcaggctcctcgatatgctgtccaaagagcctccctggtgtgacggctcttattgttacgagtgtactgctcggttcggtgtgactacaagaaaacaccactgccgccattgcgggcggttgctttgccacaaatgcagcaccaaggagatcccaatcattaagttcgatctgaataagccagtgagagtttgtaatatctgttttgacgtgttaaccttgggcggcgtctcgtag

SEQ ID NO: 24372 - DNA, 2472 bp, Artificial Sequence
  Description of Artificial Sequence: Synthetic coding sequence
atgaagctgtttgggtttggtagcaggaggggccaaaccgcacagggatctatagaccacgtttataccggctccggatacaggattcgcgattccgagctgcagaaaatacacagggcagctgtcaagggcgatgccgccgaggtggagcgctgcctggctagacgttccggggatctcgacgccctggataaacagcacaggacagcactgcatcttgcctgcactagtggacatgtccaggttgtcacccttttggtgaatcggaaatgccagatagatgtgtgcgataaggagaacagaactccgcttatccaagctgtgcactgccaggaggaggcctgcgcagtgattttgttggaacacggcgcaaacccaaatctgaaagacatctatggaaacaccgccctgcactatgctgtgtactcagagtccacctccctcgctgaaaaactcctgtctcatggcgcccatattgaggccttggacaaagataataacacacccctattgttcgctattatctgcaagaaagaaaaaatggtggagttcctgcttaaaaagaaggccagcagccacgccgtggatagactgcgtaggagcgctcttatgcttgccgtgtactatgacagtcctggaatcgtgaacatcctgctgaagcagaacattgacgtgtttgcgcaagacatgtgtggtagagatgccgaagactacgctattagtcatcatctgacaaagattcaacagcagatcctggagcacaaaaaaaagattttgaaaaaggaaaagagcgatgtgggcagctcagatgaaagtgctgtaagcatattccatgaactgcgggtggactctcttccagcctcagatgataaggatctgaatgtagctactaaacaatgtgtgcccgagaaagtttctgaacccttgcccggctcgtctcacgaaaagggcaatagaatagttaacggccaaggagagggccctcccgctaaacatccctccctgaagccaagtactgaagtggaggaccccgctgtgaagggtgccgtgcagcgtaaaaatgtgcagacacttcgggccgaacaggccctcccagtggctagtgaagaggagcaggagagacacgagaggtctgagaagaagcagccccaagtaaaagaagggaacaacacaaataaaagtgaaaagattcagctgtcagaaaatatctgtgacagtaccagcagtgccgctgcgggccgactgacacagcaaaggaaaatcggcaaaacttacccgcagcaatttcctaagaaactgaaagaggagcacgataggtgcacattgaagcaggagaacgaagagaagaccaacgtaaatatgctctacaagaagaatcgagaggagctggaacgcaaggaaaagcaatacaagaaagaagtggaggcgaagcagttagagccaacagtgcagtccctcgaaatgaagagtaaaacagcccgcaacacacccaattgggactttcataatcacgaggaaatgaaaggcctcatggacgaaaactgtatcctgaaagccgatattgccattttgcgccaggagatttgtacgatgaagaatgacaacctggagaaagaaaacaagtacctgaaggacatcaagattgttaaagaaacaaatgcagccctggaaaaatatataaaactgaatgaagagatgatcactgagaccgccttcagatatcaacaggagctgaacgacctgaaggctgagaatacccgtctcaatgccgagcttctgaaagaaaaggagtcaaaaaagcgcctggaagctgatattgaatcttatcagagtaggctggccgcagcaattagtaaacacagtgagtcagttaaaacagaaaggaacctgaagctagcactggaacgaacccgcgatgtttccgttcaggtggaaatgtcatctgcaatatcaaaggtgaaagctgagaacgaattcctgactgaacagttatccgagacgcaaattaaatttaacgcgctcaaggataagttccggaaaacgagagatagtcttagaaagaagtccctagcattggagaccgtgcagaacgacctctcacagacgcagcagcaaacccaagaaatgaaggagatgtaccagaatgccgaggcaaaagtgaacaattcgactggaaagtggaactgcgtggaagaaaggatctgccacttgcaaagagaaaatgcttggctggtccagcagctggatgacgtacaccagaaggaggaccacaaggagattgtgacaaatatacaaaggggctttattgaaagcggaaagaaagacctggttctggaagaaaagagcaagaagctcatgaatgaatgcgaccaccttaaggagtccttattccagtacgagcgcgagaagaccgaaggggtggtgtccataaaggaggacaagtattttcagacatcaaggaagacgatttag

SEQ ID NO: 24373 - DNA, 1359 bp, Artificial Sequence
  Description of Artificial Sequence: Synthetic coding sequence
atgaaggtccaacccagcgtgacatgcgtcgccagctggggcggaatcgtgcatcttgaagccttcggcgacccggtgatcgtcctgagaggggcatgggccgtaccccgggtagattgtttaatagatacccttcgcacacccaacgcttcgtgcatgagaaaagggacacacttactcgtgccctgtttggaggaggaagaactcgccttacaccggcgaagactcgacatgtccgaagcactgccatgccctggaaaagaaacaccaaccccaggctgccgccttggggccctgtactgggcgtgtgtccacaatgatccgacacagctgcaggccattctcgacggcggcgtaagcccagaagaagcaacacaggtggactcaaatggccgaaccggtctgatggtcgcgtgctatcacggattccaaagcgttgtggctctccttagccattgcccgtttctggacgtcaatcaacaggataaggggggtgacaccgccctgatgctggccgcgcaggcagggcatgtgcctttggtatctcttttactaaattactatgtgggcctcgatctggaaagacgggatcagaggggtctgaccgctctaatgaaggccgcaatgcggaatagatgtgccgaccttactgcagtcgatccagtgcggggaaagaccgcactggagtgggcggtcttgacagattcctttgacacagtctggaggatacgtcagctgctaagaaggccgcaggtagaacagctgtctcagcattataagccagagtggccggccctcagcggccttgtggcgcaagcccaagcgcaggcccaggtcgcgccaagcttactggagagacttcaggccaccctgagcctgccattcgcaccatctcctcaggaaggtggtgtcctggaccatctggtgaccgctaccacgagtttggccagcccttttgtcaccactgcctgccatacgctgtgcccagatcaccccccctccttaggcacccggagcaaatctgtcccagagctgctcggaacagcacctcccccaccgctggttcctcagtccccccctgggtctccacagaggagcccttgggtctttgtgccttaccagtccccacaaggtatcctgtccaaatgcttgcaatggctccagccccgcgattccacgtcacccaggccacaggtgcccaaaatcttactgagcaaagccagttcgtcctcacatcagtgtcaacccaagcccagcccttctggccaccagtcgttggctctccctctgtggcggtaccaggagctgaggattgagaaaaggaaacaggaggaggaggcccgcatggcccagaagtag

SEQ ID NO: 24374 - DNA, 687 bp, Artificial Sequence
  Description of Artificial Sequence: Synthetic coding sequence
atgtcttacgtcttcgttaatgatagctcccagacaaatgtgcctctgttgcaggcttgcattgacggagacttcaactactccaagcgcctactcgaatctgggttcgaccccaatattcgggactctcgagggagaactggccttcatctggccgccgcccgaggaaacgtggacatctgtcagctcctgcacaagtttggagctgacctcctggccacggactaccagggcaacacagcgctgcatttgtgtggtcatgtggacacaatacagtttctcgtgtccaacgggctgaaaatcgacatctgcaaccaccaaggagcaacacccctagtactcgctaagagacgtggcgttaataaagacgtcatcagattgctagagtccctcgaggagcaggaggtgaaggggttcaatcggggcacccattccaagctggagaccatgcagacagctgagtctgagtcagctatggagagtcattctctgcttaacccaaatctgcagcagggagaaggggttctgtcgagcttccgcacaacttggcaagagttcgtggaggacttaggattttggcgcgtactcctgcttatatttgtcatagcgctgctgtctctagggatcgcttactatgtcagcggggtgctgccttttgtggagaaccagcccgagttggtccactag

SEQ ID NO: 24375 - DNA, 588 bp, Artificial Sequence
  Description of Artificial Sequence: Synthetic coding sequence
atgagctatgtctttgtgaatgactcttctcagactaacgtgcccctgctccaggcctgcatagatggcgatttcaactactctaagcgcttactggagtccggctttgacccgaacatcagggactcacggggccgtacgggactgcatctggcagcagctcggggcaacgtggacatctgccagctgctgcacaaattcggcgcggacctgctggctacagactatcaaggcaacacagcattgcatctatgtggccacgtagatactattcaatttttagtttctaatggtctaaaaatcgacatctgtaatcaccagggagcaacgcctctggttctggcaaaacgccgtggagtgaataaagacgttatccgtttgctcgagtcattggaagaacaggaggtgaagggattcaaccgaggcacccatagtaaacttgagacaatgcagaccgccgagtccgaatccgccatggaaagtcacagcctcctgaacccaaacctccagcagggtgaaggagttctgtcaagctttcggaccacgtggcaggaattcgtcgaagatctgggtttctggagggtgtag

SEQ ID NO: 24376 - DNA, 687 bp, Artificial Sequence
  Description of Artificial Sequence: Synthetic coding sequence
atgagctacgtgttcgtcaacgattccagccaaacaaatgttcctctcctacaggcctgcattgacggggacttcaactacagcaagcggctgctagagagcggcttcgaccctaatattagagattccaggggcaggaccggactgcatctggctgccgcaaggggaaacgtggacatttgccagctgttgcataagtttggtgctgatctcctggctacagactatcaggggaatacagcgctgcatctctgcggacatgtcgacacaatccaattcctcgtttccaatggattgaagatcgatatctgcaatcatcaaggcgcaaccccactcgtcttagccaaaagaagaggtgtcaataaagatgtcattcgactgttagagagtttggaagagcaagaagtgaagggttttaatcgcggaacccatagcaaacttgagacgatgcagacagccgaaagcgagtctgccatggaaagccacagcctcctgaaccctaacttgcagcaaggcgaaggtgtgttaagcagcttcaggaccacttggcaggagtttgtagaggacttgggcttctggagagtattactgcttatatttgtgatagctctgttatcgctgggaattgcatactatgtgagcggcgtcctaccctttgtagaaaaccagcccgaactggtgcactag

SEQ ID NO: 24377 - DNA, 687 bp, Artificial Sequence
  Description of Artificial Sequence: Synthetic coding sequence
atgagctatgtctttgtgaatgatagcagccagaccaatgttccactcctccaggcctgtatagatggagactttaattactctaagcggttgctggaatccggattcgaccctaatataagagattctcggggcagaactggactgcatctggctgccgcacgtgggaacgttgacatttgtcaactgctgcacaagttcggagcagacctactggccaccgactaccagggaaatactgcattgcatctgtgcggccatgttgacactattcagttcctggtttccaacgggttaaagatcgatatctgcaatcatcaaggcgccacaccgctggtcctcgctaagagacgaggtgttaacaaggacgtaatccgcctgctggagtctctggaggagcaggaagtgaaggggttcaaccgaggcacacacagcaagctggagacaatgcaaacagctgagtcagagtctgccatggagagccactctctgctcaatccaaacctgcagcagggtgagggtgtgctgagttcgttccgaaccacatggcaagaattcgttgaggacctggggttctggcgggtactcctgcttatttttgtgatcgccctgctgtctctcggcattgcatactatgtttccggggtgctcccgttcgtcgagaaccaacccgagctggtgcattag

SEQ ID NO: 24378 - DNA, 699 bp, Artificial Sequence
  Description of Artificial Sequence: Synthetic coding sequence
atgtcctatgtttttgtcaacgattcctcccagactaacgtcccactgctgcaggcatgtattgacggcgactttaactacagtaagaggttactggagtccggatttgacccaaacattcgcgattcaaggggcagaaccggtctgcacttggccgctgctcgcggtaacgtagatatctgtcaactgctgcacaagttcggagcagatctgcttgctaccgactatcaggggaatacggcattgcatctgtgtggacacgttgacactatccagtttttagtgtccaacgggcttaaaattgatatctgcaatcaccagggtgctacgccactggtccttgctaaaagacgaggcgtgaataaggatgttattcgactactggaaagtctggaggagcaagaggtaaagggtttcaaccggggaacgcactccaagttggaaactatgcagacagctgaaagcgagagtgctatggagtcccattccttattaaatcctaaccttcagcagggtgaaggggtcctgagttcttttcgcacaacgtggcaggaattcgtggaagacctggggttctggagagttcttcttctgattttcgtaatcgccctgctgagcctggggatcgcttactaccgtcggactttgagattaggcagcttcgctcgccaagatcggtcgaggatccaagccatctag

SEQ ID NO: 24379 - DNA, 249 bp, Artificial Sequence
  Description of Artificial Sequence: Synthetic coding sequence
atgtcctacgtattcgtgaacgactcatcgcaaacaaatgttccattgctccaggcatgcattgatggggacttcaactacagtaagcgtttgttagaaagcggcttcgaccctaatatcagagatagcagggggcgaacggggctccatttagccgccgcccgggggaacgtggacatctgccaactgctgcataaattcggcgcagacctgctggcgaccgactatcaagggaatacggccttgtag

SEQ ID NO: 24380 - DNA, 261 bp, Artificial Sequence
  Description of Artificial Sequence: Synthetic coding sequence
atgagttacgtatttgtcaacgattcgagccagactaacgtgccgttacttcaggcatgtattgatggggatttcaactactccaagcggctgctggagagtggcttcgaccctaatattcgagactcccgaggccgtactgggcttcacctggcagccgcaagaggcaacgtcgatatatgccagctcttacacaagtttggtgcagaccttttagctactgactaccagggcaatactgccctccacctgtgtggctag

SEQ ID NO: 24381 - DNA, 312 bp, Artificial Sequence
  Description of Artificial Sequence: Synthetic coding sequence
atgtcctacgtttttgtgaatgacagcagtcagaccaatgtgcctctgctccaggcttgcatcgacggcgactttaattatagcaagcgactgcttgaaagtggatttgacccgaatatacgggactctcgcggcaggacaggactccacctggctgcagcccgggggaacgtggatatctgccagctgctacataagttcggggcggaccttctggcgacagactaccagggcaataccgccttacacctctgcggacatgtggatacaatccagtttctggtcagcaacggacttaagatcgacatctag

SEQ ID NO: 24382 - DNA, 1074 bp, Artificial Sequence
  Description of Artificial Sequence: Synthetic coding sequence
atggggaatagacattcccaaagctacaccctgagtgagggctcccagcagctccccaaaggagactctcagcccagcaccgtggttcagcccctcagtcacccgtccagaaatggagagccagaagctccccaacctgccaaagcctcttcccctcaggggttcgacgtggacagggatgccaagaaactgaacaaggcctgtaaaggcatgggaaccaacgaagctgccatcattgaaatcctatcaggtaggacctcagatgagcgccagcagataaaacagaaatataaggctacctatggcaaagagctggaagaagtgctgaagtctgaactgtccggtaactttgaaaaaacagctctcgccctgctggatcggccatccgaatacgccgcgaggcagctacagaaggccatgaaaggacttggaactgacgaatccgtgcttattgaagtgttgtgcacgcgtacaaataaggaaatcatcgccataaaagaagcataccaaaggctgtttgacagaagcttggagtctgatgtgaagggggacacctccggaaacctgaaaaagatcctcgtgagtctgctccaggccaatcggaatgaaggggatgacgtcgacaaggatttggccggccaagatgcaaaagacctctatgatgcaggagaaggcagatggggaacggatgagcttgctttcaacgaggtgctggctaaacgtagctacaaacagctccgtgcaactttccaggcgtaccagatccttattggcaaagacatcgaggaggcaatcgaggaggaaacttccggagatttacaaaaagcgtacttgactcttgtccgttgtgcccaggattgcgaagattactttgcagagagactgtataagtccatgaagggtgccggtacagacgaagagactctgatacggatcgtggtgacccgagccgaggtggaccttcagggaatcaaggcaaagtttcaagagaaatatcagaagagcctatctgatatggtcaggtcagatacctctggggacttcagaaagttacttgtggccttgctgcactag

SEQ ID NO: 24383 - DNA, 951 bp, Artificial Sequence
  Description of Artificial Sequence: Synthetic coding sequence
atgggcaatcggcatgcaaaagctagctcaccacagggcttcgacgttgaccgagatgcaaagaagctcaataaggcctgcaaaggtatgggtacgaacgaggccgccattatcgagatcctctcagggcggacatctgatgagaggcagcagattaagcaaaagtacaaagccacctatggaaaggagctcgaagaagttctgaaatcagaactgtctggtaactttgagaaaaccgcactggcactcctcgacaggcccagcgagtacgccgcccggcagcttcagaaggccatgaaaggccttggaaccgatgaatccgtcctcattgaagtcctgtgtactaggacaaataaggaaatcatcgctatcaaggaagcttaccagagactattcgatcggtcactcgagagcgatgttaaaggagatacatcgggcaacttgaaaaaaatcctcgtcagcctcctgcaagcgaatcgcaatgagggcgacgatgtcgacaaggacctggcaggtcaagacgcaaaggacctgtatgacgctggtgaagggcgttggggcacagacgaattagccttcaatgaagtgctcgcaaaacgctcctacaagcaattgcgtgctaccttccaagcttaccagatcctgatcgggaaggatattgaagaggcaatcgaagaggagactagtggcgatcttcagaaggcctatctcacacttgttagatgcgctcaggactgcgaagactatttcgctgagcgcctatataagtctatgaagggagccggtaccgacgaagagacactgatcagaattgttgttacacgagctgaggtcgacctgcagggcatcaaagcaaagttccaagagaaataccagaaatctctcagcgatatggtgaggtccgacacctccggcgattttaggaaacttctagttgcactgttgcactag

SEQ ID NO: 24384 - DNA, 2946 bp, Artificial Sequence
  Description of Artificial Sequence: Synthetic coding sequence
atggtgcaccactctggaagcatccaatccttcaaacagcagaaggggatgaatatttccaagtcggaaattaccaaggagacaagtctcaagcccagcaggaggagcctgccatgtctggcccaatcatatgcctactctaagtcattgtcacaatctacctctctctttcagagcaccgagtccgagtcacaagcaccaacatcaattactctaatttctactgacaaagctgagcaggttaatacagaagagaataaaaatgacagtgtcctgcgctgcagctttgctgacctgtccgacttttgcctggccttaggcaaagacaaggattatacagacgagtcagagcatgcgacctatgatcggtctcgccttatcaatgatttcgtaattaaggacaagtctgaattcaagacgaaattgagcaagaacgacatgaactatatagcatcttctggaccgctgtttaaagatggcaaaaagcgcatcgactacatcttggtctacaggaagaccaacattcagtatgacaaacgtaatactttcgaaaagaatctgcgggcggagggcctgatgctggagaaggaacctgcaattgccagcccagacattatgtttattaaaattcatattccctgggacacactgtgcaagtacgcagaacgattgaacattagaatgccattccgcaaaaaatgctattacacagatggacgctcaaaatctatggggagaatgcagacttatttccgcaggatcaaaaattggatggctcagaatccgatggtgctagataaaagcgcttttcctgatcttgaagagtccgattgttatacaggccccttcagtagagcgaggattcaccacttcattatcaataataaggatactttctttagtaatgccacccggtcaaggattgtatatcatatgctcgagaggaccaaatacgaaaacgggatcagtaaagtgggtatacgcaagttgatcaataacgggtcttatatagccgcttttccgcctcatgagggcgcatataagagcagtcagccaatcaaaacccatggaccgcagaataacaggcatttgctgtatgaacgctgggcacggtggggaatgtggtataagcaccagcccctcgatctgataaggctctactttggggaaaagataggcttatactttgcttggctaggctggtatacgggcatgctgattcccgctgccatcgtcggcctttgtgtattcttctacgggctgtttacaatgaataatagccaagtttctcaggaaatttgtaaagccaccgaggtatttatgtgtcctctttgcgataagaactgctctctgcagcggctaaatgacagttgcatctacgcgaaagtcacatacctgttcgataacgggggtactgtcttctttgcgatcttcatggccatctgggcgaccgtttttctggaattctggaaaagaaggagatcaatcctcacctacacttgggacctgatcgagtgggaagaagaggaagaaacactccggccgcaatttgaagctaaatactataagatggagatagtcaatccaatcactgggaagcccgagcctcaccagccctcttctgacaaagtcacgcgtcttcttgtctcagtgagtggtattttttttatgatctcactggtgatcacagccgttttcggcgtcgtcgtatatagactcgtcgtgatggagcaattcgcctccttcaagtggaactttatcaaacagtattggcaattcgccacctcagccgcggcagtgtgcataaacttcatcatcatcatgttactcaacctcgcctacgagaaaattgcttatttgttaacaaacttagaataccctagaaccgaaagcgaatgggagaactcttttgcacttaagatgtttttgttccaatttgtgaaccttaacagcagcatcttttacatcgccttttttctgggtcggttcgtcggacatccaggaaaatataacaagctattcgatagatggcggctcgaggagtgccacccaagtggatgtctgatcgacctgtgtcttcagatgggcgtgattatgtttctcaagcagatctggaataattttatggagcttggctatcctctcatacaaaattggtggagccgacataagattaagcggggaattcacgatgccagcatcccacagtgggaaaatgattggaatctacagcctatgaacctgcacggacttatggatgaatacctggagatggtgttacagtttggatttaccactatctttgtcgccgcctttcccctggccccactattagcattgttgaacaatataatagaaatccggctggatgcatataaatttgttactcagtggagacggcccttgcctgcgcgagcgacagacatcggaatttggcttggaatcctcgaggggattggtatcttggcagtaattactaacgctttcgtgatcgctatcacttctgattacatccctaggttcgtctacgaatacaagtatggaccctgcgctaatcatgtggaaccatctgaaaattgtctaaaaggatatgtgaataactccctgtccttcttcgacctgtccgaactggggatgggaaaatccggctactgcagatacagggattatagaggtccaccttggagctctaagccatatgaatttacgcttcaatattggcacattcttgcggctcggttggcgtttatcattgtgttcgagcacctcgtattcggcataaagtccttcattgcttacctgattccagacgtcccgaaggggctgcatgatcgcataaggcgagaaaaatacctcgtacaggaaatgatgtatgaagctgagctcgaacatctgcaacagcagcggagaaagagcggacagcctgttcatcacgaatggccttag

SEQ ID NO: 24385 - DNA, 2898 bp, Artificial Sequence
  Description of Artificial Sequence: Synthetic coding sequence
atgaatatatctaaatccgagattaccaaggagacatccctgaagccaagtcgacggtctctcccctgcttagctcagtcttatgcttatagcaagagcctatcccagtctacttccctatttcagagtacagagagcgaaagccaggcacccacgtctatcactttaattagcacagacaaagccgaacaggtgaatactgaagagaacaagaatgattcagtgctccgatgtagttttgctgacctgtcagatttctgtttggcgctgggtaaggataaggattacacagatgagtcagagcatgccacctacgatagaagccgcttgattaatgactttgtgattaaagataagtctgaattcaagaccaagctgtcaaagaacgacatgaactacatcgcaagcagcggacctctttttaaagatgggaagaaacggatcgactacattcttgtgtaccggaagaccaatatacagtatgacaaaaggaataccttcgagaaaaacctaagggctgagggcctcatgctggagaaggaaccagccattgccagtcctgacatcatgtttatcaagatacacatcccctgggataccctgtgcaagtacgctgagaggttaaatataagaatgccattccgcaagaagtgttattacacagatggacgatcaaagtccatgggcaggatgcagacctacttcaggcggatcaagaattggatggcacagaacccgatggtgctggacaaatctgctttcccagacctggaggagtcagattgctacaccgggcctttctctcgggccagaattcaccacttcatcatcaacaacaaggacacattcttctctaacgctacccggagccgcattgtgtatcacatgctggaaaggactaagtatgaaaacgggatttcaaaagtgggcatcaggaagctgattaataacggctcctatattgccgcctttccccctcatgagggtgcttacaaaagcagtcagcctatcaagacccacggcccccagaataacaggcacctcttatatgagcgctgggcgaggtggggcatgtggtataagcatcagcctcttgaccttattaggctgtatttcggtgagaagatcggactgtacttcgcatggctgggatggtacaccggcatgctgatccccgccgcaatagtgggtctgtgcgttttcttctacgggctgttcactatgaacaactctcaggtttcacaggagatctgtaaagctactgaggtgtttatgtgccccttgtgtgacaagaactgttcactgcagaggttgaatgactcctgcatctacgctaaggtcacatatctctttgacaatggcggcacagtgttcttcgccattttcatggcaatttgggctactgtttttctcgaattttggaaacggaggagaagtatcctcacttacacttgggacctgatagaatgggaggaagaggaggagacactccggccacagtttgaggccaaatattataaaatggagatcgtcaaccctattaccggtaaacctgaacctcatcagccatcctccgataaggttacaaggttgctggtttcagttagcggaattttctttatgatatctctggtgatcaccgcagttttcggggtggtggtgtatcggctggtggttatggagcagttcgcaagctttaaatggaacttcatcaaacagtactggcagttcgctacatcagcagccgccgtgtgcattaattttattatcattatgctcctgaatctggcgtatgagaaaatagcttatctcctgactaatctcgagtatccacgaacggaaagcgaatgggagaacagcttcgcccttaagatgtttcttttccaatttgtgaacctgaattcctctatcttctacatcgccttttttttggggagattcgttggacaccccggcaaatacaacaaactgttcgaccgctggaggctggaagagtgtcacccgagcggttgcttgatagatctatgcctgcaaatgggcgttatcatgttcctcaaacagatttggaacaacttcatggagctcggatatcccctgatccaaaattggtggagtcgccataaaatcaaaagaggcatccatgatgccagcatccctcagtgggagaatgactggaatctgcagcctatgaacttgcatgggcttatggacgaataccttgaaatggtgctacagtttgggttcacaactatttttgttgcggccttccctctggcccccctgctggctctcctcaataacatcatagagatcaggctggatgcctataaatttgttacccaatggcgtagaccacttccagcccgagccacagatatcggcatctggctgggcatccttgaggggatcggtatcctggcggtgattaccaatgctttcgtgatcgctattacttcagattatatccctcggttcgtttatgagtacaagtacggtccttgtgccaatcacgttgaaccctcagaaaactgtcttaagggttacgtgaataattccttgtcattttttgacctgtcagagctgggcatgggaaagtctgggtattgcaggtatagagattatagaggtcctccttggtcatccaaaccctacgagttcaccctgcaatattggcacatcctcgctgccagattggccttcataatcgtgttcgagcatctcgtgttcgggataaaaagcttcatcgcttatcttatacctgacgtgccaaagggcctccacgatagaattcgccgcgaaaagtatctagtccaggaaatgatgtacgaggcagaactggagcatcttcagcagcagagaagaaaatccggccagcctgttcaccacgaatggccctag

SEQ ID NO: 24386 - DNA, 2508 bp, Artificial Sequence
  Description of Artificial Sequence: Synthetic coding sequence
atgaattatatcgcctcctctggcccactctttaaggatggaaaaaagcggatcgattacattctggtataccgaaagacgaacattcagtatgacaagcgcaacacatttgagaagaacctccgcgccgaggggcttatgcttgagaaggagcctgccatcgcctccccagacataatgtttattaagatccacattccctgggatacactgtgcaagtatgccgaacgcttgaatatcaggatgccctttcgcaaaaagtgctattataccgatggaaggagcaagtctatggggagaatgcagacatactttaggcggataaagaactggatggctcagaatcccatggttctcgacaaatccgcatttcctgatttagaagagtcggactgctacaccggtcccttctcgagggctaggattcatcacttcataataaataataaggatacattcttctccaatgccactcggtcacgaattgtttaccatatgctagaaagaaccaagtacgagaatggaatttctaaggtcggcattaggaagcttataaacaatgggtcctatatagccgcattccctccacatgaaggggcctacaaaagctctcagccaatcaagacccacggcccacagaacaaccgtcaccttctgtatgaacggtgggcgcgctggggcatgtggtacaaacatcagccgctcgatcttatccggctgtacttcggagaaaagatcgggctttactttgcctggttaggttggtataccgggatgctgattccagctgcgattgttggtttgtgcgtcttcttctacggactgttcacgatgaataacagccaggtcagtcaggaaatctgtaaggccacagaagtgtttatgtgcccgctttgtgataagaactgtagtctgcaaagactgaacgattcttgcatttatgcaaaggtaacatacctcttcgacaacggcggaactgtgttcttcgccatttttatggccatttgggctaccgtgtttctggagttttggaagcgacggcggtcaatcctcacgtatacctgggatctcattgagtgggaggaggaggaggaaacactgcggccccagttcgaagcaaaatattacaagatggagattgtaaatcctattacaggcaagccagaaccccatcagccatctagtgacaaagtcacaagactgctggtctcggtctcaggaatattctttatgatctccttagtgatcaccgccgtgtttggggtggtggtgtacaggcttgtcgtgatggagcaattcgcttcttttaagtggaacttcattaaacagtactggcagttcgcaactagtgccgccgcggtctgtattaatttcataatcatcatgctgttgaatcttgcctacgagaaaatcgcatatctcctcaccaatctcgagtatccacggactgagtccgagtgggagaattcatttgccttaaaaatgtttctgtttcagtttgtgaatctgaacagctcgatcttctacatcgctttttttctgggccgcttcgttggacatcctggtaagtacaataagctgttcgatagatggaggctcgaggaatgccacccctcagggtgcctgattgatctctgcctgcaaatgggagtcattatgttccttaaacagatttggaacaattttatggagcttggctacccccttattcagaattggtggagcagacacaagattaagcgcggcatccatgatgcttcaattccccaatgggagaacgattggaatttacagcccatgaaccttcacggtctcatggacgaatacttagagatggtcctccaatttggatttacaaccattttcgttgctgcctttccactcgccccgctcctcgctttgctcaataatattattgaaatccgacttgatgcctataagtttgtgacccagtggaggcgaccccttcctgcccgtgcaaccgacatagggatttggctcggtatcctagagggcatcggtattttggccgttataacaaatgccttcgtgattgccatcaccagcgactatatcccgcggtttgtgtacgagtataagtatgggccctgtgcaaatcatgtggagccttctgaaaactgcttgaaagggtacgtcaacaattctctcagcttttttgacctttccgaactgggcatgggaaaaagtggttattgtcgctaccgagattaccggggacctccttggtcaagcaaaccctacgaattcacgctccagtattggcacattcttgcagcacgactggccttcatcatagtcttcgaacatttggtgttcggcattaaaagtttcatagcatatcttattcccgacgtaccaaaaggtttacacgatcgtattaggagagaaaaatacctcgtgcaagagatgatgtacgaagcggaactcgagcacttgcagcagcagaggagaaaatccggtcagccggtccaccatgagtggccttag

SEQ ID NO: 24387 - DNA, 2898 bp, Artificial Sequence
  Description of Artificial Sequence: Synthetic coding sequence
atgaatattagtaaatctgagatcaccaaggagacaagtttgaagccaagtaggcgcagccttccttgcctggcccagtcttacgcctacagtaaaagtttatcacagagcacatcgctatttcaaagcactgagagcgaaagccaggcccccacctcaattactcttattagtaccgataaggctgaacaagtcaatactgaagaaaacaagaacgatagcgtactgcgatgtagtttcgcagacctgtctgacttttgtctggctctgggcaaggataaagattacacagatgagagtgagcacgctacttacgaccgctcccgactcataaatgactttgtgatcaaagataaatctgaattcaagaccaaactgagtaaaaacgatatgaactatatagcgtccagcggtcccctgttcaaagacgggaaaaagagaattgattacatcctcgtgtaccgaaaaactaatattcaatatgacaagagaaacactttcgaaaagaacctgagagcagaggggttaatgctcgaaaaggagccagctattgcatcacccgatattatgttcattaagatacatataccttgggacaccctatgcaagtatgccgagcggttaaatatacgcatgcctttcagaaagaagtgttattacactgacggccgatccaagagcatgggccggatgcagacatactttagaagaatcaagaattggatggcacaaaaccccatggttctggacaagtccgcgtttcccgatctcgaggaaagcgactgctatactggtcccttctcgagagctcggatacaccactttattatcaataataaggacacattcttcagcaatgcaactcgctcacgtatcgtgtatcacatgctcgaacgaacaaagtacgaaaatggaatctcaaaggtgggtatccgcaagctgatcaataacgggagttatatcgcggcgttccccccacacgaaggagcctataaatcaagccaacctattaaaacgcacgggccacagaataaccgacacctgctgtatgaacggtgggctcggtggggcatgtggtataagcaccaacccctggatctgatccggctgtactttggggagaaaatcgggctgtacttcgcttggctaggatggtacacaggcatgttgatccctgcagctattgtgggactgtgtgtgttcttctacgggctgtttactatgaataactctcaggtaagccaggagatatgtaaggcaaccgaggtattcatgtgccccctctgtgataaaaactgctccctacagaggctgaacgattcgtgtatttatgccaaagtaacctatctatttgacaacggcgggaccgtgttcttcgctattttcatggccatatgggcgacagtgttcctggagttctggaagcggaggcgcagcatcctcacttacacatgggacttgattgaatgggaggaagaggaggagacactgcgaccacaatttgaagccaaatactataaaatggagattgtgaatccaatcaccggcaaacctgagccgcatcaaccctcatctgacaaagttacacgactcctggtgagcgtttcgggcattttcttcatgattagcttagtaatcaccgccgtcttcggtgtagtcgtgtacagactcgttgtgatggaacagttcgctagttttaaatggaatttcataaaacagtattggcagtttgccaccagtgccgctgccgtatgtattaactttattatcataatgctgctcaatcttgcttacgaaaagatagcttacctgctcaccaacctggaatacccaagaactgaatcagagtgggaaaatagcttcgccctgaaaatgtttcttttccagttcgtgaaccttaatagctctattttttacatagcttttttccttggccgattcgtaggccacccaggtaaatacaataagctgttcgacaggtggcggctggaagagtgccacccatctggttgtctgatcgatctgtgccttcagatgggggtgataatgttcctcaagcagatttggaataatttcatggaactgggttaccctctgattcagaactggtggagtcgccacaagattaagaggggtatccatgatgcttccatacctcagtgggaaaatgattggaatctgcagcctatgaatctccacggactgatggatgagtacctggaaatggtacttcaattcgggtttaccaccatatttgtagctgccttcccacttgctcccctcctggccctgctcaataacattattgaaattagacttgacgcttacaagttcgtgacgcagtggcgtcgaccactgcctgcccgcgccaccgacatcggcatttggctgggaatcctcgagggcattggaatcctggcagtaattaccaacgcatttgtgatcgccatcaccagcgactacattccgaggttcgtctacgagtataagtatggtccttgtgcaaaccatgtggagccctccgaaaactgcctaaagggatatgtaaacaacagcttaagtttctttgacctgtcggagttaggaatgggcaaatccggctactgtaggtatcgggactacaggggaccgccctggtcctctaagccttatgaatttactcttcagtattggcacattctggccgcccgcctggcctttatcatcgtgttcgaacatctagtgttcgggattaagtccttcatcgcgtatctgatcccagacgtgcccaagggcctgcatgacagaattcgaagagaaaaatacctcgttcaggagatgatgtacgaggcagaacttgaacatctccagcagcagaggcggaagagtgggcagcctgtgcatcatgagtggccctag

SEQ ID NO: 24388 - DNA, 2652 bp, Artificial Sequence
  Description of Artificial Sequence: Synthetic coding sequence
atgcgccctggacctaacaagccatacccatcacattcaaatatcttcgcctatcattcatctgctcttggaaaagataaggattatactgacgaaagcgagcatgccacctacgacagatcacgactgattaacgactttgttattaaggacaaatcagaatttaaaacaaaactgtccaagaatgatatgaactacatcgctagtagcggcccactatttaaagacggcaagaaaagaatagattacattctcgtgtataggaagacgaacatccagtacgataaacgtaacacctttgagaaaaacctccgcgctgagggtctgatgctggagaaagagcctgcaatcgcttcgcctgatataatgttcatcaagatccatatcccttgggataccttgtgcaaatacgccgagcgactgaatatacgtatgcctttccgaatgcaaacttattttagaagaattaaaaactggatggcacagaacccaatggtgcttgacaagagcgcatttcccgacctggaggaaagcgactgttatacagggccatttagtcgggctcggatccaccactttattataaacaataaggacacgttcttttccaacgctacgagaagccgtatagtctaccacatgctcgaacggacaaagtatgagaacggcatcagtaaagtgggaatacgcaaattaattaacaatggcagctatatagcagcattccccccacatgagggcgcctataagagtagccaacctattaagacacatggaccgcagaataaccgccacctcctgtacgagcgctgggctagatggggcatgtggtacaagcaccagccccttgacctgattagactttattttggtgagaaaattggcctgtactttgcctggctcgggtggtacaccgggatgctaatccctgctgcaatcgtgggcctctgcgtcttcttctacggcctctttaccatgaacaatagccaggtgtctcaggaaatttgcaaagctactgaagtgttcatgtgtcccctgtgcgacaagaattgttcactccagcggttaaacgactcgtgtatatatgctaaggtgacctatcttttcgacaatggtggcacggtcttcttcgcaatcttcatggctatttgggctactgtatttctcgagttctggaaacgaaggagaagcattttaacctatacatgggacctaatcgaatgggaggaagaagaggagactcttaggcctcagtttgaggctaagtattacaagatggaaattgtcaatccaatcacaggcaagccagaaccgcatcagccctcgtcagataaagtgacaagactgctggtttccgtatcgggaatcttcttcatgatttcgttggtcatcactgcagtctttggtgtcgttgtataccgcttagtggttatggagcaatttgcaagctttaaatggaactttattaaacaatattggcagtttgccacgtctgcggccgccgtctgtataaatttcatcattataatgctgctgaatctggcctacgagaagatagcttatctgctcaccaatttggaatacccacgcaccgaatccgagtgggaaaactcgttcgctttaaaaatgtttctgttccaattcgtcaatctgaactcatcaatcttttatattgccttcttcctgggacgtttcgtgggacacccaggcaagtacaacaaactgtttgaccgttggcgtcttgaagaatgccacccttctggttgtctgatagacttatgcttgcagatgggggtgatcatgttccttaaacaaatttggaacaatttcatggagttaggttatcccttgatccaaaattggtggtcacgccataaaatcaaacgcggcatccatgatgcttccattcctcagtgggagaatgactggaacctgcaacccatgaatctgcatggcctgatggacgaatacctggagatggtgctgcaattcggatttaccacgatcttcgtcgccgcgtttccactggctccccttttagccctgctgaacaatattattgaaattagactggatgcttacaagtttgtaacacagtggagacggccgctgcccgcacgggccaccgatatcggaatttggctaggcattcttgaggggattggaatcctagccgtgataaccaatgcctttgtgatagcaataacttcagactacatcccacggtttgtttatgagtacaaatacggtccatgcgccaatcacgtggaaccctctgagaactgcctgaagggctatgtaaataactcactgagtttctttgacctcagcgagctgggtatgggtaaaagcggctactgtagatacagagactatcgcgggcccccctggagttccaaaccctacgagtttactctccagtactggcacattctggctgcgaggctggcgtttataatcgtgtttgagcatttggtctttggcattaagtccttcatcgcttacctaattcctgacgttcccaagggtctgcacgaccgcatcaggcgcgagaagtacctggttcaggaaatgatgtatgaagcagaactagagcatctgcagcagcaacggaggaaatccggacagcctgtccatcacgagtggccgtag

SEQ ID NO: 24389 - DNA, 1428 bp, Artificial Sequence
  Description of Artificial Sequence: Synthetic coding sequence
atggctgtgtgggcaacagtctttcttgagttttggaagagacggcgggccgtgatcgcatacgactgggatctgatagactgggaagaagaagagatctgtgttgtcatagctgcagttttcgggatcgtgatctatagggttgtgaccgtctcaacattcgcagcatttaaatgggctttgattcggaacaattctcaggttgcaacgaccggtaccgctgtctgcatcaatttttgtattataatgctgttgaatgttctctatgaaaaggtcgctctgctcttgaccaacctcgaacagccacggaccgaatcggaatgggaaaattcatttacattgaaaatgttcctgtttcaattcgtgaacctgaactccagcaccttctacatcgccttcttcctcgggcgcttcacaggacatcctggcgcttatcttcgcctcatcaataggtggagactcgaggaatgtcacccaagcggctgcctcattgacctgtgcatgcagatgggcatcatcatggttctgaagcagacatggaataactttatggaactgggctaccccttgatccagaattggtggacacgccgcaaagtgcgccaagaacatggacctgagcgtaaaatctctttccctcaatgggaaaaagactacaacttacagccgatgaacgcctatggtctctttgacgaatatttagagatgatcctccagttcgggttcaccacaatattcgtggctgcttttccgttggcccccctcttggccctcctgaacaatattattgaaatcagattggacgcctacaagttcgtgacgcagtggcgaagaccgctcgctagcagggccaaagatattggcatctggtacggcatccttgagggtatcggcattttgagcgtgatcacgaacgcttttgtgatcgctatcaccagcgactttatccctaggcttgtctacgcttataaatatgggccctgcgccggtcagggcgaagcggggcaaaagtgcatggtcggatatgtaaacgccagtcttagcgtgtttagaatatcagattttgagaatagatctgagcccgaaagcgacggatctgagttcagtggcaccccactgaagtactgccggtatagggactaccgcgaccccccacatagtctggttccatatggctatacgctccagttttggcatgtcctggcagcgaggctcgcatttattatcgtgttcgagcacctggtgttctgcataaaacacttgatctcctacctgattccagacctacctaaagatttgagagacaggatgagacgtgaaaaatacctcatccaagagatgatgtacgaggcagaattggaacgactgcagaaggaaaggaaagaaagaaagaaaaatggaaaggcccatcacaatgagtggccgtag

SEQ ID NO: 24390 - DNA, 2868 bp, Artificial Sequence
  Description of Artificial Sequence: Synthetic coding sequence
atggaggctagcagttccggcatcaccaacgggaagactaaggtgttccatccggaggggggtgttgaccttcaaggctatcaactggatatgcagatcctgcccgacggacctaaatccgacgttgacttttctgagatcctgaacgctattcaggaaatggccaaggacgtaaatatcctgtttgacgaattggaggccgtgagctcaccttgcaaggatgacgattctctcttgcatccgggcaacctcactagcaccagcgatgacgcaagcaggttggaagcaggcggcgagacggtgcctgagcgaaataagagtaatggcctctacttcagagatgggaaatgcaggatcgattacatattggtttatcgtaagagtaatccacaaaccgagaagagagaggtgttcgagagaaacattagagctgagggcctgcagatggagaaggagtcatccctgatcaacagtgacattatttttgtgaagctgcacgctccctgggaagtgcttggtcgctacgcagagcaaatgaatgtccgaatgccattccgcagaaaaatctattaccttccacgccgatataaattcatgagtcgaattgataaacagatatctaggtttagacgttggcttccgaagaaacccatgcggcttgacaaagaaacactgcccgatctggaggagaacgattgctacactgcccccttctctcagcagcgaattcaccactttataatacacaataaggaaaccttcttcaataacgcaacaaggagtcgtatcgttcaccacatcttgcagcgcataaaatacgaggaaggaaagaacaagatcggccttaatagattactgactaatgggtcatacgaagctgcgttccctctgcacgagggatcatacagatcaaagaactccattaggacacacggggccgagaatcacagacacctgttatatgagtgttgggcgtcttggggagtgtggtacaagtatcaaccgctggatctggtgagacgctatttcggggagaagatcgggctatacttcgcatggctgggctggtatacagggatgttgtttcctgccgctttcataggactattcgttttcctctacggtgtgactactctagaccactctcaggtctcaaaggaggtgtgccaagccacggacattatcatgtgccctgtgtgcgacaagtactgcccattcatgagactcagtgactcctgcgtttacgccaaagttacccacctgttcgacaatggtgccacagtttttttcgcagtgtttatggccgtttgggcaaccgtgtttttggagttctggaaaaggcgtcgggctgtgatcgcctatgactgggacttgattgactgggaagaggaagaggaggaaataagaccgcagttcgaagccaagtactctaagaaagaaagaatgaatcctatctcagggaagcccgaaccctatcaggcctttaccgacaagtgttcacggcttattgtgagtgcgtcaggcatcttctttatgatctgcgtagtgatcgcagctgtgttcggcattgtcatttatcgagtggtcacagtttctacattcgcagctttcaaatgggcgctcattcgtaataattcccaggtggccaccaccggtaccgcagtgtgcatcaacttctgtatcataatgctgctcaatgtgttgtatgagaaggtggctctccttctcaccaacctcgaacagcccagaacagagtctgaatgggaaaattcttttaccctcaaaatgtttctgttccagtttgtgaacttgaactcttcaactttttatattgccttcttcctgggccggtttacaggacacccgggcgcatacttacgactgatcaataggtggcggctggaggagtgtcatccctccggttgtctgatcgacctctgcatgcagatggggataattatggtccttaagcaaacatggaacaactttatggaattaggttatcctctgatccaaaattggtggaccagacgcaaggtgagacaggaacacggtccggaaagaaagatctcattcccacaatgggaaaaggattacaacctgcagcccatgaacgcctatggcctgttcgacgaatatcttgaaatgattttgcagtttggatttacgacaatcttcgtggctgccttccctcttgctcctctcctggcactcctgaataacattattgagattagactggacgcctacaagtttgtgacccagtggcggcggccacttgctagccgggcaaaagacattggcatctggtacggcatcctggaaggtataggtattctgtccgtcataaccaacgcatttgtgatcgccatcacatccgatttcatccctagattggtgtacgcttataagtatggaccctgcgctggacagggtgaggctgggcagaagtgcatggtgggctacgtcaacgcgtcgctgtctgtcttcagaatctctgacttcgagaaccgctcagagcctgagtcggacggaagtgagtttagcggtaccccactgaagtactgcaggtacagagactatcgcgatcccccgcattctcttgtcccctatggatataccctgcagttctggcacgtgttggctgcgagactggccttcattatcgtctttgaacaccttgtgttctgcattaaacatctgatctcgtacctcatccctgacctgccaaaagatctgagggacagaatgaggagagagaagtatttgattcaggaaatgatgtacgaggctgaactggagagactccagaaggagaggaaagagcggaagaagaacggcaaagctcatcacaatgagtggccatag

SEQ ID NO: 24391 - DNA, 2763 bp, Artificial Sequence
  Description of Artificial Sequence: Synthetic coding sequence
atggaggcaagtagttccggcattaccaatgggaaaactaaagtgtttcaccccgtcgcaaaagatgttaacatactctttgatgaactggaagctgtctcctcgccctgcaaagacgacgactcccttctgcatcctggaaacttgaccagtacttcggacgatgcctcccgcctggaggctggcggagagactgttccagaacgtaacaagagcaacgggctctatttcagagatggcaaatgccgcatcgattatatcctggtctataggaaaagtaatccgcagactgaaaaaagggaagttttcgagcgaaacatacgggccgaggggctgcagatggaaaaggaatctagcctcattaattctgacattatctttgttaagctccacgccccttgggaggtcctaggtcggtatgccgagcagatgaacgtgcgcatgccattccgacggaaaatttattacctcccgagaagatacaagtttatgtcccgtatcgacaagcagatctcaagattccgaaggtggctgccgaagaagcccatgaggctagataaggagaccctgcccgatttggaggagaatgactgttacaccgcaccgttctctcagcagcggatacaccacttcataatccataataaggagaccttctttaacaacgctacccgaagtcgcattgtgcaccacatcctgcaacgtataaaatacgaggagggcaaaaacaaaattggattgaacagattgctcaccaatggctcttacgaggccgccttccctttacacgagggttcgtaccgctccaagaacagcatacggacacatggcgctgaaaaccacaggcatctcctgtatgagtgttgggctagctggggtgtttggtacaaatatcagcctctcgacctggtaagaagatatttcggggagaaaataggcctttacttcgcctggctcggctggtacactggcatgttgttcccagcagccttcattggactgtttgtgttcctgtatggagtgactactctagaccactctcaagtgtcaaaagaagtctgccaggcaaccgatatcatcatgtgtccagtctgcgacaaatactgcccatttatgaggctgtctgacagttgtgtgtatgctaaggtgacacatctcttcgacaacggtgctacggttttttttgccgtgttcatggcagtctgggcaaccgtgttccttgaattttggaagcggcgccgagctgtgattgcttatgactgggatctgattgattgggaagaggaggaagaggaaatccggccacaattcgaggcgaagtactcgaaaaaagagcgcatgaacccgatatcaggaaagcctgagccatatcaggcctttacagataaatgctcaaggctgatcgtatctgctagcggaattttttttatgatttgtgtggtgattgctgctgtgtttggcatcgttatttacagggtcgtaacagtcagtacatttgccgccttcaaatgggcactgatcagaaacaactctcaggtggcgactactggcacagccgtctgcattaatttctgcatcatcatgctgttgaatgttctctacgagaaagtggcactgttactcacaaatctggaacaacccagaacggaatccgagtgggagaactccttcacattaaaaatgttcctgttccagtttgtgaatttgaactcgtctacattctatattgccttttttcttgggcggttcactgggcaccctggcgcctacctgcggctgatcaacaggtggcggctggaagagtgccacccgagtggttgcctcattgatctgtgcatgcagatgggaataatcatggtgttgaaacaaacatggaataacttcatggaattggggtacccgctgatacagaattggtggacccgaaggaaggtcaggcaggagcacgggccggaacgcaagattagcttcccccagtgggaaaaagattataatctccaaccaatgaatgcctatggactgttcgatgagtacctggagatgattctgcagtttggcttcactacgatctttgtggctgcatttccacttgcgccccttttggccctgttaaataatatcattgaaattcgtttggacgcttacaagtttgtcacccagtggaggcgcccactcgcctcgcgggctaaggatatcggtatctggtacggaatcctggaggggatcggcatattatccgtgataaccaacgcgtttgtgatcgccattacctccgactttatcccacgcctcgtgtacgcatataaatacggcccttgcgcgggccagggagaggccgggcaaaagtgtatggtgggctacgtaaacgccagcctgagcgtgttccgaatttcggactttgagaatcgctccgaaccagagtcagatggtagcgagtttagtgggacaccacttaagtactgccgttatagagactacagggaccccccacattctttggtcccatacggctatacattacagttctggcacgtcctggctgcgagactcgctttcataatagtgtttgaacatctagtgttctgtatcaagcatttgattagttatttgatcccggacctccctaaggacctgcgggaccgcatgaggcgggaaaaatacctgatccaggaaatgatgtacgaagcagagttggaacgactccagaaagaacgtaaggaacgaaagaagaatggaaaagcacaccacaatgagtggccgtag

SEQ ID NO: 24392 - DNA, 1071 bp, Artificial Sequence
  Description of Artificial Sequence: Synthetic coding sequence
atggcatctctcaccgcatatgacaaggacgtgagtagtggttcatataatctatcaagcgccactacaggtagctattactcctgcgtctctcagattaccattgggtatgatgtcgcgggcccagtcgccattggcctgacccactggaaaaacccatatgtgcagggacgacccacactcccatctgacctgcccttgtttgtcagcaaggacgccggcatcccggtttatcaccgatctttcactcggaagactgaccaagccacgcccctgagctgtccagcgtcgctgtctattaccccagtcccctcatactccagttcgtctcaggaaaccctctctcaggacacaaccgggctcagtctgtctatacatggtgctgagaagcgactccagatacatcagcgcagatctgtggcgtcccgcccagccagccgcaggcgacttccagtggtccgccactcttcgctcccacctggccgaagatccatcaaaatggaggcctcgagtagcgggattaccaatgggaagacaaaggttttccatcccgaggggggggtggacctgcagggctaccagctggatatgcagatcttgccagacggtcctaaatccgatgtcgacttctcagagatcctcaatgctatccaggagatggccaaggatgtgaacattttgttcgatgagctggaagcagtgtcaagcccatgcaaggatgatgacagtttgctgcatccaggaaatttgacctcgacctcagacgacgcctcgaggttggaggccggaggcgaaacagtgccagagagaaacaaaagcaacgggttgtattttcgggacgggaaatgcagaattgactatatccttgtgtacaggaaaagtaatcctcagacggagaaacgggaagtgtttgaacggaacatcagagccgaggggctccagatggagaaggagtcttctcttatcaactcagacattatctttgtgaaactgcatgctccctgggaggtgctggggagatacgccgagcaaatgaacgtccgaatgccattttcgagcaactgcaattag

SEQ ID NO: 24393 - DNA, 36 bp, Artificial Sequence
  Description of Artificial Sequence: Synthetic coding sequence
atggaggcaagttcatcagggataacaaacggttag

SEQ ID NO: 24394 - DNA, 1428 bp, Artificial Sequence
  Description of Artificial Sequence: Synthetic coding sequence
atggccgtctgggccactgtatttctggaattctggaagaggcgccgcgcagtcatagcttacgattgggacctcattgactgggaagaagaagagatatgcgttgtgatagcagcggtgtttgggatagtcatctatcgggtggtcaccgtttcgacatttgctgctttcaagtgggcactgatccgaaacaacagccaggttgcgactactggaactgccgtatgcattaatttttgtatcatcatgctgcttaatgtcctgtacgagaaagtggccctgcttctgacaaatttggagcagcccagaacagagtcggagtgggagaatagcttcactctcaagatgttcctgttccagttcgtgaacttgaactcctcgactttttatatcgcattcttcctaggacgtttcacaggccatcctggggcatatctgcgtctgattaatcgatggagactcgaagagtgccaccccagcggatgcctgatagatttatgtatgcagatgggaatcatcatggtgctcaaacagacctggaataatttcatggagctggggtatcctctcattcagaactggtggacccggagaaaagtaaggcaggaacacggccccgaacgcaagatctcatttccacagtgggaaaaagactacaatctgcagcccatgaacgcatatggcctatttgatgagtatttggaaatgatacttcaattcggcttcacaactatattcgtagccgcctttccccttgccccgctactagccctactaaacaatattattgagatccgccttgacgcatacaagtttgtgacacagtggcgcagacctctagcctcgcgagcgaaggatatcggcatctggtatgggatcctagagggcatcggcatcctcagcgtgattaccaatgcttttgttatagctatcacttccgactttatcccccggctagtctatgcctacaagtacggcccttgcgccggacagggcgaggccggccagaaatgcatggtaggatacgtgaatgccagtttgtccgtttttcgcatctccgattttgagaaccgctctgagcctgagtccgacggatcagaattctctggtactcctctaaaatattgtcgctaccgggattaccgggacccaccccacagcctcgtgccttacggatacacactgcagttctggcacgtcctggccgcaaggttagcatttatcatcgtttttgagcaccttgtgttttgcattaagcacctgattagctatctgatacccgatctgcccaaggatctcagagatagaatgcgtcgggagaagtatttaatccaggagatgatgtacgaggcagagctggagcgcctgcaaaaggagagaaaagagcgcaagaaaaatggtaaggcccatcataacgaatggccctag

SEQ ID NO: 24395 - DNA, 2802 bp, Artificial Sequence
  Description of Artificial Sequence: Synthetic coding sequence
atgcgcatggctgctacggcctgggcgggcttacagggtcctcctcttcccacactctgccccgccgttcggaccggattgtactgtcgcgatcaggcccatgctgagagatgggctatgacatccgagaccagcagcgggagccattgcgccagaagccgcatgctccggcggcgcgcccaagaggaggattccactgtcctgatcgacgtctcacctcccgaggctgaaaaaagaggcagctatggcagcacagcccacgcaagcgagcctggggggcagcaagctgcggcttgcagagctggaagcccagcgaagcctagaattgcggattttgtactggtttgggaggaggatctgaagctggatcgtcagcaagacagtgccgctagggatcggacggatatgcaccgcacatggagggaaactttcctggataacctgagggccgctggcctctgtgtggaccaacaggatgtccaggatggcaacaccactgttcattacgcgctcctcagtgccagttgggccgtactttgttattatgccgaggacctcagactgaagctgcctcttcaggaactacctaatcaggcatccaattggtctgcgggcctattggcctggctcggtattcccaatgttctgctcgaagttgtccccgacgttccaccggaatattattcttgccgctttcgggtgaataagttacctcgctttctcggctcagataaccaggacactttctttaccagcacaaagcgccaccagattctattcgagatactcgcaaaaactccatatgggcacgagaagaaaaacctgctgggaatacatcaacttttggccgaaggtgtgctcagtgccgcttttccgctacatgatggacctttcaaaacaccaccggaagggccccaggctccgcgcttgaaccagagacaggtcctgttccagcattgggcccgctgggggaagtggaacaagtaccaaccattggatcatgttcgcaggtacttcggagaaaaagtcgcactttacttcgcatggctcggcttctacacagggtggttacttccagcagccgttgttgggacactcgtcttccttgtaggctgttttttggtgttctcagatattccaacccaagaactttgtggcagcaaagactccttcgagatgtgcccgctgtgcctggattgccccttttggctgctttcttcagcctgtgcccttgcccaggctggaagactgttcgatcatggtggcacagttttcttctccctcttcatggccctctgggccgtgctgctgcttgagtattggaagcgcaagtctgctactttggcgtaccgttgggattgttctgattatgaggacaccgaggagcgacccaggccgcaattcgctgcatcagctcctatgaccgccccgaacccaattaccggggaggacgagccctacttccctgaacgctcgcgggctagacgcatgcttgccggcagtgtcgtgattgtggttatggttgccgtggtggttatgtgcctggttagtatcatactgtatagagccattatggccatcgtagtgtcccgcagcggtaataccctactggccgcctgggcctcacgcatcgcaagcctcacaggcagcgtcgtgaacctcgtttttatcctcatcctgagcaagatctacgtgtctcttgcccacgtactgactcggtgggagatgcacagaactcagacgaagtttgaggatgccttcacactgaaagtgtttatctttcagttcgtgaacttctacagctcacctgtgtacatcgccttctttaaggggcgctttgtaggatatccaggaaattatcatactctcttcggagtgcgcaacgaggagtgtgcggctggtggatgcttgattgagctggctcaggagctgctggtcatcatggttggcaagcaagtgattaacaacatgcaagaagtgcttattccaaagctgaaggggtggtggcagaagttccgactgcgcagcaagaaacggaaagccggcgcctctgccggagcatcacaggggccttgggaagatgattatgaattggtgccctgtgaggggctgtttgatgagtacctagaaatggttttgcagttcgggttcgttactatcttcgtggctgcctgccctctagctccactgttcgcactgcttaataactgggttgaaattcgcttggatgctcgcaagttcgtgtgtgagtaccgtcgcccggtggccgagagagcccaagatatcggcatttggtttcatatcctggctggactgacccacctcgccgtgatctccaacgccttcctgcttgccttcagctcagacttcctgcctagggcgtactacaggtggactcgggcacacgacctgcgcggcttcctgaattttaccttggctcgtgcccccagttcatttgccgctgcccacaatagaacctgccgctatagagcatttcgagacgacgacggacactattcacaaacttactggaatttgcttgccattcggttagcctttgtgatagtctttgagcacgtagtgtttagtgtgggcagactcttggacctcttggtgccagacattcctgagagtgtggagatcaaagtaaaacgcgagtactatttggcgaagcaggctctagccgaaaatgaagtgctattcgggactaacggcacgaaagacgagcagcccgagggctccgagctgtctagccactggacaccattcactgtgcctaaggcatcacagctgcaacagtag

SEQ ID NO: 24396 - DNA, 2652 bp, Artificial Sequence
  Description of Artificial Sequence: Synthetic coding sequence
atgcggatggccgctaccgcatgggcaggtctgcaaggtccccctctgcctacattgtgtcctgccgtccggaccggtctgtattgccgcgatcaagcccacgccgaaagatgggcaatgacctccgagacgtcatctgggtcacattgtgcccggtcccgtatgctccgacgccgggcccaggaggaggactccactgtcctcattgacgtctcccctcccgaagccgaaaaacgtggcagttacgggtccaccgcacacgcgtctgagccgggtggccagcaagctgctgcttgcagggcaggatctccggcgaaaccccggatcgattttgtgctggtgtgggaagaagatctcaaactggatagacagcaggatagtgctgcaagagacaggactgacatgcatcgcacttggcgggaaacattcctcgacaatctccgagcggccggactttgtgtggatcagcaagacgtgcaggacggaaacacaactgtccactatgcgttgctctccgcgtcatgggccgtgctgtgctactacgcagaggatctccggttgaagcttcccctgcaggaacttcctaatcaggctagcaattggagcgccggccttctggcatggctgggcattcctaacgtgctcctggaggtcgtgccagatgttccgcccgagtactattcctgcagattcagggttaataaactgcctaggtttctggggagcgataaccaggacaccttctttactagcaccaagcgacaccaaatcctgtttgagattctcgcaaaaactccgtacggacatgagaagaagaacctgctgggaattcatcagctgctggccgagggggttctaagtgcagcttttcccttgcacgacgggcctttcaaaactcccccggagggtccgcaagcaccccgactgaaccagaggcaggtgctgtttcagcactgggccagatggggcaaatggaataagtatcagccacttgaccatgtccgtcggtattttggtgagaaggtggcactgtacttcgcatggcttgggttttacaccggatggctgctgccagccgccgtggtggggacactggtgttcttggttggctgctttctcgtatttagcgatatccccacacaggaactctgcggatctaaagactcgtttgaaatgtgtcctttgtgcttggactgtcccttctggctgctgtcttctgcctgcgctctggctcaggcaggtcggctcttcgatcacggcggaaccgttttcttttccctgttcatggccttgtgggccgtgttactcctggaatactggaaaaggaagtcggctacattggcatacagatgggattgctctgactatgaagatactgaggaaagacccagaccacaatttgctgcgtcggccccaatgaccgctccaaatcccatcacaggagaagacgaaccgtacttccccgaaagaagcagagcccggagaatgctggccggctctgtcgtgatcgtggttatggttgcagttgtcgtgatgtgccttgtctccataatcctgtaccgtgcaatcatggctatcgtagtgtccaggagtgggaatactttactcgccgcttgggcttccagaatcgcgagcctaactgggagcgtagtaaatcttgtcttcatcctgattttaagcaaaatatatgtgagtctggctcatgttttgaccaggtgggaaatgcacaggacccagaccaagttcgaagacgccttcacgctcaaagtttttatcttccaattcgtcaatttctactctagcccagtgtatatcgctttcttcaagggacgattcgtgggttatccagggaattaccacacgctatttggtgtcaggaacgaggaatgcgccgctgggggttgcctcatagaactcgcccaggagctgctcgttattatggtgggcaaacaagtaataaacaacatgcaggaagtcctcatacccaagctgaagggatggtggcagaaattccggctgcgaagcaagaaacggaaggctggtgccagtgccggagcgagccaaggcccctgggaagacgactacgagctggtcccctgtgagggtctctttgacgaatatttagagatggtgttgcagtttggatttgtgacaatcttcgtagcggcttgtcctcttgctcccctgtttgctcttctcaataactgggtcgagattaggttagatgcaaggaagttcgtctgtgaataccgacggccagtggctgagcgggcacaggacattggtatttggttccacatcctggctggtctaacacacctcgccgtcattagcaacgcctttttgctggccttttcctccgatttcttacctcgcgcctactaccgctggacccgcgcacacgaccttaggggtttccttaattttaccctggcacgcgccccatcttcgtttgcggctgctcacaaccggacctgcagataccgagccttcagagacgacgacggtcactactcccagacatactggaacctcttggcaattcgtctcgcttttgtgattgtctttgaggtagccgaagcgcctgcaggctccccgatccacggtatgagaccccggccatgtgcccttcctaactcttccacgtggtag

SEQ ID NO: 24397 - DNA, 540 bp, Artificial Sequence
  Description of Artificial Sequence: Synthetic coding sequence
atgaggatggctgctaccgcttgggcgggattacaaggcccacctctgcctacgctctgccccgcggttcggactggcttatattgtcgggaccaggctcacgcagagagatgggcgatgactagtgagacatccagcggttctcactgtgcacgcagtcgtatgttaagacgcagggctcaggaggaagactctacggtgctgatcgatgtaagcccccctgaagctgaaaaacgcggttcttatggaagtacagcccacgcatccgaaccgggtggccagcaggccgcagcgtgtcgggctggcagtccggcgaaaccaaggattgacttcgtcctcgtgtgggaggaagacctcaagctcgacagacagcaggattctgcggcacgcgaccggactgacatgcacagaacttggcgggagacattcctcgataaccttagagcggccggcctctgtgtggatcaggtccgaggaggttgtcacggccaagggccccgcccatgtatacactccgtcacacacgatctggcagcatag

SEQ ID NO: 24398 - DNA, 3699 bp, Artificial Sequence
  Description of Artificial Sequence: Synthetic coding sequence
atggccgaagccgcttccggggcaggcggaaccagcttggagggcgaaagaggcaagagacctccccctgagggcgagcccgccgctcctgccagcggagtgttggacaagctgttcggcaagcgccttctgcaagccggtcgctatttagtgtcccacaaagcttggatgaaaacagtgcctacagagaactgtgacgtgttaatgactttccccgacacaacagatgaccacaccctgctatggctgctcaatcacattagggtgggaatccctgagctgatcgtacaggtgagacaccataggcacacccgagcctatgcatttttcgtcaccgctacctatgaaagcttgctccggggcgccgacgagctgggtcttaggaaggccgtaaaggccgaattcgggggcggcactcgtggattctcctgtgaagaggatttcatttacgagaatgtagaatctgaactgagatttttcacctctcaggaacgtcaaagcatcatcagattctggctgcaaaacctccgtgccaagcagggagaagcactgcataacgtgaggttcctggaggatcagccaattattcccgagctcgctgctcggggaataattcagcaggtcttccccgtccacgagcaacgaatcttaaatcgcctgatgaagagctgggtgcaggcggtctgtgaaaaccaacccctggacgacatttgtgattattttggggtcaagatagcaatgtatttcgcatggttaggattttacaccagcgctatggtctatcccgcggtgttcggcagtgtcctgtacacattcacggaggctgatcagacttctcgtgacgtgtcttgtgtcgtgtttgcactgtttaacgtgatttggtccacccttttcctcgaagagtggaagaggagaggagccgaattagcttataaatggggaactctggatagccccggcgaggctgtggaagagccccggccccagtttcgcggtgtgagaagaatctcgcccatcactcgggccgaagagttttactatcctccatggaagcgcctgctgttccagttgctagtttcccttccactttgcctggcctgcttggtttgcgtgtttctgttaatgctgggatgcttccagctgcaggagctggtcctgtcagtgaaaggcctgcctcggctcgccagattcctacccaaggtgatgctggcgcttctggtgtcggtttccgctgaaggctataagaaacttgctatctggctgaacgatatggaaaactaccggctggaaagcgcgtacgaaaagcacctaatcattaaagtggttcttttccagtttgtcaattcctacctgtcattgttctacataggcttctacctgaaagatatggaaaggctcaaagagatgctcgccacactcctgatcacacgccagttcctgcagaatgtgagggaagtgttgcaaccacacttatatcgacgtctggggagaggggagctcggacttagggccgtttgggagctggcccgagcgctcttaggactgctgagcttacggaggcccgcgcctcggcggctggagccccaagctgacgagggtggtggaggaggcagcggaggcggaggcaggcgctgcctatccggcggatgtggcgcaccagaggaagaggaagaggcagctctcgtggagcgtcgccgtgctggggagggcggcgaggagggggatgggccccccggaggaaaggaggaggacgaagatgatgaagaagaggaggacgaagaggaagaggaagacgaggaagaaggcgaggaaggcgggctgctggactgcgggctacgattgaaaaaggtctcatttgccgagcggggtgcaggacggcgtaggcctgggccatccccagaggctttgcttgaagagggcagccccacaatggtggaaaaaggcctggagccgggggtgtttaccctagccgaagaggatgatgaggccgagggagcaccaggctctccagaacgtgagccgcccgcaattctgttccggcgtgctggaggagagggccgcgatcagggccctgatggcggtcctgacccagagccaggatctaattcagattctacccggcggcagcggcgccagaatcgcagctcctggattgatcctccggaggaggaacactcaccacagctgacacaggctgaacttgagtcctgtatgaaaaaatatgaagatacattccaggattaccaggagatgtttgtgcagttcggctacgtcgtgctgttttcttcggccttccccctcgctgccctttgtgctctggttaacaatttgatcgagatcaggagtgatgccttcaagttgtgcacaggtcttcaacgcccatttggccagagggtggagtctatcgggcagtggcagaaggtcatggaggcaatgggtgtcctagccatcgtggtcaactgctacctgataggtcagtgtggtcagctgcagcgcctcttcccctggctgagcccagaggcggctatcgtgagtgttgttgtgctggagcatttcgcacttctcctgaagtatctgatacatgtcgccatacctgatatccccggctgggtggccgaggaaatggccaagttggagtatcaaagaagagaagcatttaagcgccatgaacgtcaggcgcaacaccggtatcagcagcagcagcgccgacgacgagaggaagaagaacgacagaggcacgctgagcaccacgcgcgaagggagcatgatagcggagggagagaagaggccagagcagaaggctcaggcctggacccagcgacttccagcgaaaaggcatccgccaaggctaaaggtagcaccgcgggtggccatgggcctgagcggcccaaaaggcctgggtcccttctggcccctaataacgtgatgaagctgaagcagattatacctctccaaggaaaatttcttagttctggagccactagctccttggcagccgcaggggccggagcgaccactcgtcctcctcctgcacagtcccctaccgggtctgacactaggttgcctgccttcctgtcattcaagttcctcaagagcccagaaactcgaagagactcggagcgctcccattcccctccaaaggcatttcatgctggaaagttgtttcccttcgggggcactcgggcagagcccgggtcaaatggcgcaggtggccaagcacgccctgatggtactcctagctctggaagcagccgggtgcagaggtctggacctgtggacgaagcgctggcagaagagctagaggctccacggccagaagaagaaggatctggtactgctctggcccctgttggcgcccccgctcttcgcactcggcgatctcgatctccggccccacctcccccaatgccactgccacggcccccaacccctccagctggatgttggcagtgggacggaccgtggggatgcgggggtgagggtgctgctcctcggcaagccctggcggctgctgagtgcccaccttgcgccatggccgggcccccccctgccccgcagccattacctggcgacgcatcattctatagtctaccgccccctccgcttccacctacttcagaccccctcgagaccccagcgccatctccttcgccttcacccagcccccaagccgtttgttggccatcaggatggcactag

SEQ ID NO: 24399 - DNA, 2349 bp, Artificial Sequence
  Description of Artificial Sequence: Synthetic coding sequence
atgcagggcgaagagagtctccgcatcttagtggaacccgagggtgattccttccccttaatggagatttcaacttgcgaaaccgaggcctcggaacagtgggattatgtgttagtagcacaaagacatactcagagagatccgagacaggctcgtcagcaacagttcctggaagaacttagacgtaagggatttcatattaaggtcatacgggatcaaaaacaagtcttcttcggcataagggccgataattctgtcttcgggctctatcgcacattcctgctcgagccagaagggccagctccgcatgctgaactggccgcccctacgaccatccccgtcacaacgagtttgaggatccgaatcgtgaactttgttgtaatgaacaataaaacaagcgctggagaaacattcgaagacttgatgaaggatggggtattcgaggcacgcttccctttacacaagggggaggggagactcaagaaaacttgggccaggtggagacacatgtttcgggagcaaccagttgacgagattcgcaactattttggcgagaaagtcgcactctactttgtgtggttagggtggtacacatatatgctggtgcccgcagccctaaccggactcctggtattcctcagcggcttttccttatttgaagctagtcagatctcaaaggaaatttgcgaagcgcacgacatactgatgtgcccattaggcgatcattccaggcggtaccagcgtcttagtgagacatgcacctttgccaaactgacgcacttgttcgataatgatgggacagtggtcttcgccattttcatggcactgtgggcaactgtatttttggagatatggaaaaggcaaagggcacgcgtcgttctgcactgggacctgtatgtgtgggacgaagagcaggaggagatggctctgcagctcatcaattgcccggattataagcttcgaccatatcagcactcttatctgaggtctaccgtgatcctagttctcaccctgctgatgatctgcctcatgatcggcatggcacatgtcttagtcgtgtaccgcgtgctggcaagcgctttgttctcttcctctgccgtgcccttcctagaagagcaggtcacaacagcggtggtcgtcaccggcgccctggtgcactacgtcacaataatcattatgaccaagatcaatcgatgcgttgctctgaaactctgtgacttcgagatgccccggactttctctgagagggaaagcagattcaccatccggttctttaccctacagttctttacacatttttcatccctgatctatatcgcctttatactgggccgaatcaacgggcatcctggtaagtccactcgacttgccggtctgtggaagttggaagagtgtcacgccagcggttgcatgatggacctgtttgtgcagatggccattataatgggactgaagcaaactctgtctaattgcgtcgagtatctcgtcccatgggttactcataaatgcagatctctgcgggcctcagaatcaggccatcttccgagagacccggaactcagggattggcgccgcaattacttactgaatccagtgaataccttttctttattcgacgagtttatggaaatgatgatccagtacgggttcaccaccatcttcgtcgctgcctttcccctcgcaccgctgctcgccctctttagtaacctggtggaaattaggctggatgcgatcaaaatggtgtggctccagcgtcggttagtccccaggaaggcaaaagatatcggaacttggttgcaagtcctcgaaaccataggtgtgctcgccgttattgctaacggaatggtaatcgctttcacctccgagttcatacctagggtggtgtataagtaccggtattccccgtgccttaaggaaggcaattccacagtcgactgcctgaaaggatacgtgaaccatagcctgagtgtttttcatacaaaggacttccaggatccagatggcatagaggggagcgaaaacgtcaccctctgccggtaccgagactacaggaatcccccggattataatttctctgagcagttctggttcctgctggcaatccgcttagccttcgttatccttttcgaacatgttgcgctctgcattaagctcatcgccgcttggttcgtgccggacattccccagtcggtgaaaaataaagtgttggaggtcaagtatcagcgcctacgtgagaagatgtggcacggacggcaaaggcttggaggagtgggagccggatctcgccccccaatgccagcccacccgactcccgcaagcatcttttctgctcgttcaacggatgtgtag

SEQ ID NO: 24400 - DNA, 2592 bp, Artificial Sequence
  Description of Artificial Sequence: Synthetic coding sequence
atgaaaaagttcttcgattcccgacgcgaacaaggggggtctggactgggcagcggctcctctggtggcggaggcagcactagcggcctgggctccggatatattgggagggtgtttggcattgggaggcaacaggtcaccgtcgatgaggtgctcgcagaggggggtttcgccatcgtctttctggtgagaacctccaatggtatgaaatgtgccttaaaacgtatgtttgtgaacaacgagcacgacttgcaggtctgcaagagggagatccagataatgagggatctgagtggtcacaagaatatcgtgggctatatagactccagcatcaacaatgtctcttcaggagatgtgtgggaagttctgatcctgatggacttttgtcggggcgggcaggtggtgaacctaatgaaccagcggctgcaaactggcttcactgagaatgaggtactgcaaattttttgcgacacttgcgaggctgtcgccaggcttcaccagtgcaagaccccaatcatccatagggatttgaaggtagagaacattctattacacgataggggacattatgttctgtgtgattttggctctgccacgaataagttccagaacccccaaacagagggtgtgaatgctgtcgaggatgagatcaaaaaatatacaaccctgtcttatagggctcccgaaatggttaacctatattccgggaagataatcaccacaaaagctgacatttgggctctgggctgtctcctctataaactatgttactttactcttcccttcggagagagccaggtggcaatttgtgatggcaattttaccatccctgataatagtcgttattctcaggacatgcactgcctaatccgctacatgttggagccagaccccgacaagaggcctgatatataccaagtctcgtatttttctttcaagctgctaaaaaaagaatgtccaatccccaacgtccagaactcccccataccagcaaagcttcctgaaccagtgaaagcctctgaggctgccgctaaaaaaacccagccaaaggctagactaacagatcctataccaaccacagaaaccagcatcgcgccacgccagcgcccaaaggcgggtcagacacagccaaaccccggcatcctgcctattcaacccgctctaactcctagaaagcgagccacagtccagcccccacctcaagccgccgggagctcaaatcaacctgggctgctggctagcgtcccgcagcctaagccacaggcccctcccagccagcccctgccacagacacaggctaagcagccccaggccccccccacgcctcagcaaaccccctcaacccaggctcaagggttacccgcacaggcccaggccactcctcagcaccagcagcagctattcctcaaacaacagcagcaacagcagcagccaccacccgcgcaacagcagcctgcaggcaccttttatcaacaacagcaggcacagacccaacagtttcaagctgttcacccagctactcagaagcctgcgattgctcagttcccagtcgtctctcagggcggcagccaacagcagttaatgcaaaacttctatcagcagcagcagcaacaacagcagcaacaacagcagcagcagttagccaccgcgctccatcagcagcagcttatgacacagcaggccgcacttcaacaaaagcctacaatggcagctgggcagcagccgcagcctcagcctgccgccgctccacagcctgctcctgcccaggagcccgcaattcaggccccagtgcggcagcagccaaaagtccagacaaccccgcccccagccgtgcagggccagaaggttggaagcctaacgccgccatcatcaccaaaaacccaaagagccgggcacaggcgaatactctcggatgtaacccactctgccgttttcggagtgcccgcttccaaaagcacacagctacttcaggccgctgctgcagaggccagccttaacaagtccaaaagtgctacgacaaccccgtctggatctcccagaacgagccagcagaacgtctacaatccttcagaaggctccacctggaatccttttgatgacgataatttctcgaagcttaccgccgaagaactcctgaataaagatttcgctaagctcggtgagggaaaacatcccgagaagctggggggatcagccgagtccctcattccaggctttcagagcacccagggggatgcattcgctaccactagcttcagtgcaggtacagcagagaaaagaaagggcgggcaaacagtagacagcggtctgccactgctttctgtgtcagacccgtttattcctctccaggtgccagacgcgccagagaagttaatagaaggcctgaagtcccccgacacttcactgcttctccccgatctcctcccaatgactgacccctttggtagcacttccgatgcagtaattggtaaggtgatcataagtgtgagctccgtcatgcacgacatgtgcgcctgtttcaagaatgacaaatatctggtgaatcaatcccttggtaacagcccggcaactccggaagccaaagctatctag

SEQ ID NO: 24401 - DNA, 2886 bp, Artificial Sequence
  Description of Artificial Sequence: Synthetic coding sequence
atgaaaaagttctttgactcccgaagagaacagggaggctctggtcttgggtcagggagctctggaggcggaggctcaactagcggcttaggtagtggatacataggtagagtgttcggcatcggcaggcaacaggtcacagtggacgaggtgttggcagaaggcggcttcgccatcgtttttttggtccggacaagcaatgggatgaagtgtgccctgaagcgaatgtttgtgaacaatgagcatgatcttcaagtgtgcaagcgggagattcagataatgcgagacctgagcggtcacaagaatatcgtagggtatatcgattcctcaatcaataacgtctcctccggtgatgtctgggaagtgttaatcctcatggatttttgtagagggggacaggtcgtgaacctaatgaatcaaagactccaaaccgggttcacagagaatgaggtattgcaaattttttgtgatacatgcgaggccgtggctagactacaccaatgcaagacacccatcatccatagggatttaaaggtcgagaatatcctgcttcacgatagaggacattacgtactatgcgactttgggagcgcaactaataagttccaaaaccctcaaaccgaaggtgtcaacgccgtcgaagatgagatcaagaagtacaccaccctatcatacagagccccagagatggttaatctgtacagcgggaagattatcactactaaagcagacatctgggcgttaggttgccttctgtacaagttatgttacttcaccttgccatttggtgaatctcaggtggctatctgtgacggaaacttcactatccctgataactcccggtatagccaggacatgcactgcctgattcgttacatgctggagccagacccagacaagagacctgacatctatcaagtatcctatttttccttcaagttgctgaagaaggaatgtcctatcccaaatgtgcagaattcaccaatccccgccaagctgccagagcctgttaaggcctccgaggcagcagccaagaagacccaacctaaggcaagattaactgaccccatccccactacagaaacatctatcgcacctcgccagagacctaaggcgggccaaacacagcccaaccctggaatcttgcctatacagcctgctctcactccccgcaagagggctactgtacagcctccaccgcaggcagccggctcttctaatcagcccggacttctggctagcgttccacaaccgaaaccccaggccccaccttctcagcccttgccccagactcaggccaaacagccgcaggccccacctacacctcagcagacaccatctactcaggcacaggggctccccgcacaagctcaggccaccccacagcatcagcagcagctttttctaaagcagcagcaacagcaacagcagccaccaccagcccaacagcagccagcgggtacgttttatcaacagcaacaagcccagacacaacagtttcaggccgtgcaccctgccacccagaaaccagctatcgcccaatttcctgtagtgtctcaaggcgggtctcaacagcagctgatgcaaaatttttatcagcagcagcagcagcagcaacagcagcaacagcagcagcagctcgccacagccctccaccagcagcagttaatgacccaacaggccgccctccagcagaagcccactatggcagcaggccagcagccacaaccccaaccggccgccgcgccacaaccggcacccgcccaggagcctgccattcaagcccccgtccgacagcagcctaaggttcagactacgcccccccctgcggtccagggacagaaagtcggtagccttactccaccctcatctcccaaaacacagagggccgggcatcgtcgaatcttgagcgatgttacacactccgccgtgttcggcgtaccggcaagcaagtccacacagctgctacaagccgccgcagcagaagccagcctcaataagtccaagtctgccacgaccacccctagcggcagccctagaacatcacagcagaatgtctacaatccatccgagggttctacatggaacccctttgacgatgataacttttctaaactgacagctgaagagttgcttaataaagacttcgctaaattgggcgaggggaaacatcctgagaagctcgggggcagcgcggagtcactgatcccaggattccagtccacacagggcgacgcctttgccactacatcattctccgcggggactgccgaaaaacgcaagggcgggcaaacggtggacagcggactgcccctgttgtccgtctccgacccattcattccgcttcaggtacccgatgcccctgagaagttgattgagggtctgaagtcacccgataccagtctcctcctccccgatctcctccctatgaccgatccatttgggagcactagtgatgcagtgattgaaaaggctgatgtggccgtcgagagcctgatcccagggctggaaccacccgtgccacagcggctccccagccaaaccgagagcgtgacatccaatagaacagatagtttgaccggagaagactcactgttggactgcagcctgctgtcgaatccaaccactgacctgttggaagaattcgcgcccactgcaataagcgcgccggtccacaaggctgctgaagattccaacctcatcagtgggttcgacgtgcctgaaggtagcgataaagtcgccgaagacgagttcgatccaatacccgtgctgattaccaaaaacccacaaggtggacactctaggaatagcagcgggtccagtgagtcttccctgccaaaccttgcgaggtctttacttcttgtcgatcagctcatcgatctttag

SEQ ID NO: 24402 - DNA, 1143 bp, Artificial Sequence
  Description of Artificial Sequence: Synthetic coding sequence
atggaagaagggggtgatttcgataattattatggggccgacaaccagtccgagtgtgaatataccgactggaaatcttctggggctttgattcctgccatctacatgctcgtatttttattgggaacgaccgggaacgggctagtgctgtggacagtctttaggagttcacgcgagaagcggcggagtgcggacattttcattgcctctttggcggtagcggatctgaccttcgtagtgaccctgccgctgtgggctacatacacctatcgggattacgattggccattcgggacatttttttgcaagctaagctcatacctcatttttgtgaatatgtatgcatctgtgttctgtctcaccggtctgagcttcgaccgctatctggccatcgtgcgcccagtcgccaacgcaaggctgaggctgcgagtttccggagctgtcgcaacggcagtgctgtgggtgctggctgcactgctggccatgcctgtgatggtcctgcgaaccaccggcgatctagaaaacaccacgaaggtccaatgttacatggactacagtatggtcgcaactgtcagttccgaatgggcatgggaagtgggactaggcgtctcctccacgacagttggtttcgttgtaccatttacaataatgctgacctgctacttttttatcgctcagacaattgccgggcactttcggaaggaacgcattgaggggcttcgaaagagaaggaggcttctgtcaattatcgttgtacttgtagtaacattcgccttgtgctggatgccatatcatctggttaaaaccctgtatatgctcgggagcctactacactggccctgcgattttgatctctttttaatgaacatcttcccgtactgtacatgtatttcttacgttaactcctgcctgaatcccttcctctacgccttcttcgatccgcgcttcaggcaggcttgcacaagcatgttatgctgtggccagtctcggtgtgccggaacatcccattcatcctcaggggaaaaatcagcctcctatagttctggccacagtcaaggacccgggccaaacatgggcaaaggaggtgagcagatgcatgaaaagtccatcccatactctcaagaaacactcgtagtagactag

SEQ ID NO: 24403 - DNA, 786 bp, Artificial Sequence
  Description of Artificial Sequence: Synthetic coding sequence
atggaggagggtggcgactttgacaactactatggcgccgataatcagagcgaatgtgagtataccgattggaagtccagtggagcattaattcccgcgatctacatgctggttttccttcttgccatgccagtcatggtcctgcgcacaactggggacttggaaaacacaacaaaagtccagtgctatatggactacagcatggtggccactgtgtctagtgagtgggcctgggaagttggcctgggcgtatcatccacgacagtgggcttcgtggtcccttttacgataatgctgacatgctattttttcatcgcacagacaatcgccggacatttccgcaaggagaggatcgagggcctaagaaaaagaagacgcctgctgagtatcattgtggtactggtggtgacctttgctctctgctggatgccttaccacctcgttaaaaccctgtacatgttgggatctctcctccactggccatgcgattttgatcttttcctgatgaacatctttccatactgcacctgcatctcctacgtgaacagctgcctgaacccttttctgtatgcatttttcgaccccagatttagacaggcatgtacgagtatgctatgttgcggtcagtctcggtgtgcaggcaccagccactcgtcttccggtgaaaaaagcgcctcctacagcagcggtcactctcaggggcctggtccaaatatgggaaaaggcggagagcagatgcacgagaagtcgattccttactcacaggaaacactcgtggttgattag

SEQ ID NO: 24404 - DNA, 900 bp, Artificial Sequence
  Description of Artificial Sequence: Synthetic coding sequence
atgctcgtcttcttactgggtactacaggaaatggcctcgttttgtggaccgtgttccggagctctcgggaaaagcgcaggagtgcagacatctttatcgccagtcttgcggtggcagatcttaccttcgtggtcacactgccgttgtgggctacctacacctatcgagactatgattggcccttcggcacattcttctgcaaactgtcctcctatctcatctttgttaacatgtacgctatgcctgtaatggtactccggacgaccggcgaccttgaaaacacaactaaggtacagtgttacatggactacagtatggtcgccactgtgtctagcgagtgggcctgggaggtgggcctaggtgtttcctccaccacagtgggatttgtcgtgccatttactatcatgctgacctgttacttttttatcgcccagacaatcgctggccattttagaaaagaacggatcgagggcctccgtaagagaaggcggctactctccattatagtagtgcttgttgtgacgtttgctctgtgctggatgccatatcacctggtcaagaccctctatatgttagggagcttacttcactggccatgtgacttcgacctgtttcttatgaatatctttccctattgcacttgcatatcttacgtgaatagttgtctgaatccttttctgtacgcatttttcgaccccaggtttcgacaggcttgcaccagcatgctgtgctgcggccaaagtaggtgtgcaggtacaagccattcatcatccggagagaagagcgcaagctatagcagcgggcattcccaaggccctggtccaaacatgggaaagggtggcgaacaaatgcacgaaaagtctattccctatagtcaagagaccctggtagtcgattag

SEQ ID NO: 24405 - DNA, 621 bp, Artificial Sequence
  Description of Artificial Sequence: Synthetic coding sequence
atgctgccgtgtgctgcaggcgctcgcgggcgtggagccatggtcgtgctgagggctggcaaaaaaactttcttacctcccttgtgcagggcctttgcctgccgcgggtgccagctggcccctgagcgtggggccgagaggcgcgacacggcgccgagtggcgtcagcagattttgtcctcctcgcaaaagctgtcacgattggatcggccccccggacaagtattcgaaccttagacctgtccacttctacatacccgaaaatgagtcccccctcgaacagaagctgcgaaagctccgacaagaaactcaggagtggaatcagcagttctgggctaaccagaacctgaccttctctaaggagaaggaggagttcatccattcccggttaaaaactaaagggctgggactgagaaccgagtcaggccagaaagctactctgaacgcggaggaaatggccgatttttataaagaatttctctctaagaatttccaaaagcacatgtactacaaccgggattggtataagcggaatttcgccataaccttcttcatgggaaaagtagccttggagcggatctggaacaagctgaagcagaaacagaagaagcgatccaactag

SEQ ID NO: 24406 - DNA, 1122 bp, Artificial Sequence
  Description of Artificial Sequence: Synthetic coding sequence
atgggctcccaggtcagcgtcgagtctggtgccctccacgtggttatcgtaggcggaggctttggcgggatcgctgctgcatcccagcttcaggctcttaacgtgccctttatgcttgttgatatgaaggattcctttcaccataatgtagctgcgctccgggcatccgtggagacaggcttcgccaagaaaacattcatctcttattccgttacgttcaaggacaactttagacagggcctagtggtcggaatcgatctaaaaaaccagatggtgctgcttcaggggggggaggcactgcccttctcacacctgatcctcgcaacaggatctacagggccgttccccggaaagttcaacgaagtatcctcacagcaggctgccattcaggcctacgaagatatggtccggcaggtccagcgctccagattcatcgtcgtcgtgggggggggatctgccggtgtcgaaatggctgccgagataaaaaccgagtacccagagaaagaagttaccctgattcacagccaagtcgctcttgccgacaaggaactacttccgtcggtgcgccaagaagtcaaagagatcttactccgcaagggcgttcagctacttctctccgaaagagtgtctaacctggaggaactaccacttaatgaataccgcgaatacatcaaggttcagactgacaagggaaccgaggtggcaacaaatctggtgattctgtgtaccggcatcaagattaatagctctgcttatcggaaagcttttgaaagtagacttgccagttctggcgctctccgagttaatgagcacttacaagtggaggggcacagcaacgtgtatgccattggagattgcgccgacgtgcgaacgcctaaaatggcctatcttgcgggactgcatgccaacattgcggtggcaaatattgtgaactcggtgaagcaaagaccgctgcaggcctacaagcccggagccctaactttcctcctgtccatgggccggaatgatggtgtcggacagatcagcggtttttacgtcggccgtctgatggtgaggttgactaagtctcgagatctgttcgtgtcaacttcctggaagacaatgcgccagtctcccccatag

SEQ ID NO: 24407 - DNA, 1122 bp, Artificial Sequence
  Description of Artificial Sequence: Synthetic coding sequence
atgggctcccaagtttctgtggaatctggggcgctccatgtagtgatcgttggcgggggctttggcggcatcgcagcagccagtcagctgcaggccctcaatgtgccattcatgctcgtcgacatgaaggattccttccaccataacgtggctgccctgagagccagtgtcgagaccggcttcgcgaagaagacatttatctcttactcagttacatttaaggataacttcaggcaaggactggtcgtggggattgatcttaaaaaccagatggtactattacagggcggggaagctctgcccttttctcacttaatactggcgaccggttctacagggccctttccaggcaagttcaatgaagtgtctagccagcaggccgctatccaggcatacgaggacatggtgcggcaagtgcagcgcagtaggtttatcgtggtagtcgggggcggctccgcaggggtggagatggctgctgaaattaaaaccgaataccccgaaaaggaagtgacattgatccacagccaggtggctttggcagacaaggaactgctcccaagtgttcgacaggaggtgaaggaaatcttgctccggaaaggcgtgcagctcctcttgagcgaacgagtgtcaaatctggaggaacttccactgaatgagtatcgggaatatatcaaagttcagaccgataagggtaccgaggtggctacaaatctggtaattttgtgcaccggaatcaaaatcaactctagcgcgtatcgaaaagcgttcgaatcccggctggcatcctctggcgcccttagagtaaatgaacacctgcaagtggaagggcacagcaatgtctacgccattggtgattgcgccgacgtgaggactccgaaaatggcttatctggctggtttgcacgctaatattgcagttgctaacattgtgaatagtgtcaaacagaggcccctccaggcatacaaacccggtgcgctgaccttcctgctgtctatgggaagaaatgacggcgtgggtcagatcagtggattctacgtgggaagattaatggttaggttaacaaagagtagggacctgtttgtcagcacatcgtggaagactatgagacagtcacctccctag

SEQ ID NO: 24408 - DNA, 1011 bp, Artificial Sequence
  Description of Artificial Sequence: Synthetic coding sequence
atgggatcccaggtatctgtggagtccggagcccttcatgtggtgattgtgggaggcggttttggtgggatcgcagcagccagccagttgcaggcactgaacgtgccctttatgctggtggatatgaaggactcattccaccacaatgtggccgcactcagggcctctgtcgagactggattcgccaaaaaaacgtttatttcatattcggtcaccttcaaagacaacttcagacagggccttgtagtgggaatcgatctcaagaatcagatggtccttctacaggggggtgaggtccagaggtccaggtttatcgtagttgtggggggcggtagtgctggcgtcgaaatggccgccgaaatcaaaactgaatatcccgagaaagaggtcaccctgatccacagccaggtggccctggctgacaaagaactgttacccagcgttcggcaggaagtgaaagaaatactcctccggaaaggtgttcagctactattaaccttgctcggggagcgggtttcaaaccttgaggagctgccgcttaatgagtatagggaatacataaaggtgcagacagataaggggacagaggttgccaccaatttagtgatactatgtaccggaattaaaatcaacagtagtgcatacagaaaagcatttgaaagtcgactggcctcttccggcgccctccgggtgaacgagcaccttcaagtcgagggacatagtaacgtgtatgccataggtgattgcgccgacgtgaggactcccaagatggcttatctggccggactgcacgcaaacatcgctgtggcaaatattgtcaacagcgtcaagcagcggcctttgcaggcatacaagcctggcgcgctgacgtttctgctgtccatgggacggaatgatggggttgggcaaattagcggcttctatgtcggccggctcatggttaggctcacaaagtcaagagatttgtttgtctccacatcctggaagacaatgaggcagtctccaccatag

SEQ ID NO: 24409 - DNA, 906 bp, Artificial Sequence
  Description of Artificial Sequence: Synthetic coding sequence
atggtttttacacaagccccagctgaaattatgggccatctgcggataagatccctgctggccaggcagtgtctcgctgagttcctgggggtttttgtccttatgcttttgactcaaggcgctgtggcccaggccgtgacttccggcgagacaaaggggaacttcttcacaatgttccttgccggcagtctggccgtcacgatcgccatctatgttggggggaatgtctccggagcccatcttaatccagcctttagcctggcaatgtgcatcgtggggaggcttccatgggtgaagctccctatctatatcctggtgcagctgctgagcgccttctgcgcttccggcgcgacatatgtgctctaccatgatgccctacagaattacaccgggggcaatttaacagtcactggtccgaaggagacggccagcatcttcgcgacttaccctgccccatatctgtcattaaacaatggattcctcgatcaagtcctcgggactggaatgctcattgttggactgctggctatcctggatagaagaaacaagggtgtacccgccggactcgagccagttgtggtcggcatgctcatcctggctcttggcctatctatgggtgctaactgcggtatccccctcaatccagcccgagacctagggccacgactctttacctacgtggcgggctggggaccagaggtgttcagcgccgggaacgggtggtggtgggtgcccgtcgtcgccccattggtgggcgccactgttggaaccgccacctaccagctgcttgtagccttgcatcatccagaggggcccgagcctgctcaggatctagtgagcgctcagcataaggcctccgaactggaaacccccgcaagcgcgcagatgctggagtgcaagctctag

SEQ ID NO: 24410 - DNA, 795 bp, Artificial Sequence
  Description of Artificial Sequence: Synthetic coding sequence
atggtcttcacccaggccccagccgaaattatgggtcatctaaggattcgtagcctgctggcacgtcagtgtctagctgaattcctgggcgttttcgtgctcatgctactgacccaaggcgctgtggcgcaggcagtcacgtctggggagacaaaggggaatttttttaccatgtttctagctgggagcctggctgtaactattgccatttacgtaggaggcaatgtgtcgggggcccatctgaaccccgctttctccttggccatgtgcattgtagggaggctaccatgggttaagctgcctatttacatcttggtgcagctgctctccgcattttgtgcgagcggtgccacatacgttctttaccatgatgccctgcagaactatacaggcgggaatctcaccgtcaccggtcctaaggagacagcttccatcttcgctacataccccgctccctacctgagcttgaataacggtttcctggatcaggtccttgggaccggcatgctgatcgtgggattgctggcaattctcgaccggagaaacaagggcgttccggccggcctcgagcccgtggttgtggggatgctgatcctagccctgggcctgtctatgggagctaactgcggcatcccattaaaccccgcgcgcgatttgggacccaggctgttcacatatgtcgctggatggggccccgaagtgttcagatgggaaacagattcccccggtgctggtttgcattccccaagttccgccaagggctccgtccctggctcgaccgcactctgcttgtag

SEQ ID NO: 24411 - DNA, 1125 bp, Artificial Sequence
  Description of Artificial Sequence: Synthetic coding sequence
atggcaaaagaacgccgccgggctgtgctggagctgctgcagaggcccggaaacgctagatgtgcagactgcggcgctccagatcccgattgggctagctataccctgggggtttttatttgtctctcatgcagcggcatccatagaaacatacctcaggtgtccaaggtgaaatccgtcagacttgatgcgtgggaggaggcccaggtcgagttcatggcaagtcatggcaatgacgcagctcgtgcacggttcgaaagcaaggttccctctttttattacaggccgacaccctctgactgtcaattgctgagggagcagtggatccgagccaagtatgaacggcaggaattcatttaccccgaaaagcaagaaccctatagtgcaggctaccgagaagggttcttatggaagaggggtcgggataacggccagttcttgagcaggaaattcgtgctcactgaacgagagggggctctgaagtactttaacagaaacgacgcgaaagagccaaaagctgtaatgaaaatagagcatctaaatgccacgttccagccagccaagattggccacccacacggccttcaggtcacatacctcaaagataatagcacacggaatatattcatataccatgaagacgggaaggaaatcgtggattggttcaatgccctcagagccgccagattccactatcttcaagtggctttccctggtgcaggggatgcggacttggtcccaaagctgagccgcaactaccttaaagagggctacatggagaagacaggacccaaacagactgagggattccggaagcgctggttcactatggacgatagacggctaatgtactttaaggaccccctcgacgcctttgctcgcggggaagttttcatagggtctaaggaatcagggtacactgtgctccacgggtttccccctagcactcaggggcaccactggcctcacggaattactattgtcacacctgacagaaagttcttgttcgcttgcgaaaccgaatccgatcagcgggagtgggtcgccgccttccagaaagcagttgatcgtccaatgctgccccaggagtatgccgtggaggcccattttaaacacaagccttag

SEQ ID NO: 24412 - DNA, 909 bp, Artificial Sequence
  Description of Artificial Sequence: Synthetic coding sequence
atggcttcacacggtaacgacgctgcgcgggctcggtttgagtctaaagtcccttcattttattaccggcccaccccctctgactgccagcttctcagagaacagtggatacgcgctaagtacgaaaggcaagagttcatctaccccgaaaaacaggaaccctattctgctggttatagagagggattcctatggaaacgcgggagggacaacgggcaatttctttccagaaagttcgtgctgactgagagagagggggcgttgaaatactttaaccgcaacgacgcaaaggagcctaaagcagttatgaagatcgagcacctgaatgccacattccagccggctaagatcggccacccacacgggctacaggtaacttacctcaaggataatagcaccagaaacatatttatctaccacgaggacggtaaagagattgttgactggtttaatgcattgcgcgcagcccggtttcattatctgcaggtggcttttccaggcgctggcgacgcagacttagttcctaaacttagcaggaattaccttaaggagggctatatggaaaagacaggacctaagcagaccgagggttttaggaaaaggtggttcacgatggacgatcgcaggctcatgtatttcaaggaccccttggacgcctttgccaggggcgaggtgtttattggcagcaaggaaagtggatatacagttttacacggcttccccccctccacccaaggtcatcactggccacatggaattacaatcgtgactcccgatcggaagttcttatttgcttgcgagactgagagtgaccagcgggaatgggtggcagcattccaaaaagccgtggaccgtcctatgttgccacaggagtacgccgtggaagcccatttcaagcacaaaccatag

SEQ ID NO: 24413 - DNA, 603 bp, Artificial Sequence
  Description of Artificial Sequence: Synthetic coding sequence
atgaagatcgagcatctgaacgcgaccttccagcccgctaaaatcggacacccccacggcctgcaagtgacctatctgaaagacaattccacccgaaacatctttatctaccacgaggatggcaaggagatagtagactggtttaatgcccttcgcgccgcaagatttcactacctccaggtcgcattccctggcgccggggatgcggacctggtcccaaaattatccaggaattacctgaaggaaggctatatggaaaagaccggccccaagcagactgagggctttcgcaagcgttggtttactatggacgacagacgcctgatgtactttaaggaccccttggacgcctttgcaaggggggaagtttttattggctctaaagagtcaggttacaccgtactccatggattccccccttctacccaaggacatcactggccacatggaataacgatagtgaccccagatcgtaaatttctgttcgcatgtgagacagagagcgaccaacgggagtgggtcgccgccttccagaaggccgtcgatagaccaatgctcccccaggaatacgcagtggaggcccacttcaaacacaagccctag

SEQ ID NO: 24414 - DNA, 783 bp, Artificial Sequence
  Description of Artificial Sequence: Synthetic coding sequence
atggtgctcgcatcgctggaactactacgagagcagtggattcgtgctaagtacgaaaggcaggagtttatctatcccgaaaagcaagaaccatattcagccgggtacagggagggctttctttggaagagaggtcgtgacaacggccagttcctctctcgcaagtttgtgttgactgaaagggagggagcactcaagtactttaataggaacgacgcaaaaattggccacccgcatgggttacaggtcacgtatctcaaagacaacagcactcggaacatatttatataccacgaggatggaaaggaaatagtggactggtttaacgccctccgagccgccagatttcactacctccaggtggcctttcctggagctggtgatgcggacctggtaccaaaactgtctcggaactatctgaaggagggctatatggagaagactggccctaaacagactgagggattcagaaagcgatggtttactatggacgacaggcgacttatgtactttaaggatccattggacgcgttcgcccgcggagaggtcttcatcgggagcaaagaatctgggtataccgtcctacatggttttccaccctccacacagggccaccactggccccacggaataacaatagtgactcctgatcgcaagtttctgttcgcatgtgaaactgagtctgatcagcgagagtgggtggccgcctttcagaaagccgtcgatcgacctatgttaccacaagagtatgcagtggaggcacattttaagcataagccatag

SEQ ID NO: 24415 - DNA, 1158 bp, Artificial Sequence
  Description of Artificial Sequence: Synthetic coding sequence
atgttccagtttgtttttagccgagtctattgcatcaatccagctaggaggaaatggaaggagttcgagaagatgctggggtgtgccgaagaaggtcatgcgtcattggggcgggaccccgactgggcgagctacacgctcggtgtgtttatttgtctgtcctgctcggggatccaccgaaatatcccacaggtttcaaaggtcaaaagcgtgcgcctcgacgcatgggaggaggctcaggtggaatttatggccagtcatggcaacgatgcagcccgcgccaggttcgagtcaaaagtaccatccttctactacagacccacacctagcgattgccagctcctgcgagagcagtggatcagagccaagtatgaacgccaagagtttatttaccctgagaagcaggaaccttactccgccggctatagagaggggttcctgtggaaaagagggagagacaatggccagttcttgtcgaggaagtttgtgctgactgaaagggagggggcgctgaagtatttcaacaggaacgatgcaaaagaaccaaaagccgttatgaaaatagaacacttgaacgcgaccttccaaccggctaaaatagggcacccccacggacttcaggtgacctacttgaaggacaatagtacacgcaatatcttcatttatcatgaggacggaaaagaaatcgttgattggttcaatgcattgagggctgcacggtttcattacctgcaggttgccttccctggcgccggggacgctgatcttgtgcccaagctctctcgtaactacctgaaggagggatatatggaaaagacaggtccaaaacaaaccgaaggcttcaggaagcggtggtttacaatggatgataggcggctgatgtacttcaaggatcctttggatgcttttgcaagaggagaggtcttcatcggctctaaggagagcggatatactgttttgcacggatttccacctagcactcaggggcaccattggccccatggtataacaattgtgacacctgataggaagttcctgtttgcttgtgagaccgaaagcgaccagcgagagtgggttgccgctttccagaaggccgtagataggcctatgctcccacaggaatacgcagtggaggcccacttcaaacacaagccatag

SEQ ID NO: 24416 - DNA, 1146 bp, Artificial Sequence
  Description of Artificial Sequence: Synthetic coding sequence
atgggggatcgggaaagaaacaaaaagagactgctggagcttctgagagctcccgacactggcaatgcccactgtgcagattgcggcgccgctgacccagactgggcctcctataagcttggcatattcatctgtcttaactgttgcggagtgcatcgcaacttccctgacatcagcagagtgaaatctgtgaggctggatttctgggatgacagtattgtagaattcatgattcacaacggcaatcttcgggtgaaggcaaagttcgaagccagggttcccgccttctattatattccgcaggcaaacgattgtttagtgctgaaggagcagtggattagggcaaaatacgagaggagggagtttatggccgacggggagacaataagcctgcccggaaatagagagggcttcttgtggaagaggggcagggataattcacagttccttagaagaaagttcgttctgttagcacgggaggggctgctgaaatacttcacaaaagaacagggtaagtctcctaaagcagtgattagcatcaaggatttgaatgccacgtttcagactgaaaaaatcggtcaccctcacgggttacagataacgtatagacgtgacgggcacaccaggaacctttttgtttaccacgagtctggcaaggagatcgtggattggtttaacgcgctgagggccgcacggcttcagtaccttaaaatggcctttcctgaactgcccgaatctgagctagtcccctttctgacgcggaattacctaaaacagggcttcatggagaaaaccggcccaaaacagaaagagcccttcaagaagaggtggtttgctttagattgccacgagcgcagactactctactacaaaaaccctttggacgctttcgaacaaggtcaagtatttctgggcaataaagaacaggggtacgaggcttatgaggacctgcctaaaggcatcaggggcaaccgttggaaggcggggctcacgatcgtgaccccggagcgacgcttcgtgctgacctgtcccagtgaaaaagaacaacaggaatggcttgagtctttacgtggcgtcctcagctccccactgacgcctcttaatagactcactgcctcaactgagagtggaagatcttcacgctag

SEQ ID NO: 24417 - DNA, 3021 bp, Artificial Sequence
  Description of Artificial Sequence: Synthetic coding sequence
atgccagaccagatctcagtctctgagttcgtggctgaaacacatgaagactataaagcacccacagcgagcagcttcactactcggaccgcgcagtgtcgcaatactgtggcagccatcgaagaggcactggacgtggatcgaatggtactttacaagatgaaaaaatctgtcaaagccatcaattcgagcggactggctcatgtggagaatgaggagcagtacactcaagccttagaaaaattcgggggaaactgtgtctgtagagacgatcccgatctggggagtgcctttctcaaattcagcgtctttacgaaggaactcacagcgctatttaagaacctgattcaaaatatgaacaatattatttccttccctttggactccctgctgaaaggtgacttaaaaggcgttaagggcgacttaaagaaaccatttgataaggcttggaaggattatgaaacaaaaataacgaaaatcgagaaagagaaaaaggagcatgctaaactccacggcatgatccgcacagagatctccggcgccgaaatagccgaggagatggagaaggagcggagatttttccagttgcagatgtgcgaatacctgctcaaagttaatgaaatcaaaatcaagaaaggggtggacttactccagaatctcattaagtacttccacgcacagtgtaatttttttcaggacggcttgaaggcagtggaatcgctcaagccttccatcgaaactctatctacggatctccacaccataaaacaagcccaggatgaggagaggagacagctgatccagctgcgcgacattctgaaatcggccctccaggtggaacagaaggaggactctcagatacgccaatccacagcttactctttacaccagccgcagggaaacaaagagcatgggaccgaaagaaacggcagcctgtacaagaagtccgacgggatacgtaaagtttggcaaaaacgcaagtgctctgtgaaaaatggtttcttgaccataagtcacggcacagcaaatagaccccccgcaaaactcaatctgctgacctgccaggttaaaactaatcccgaagagaagaagtgcttcgaccttattagtcacgaccgtacatatcattttcaggcagaagatgagcaagagtgtcaaatatggatgtctgtcctgcaaaattccaaggaggaagcactgaacaatgcattcaaaggagatgataacactggggagaataatatagtccaagaactcactaaagagattatcagtgaggtgcagagaatgactggcaacgacgtgtgttgtgattgcggagcccctgatccaacctggctgagtactaacctgggcattttaacatgtatcgaatgttctgggatccaccgcgagctcggggtccattacagccgtatgcaaagtctgacgctcgatgtgctaggaacttctgaactgctgctggccaaaaatatcggaaatgcggggtttaatgagattatggaatgctgcctgcccgccgaagactccgtgaagcccaatccgggcagtgatatgaacgcccgaaaggactatataaccgctaaatacatagagagaagatatgcccggaagaaacacgccgacaatgctgccaaactgcatagtctctgtgaagccgtcaagacacgggacatctttggccttctgcaagcctatgccgacggggtggacttaactgagaagatccccctcgccaacggacacgagccggatgaaactgcactccacctggcagtgagaagcgtggatcgaacctcccttcatatcgttgacttcctggtgcagaactctggaaatctggacaaacaaacagggaaaggttctaccgctctgcactattgctgcttgactgataacgctgaatgcctgaagcttctgctccgaggaaaagcgtcgattgagattgctaatgagtctggcgagactccgctggatatcgccaaaagactgaagcacgagcactgtgaggagctgctgactcaagcgctatctggcaggtttaattcccatgtccacgttgagtacgaatggcggctgcttcatgaggatctggacgaatctgatgatgacatggatgagaagctccagccatccccgaaccgaagagaagatcgccccatctcattctatcagttaggcagcaatcaactgcagtccaacgctgtcagcctggcccgagatgctgccaaccttgcgaaggagaagcagcgcgcctttatgccttccatcctgcagaacgagacctacggtgccctgctatctggatcccccccacctgcccagcctgcagctccatccaccacctccgcgcccccactgccgcctcgcaacgttggcaaggtacagacagcaagttcagccaacactctgtggaagaccaattcagtatcagtagacggtgggtcccgccaaagaagttcatcagaccctcccgctgtacatcccccgctgcctcccctgcgagtgacgtccactaacccccttacaccgacacctcccccacccgtggcaaaaactccctctgtgatggaggcactgtcacagccttccaagccggccccaccaggaatctcacagattaggccacctcccctgccgccacagcccccgagtcgactccctcagaagaagccagcaccaggggctgataaaagcacacctctaacaaataaaggtcaaccacgtggcccagtggacctgtcagctacagaggccttggggcctctgagcaacgccatggtactgcagccacctgccccgatgcccagaaagtctcaggccaccaagctgaaacctaagcgcgtgaaggctttgtataattgcgtcgccgataacccagacgaacttactttctcagagggggatgtcatcatcgtggatggagaggaagaccaagaatggtggattgggcatattgatggcgatcccggacggaaaggagcctttcccgtgtctttcgtacactttatcgctgactag

SEQ ID NO: 24418 - DNA, 2886 bp, Artificial Sequence
  Description of Artificial Sequence: Synthetic coding sequence
atgcctgatcagattagcgtgagcgaatttgtggccgagacacacgaagactataaggctcccaccgcatcttcttttaccaccaggactgcccagtgcaggaacaccgtagcggccatcgaagaggctctcgacgttgaccgcatggttctgtataaaatgaaaaagtctgtcaaggccatcaactcttccggtctggctcatgtcgaaaacgaggaacagtacacgcaggccctggaaaagtttggaggcaattgcgtatgtcgtgatgatcccgatttgggatcagcattcctcaaattctcagtttttacaaaggaactgaccgccctgttcaagaatttgatccagaacatgaacaatataattagctttcccctcgattcactgttgaagggggatctaaagggggtcaaaggggatctgaaaaaacccttcgataaggcctggaaagactacgagaccaagattacgaagatcgagaaggagaaaaaggagcacgcaaaactccacggcatgattcggaccgagatctctggcgccgagattgcagaagaaatggagaaagagaggcggttttttcagctccagatgtgtgagtatcttctaaaagtgaatgaaatcaaaatcaagaaaggcgtagatctgctgcagaacttaattaagtactttcacgctcaatgcaattttttccaggatggactcaaggctgtggaaagtctcaagccctcaatcgaaactttgtccaccgacttacatacgattaagcaggcccaggatgaagagcgtcggcagctgattcaattaagggatattctcaaatctgcacttcaagtggagcagaaggaagacagtcagattcgccagagcaccgcgtactcactgcatcagcctcagggcaacaaggagcatggaaccgaacgtaatggatccctatacaagaaatccgacggaatccgtaaagtttggcagaagaggaaatgttcggtgaagaatggttttctgactatatcacacgggacagccaatcgtcctcccgccaaactgaacctgttaacctgtcaagtgaagacgaaccctgaagaaaagaagtgctttgacttaataagccacgacaggacttaccacttccaggcagaggacgaacaggaatgtcagatctggatgagtgtgctgcagaactccaaggaagaggccctgaataatgccttcaagggggatgataataccggggaaaacaatattgtccaggaactgacaaaggagattatcagcgaggtgcagcggatgactggaaatgacgtgtgttgcgactgtggggcccctgatcctacctggctgagtaccaatctaggcatattaacctgtatagaatgttccgggattcatagggagctaggggtccactactcgcgtatgcagtctctaacactggacgtgctggggacaagcgagctactcctggcaaagaatatcgggaacgctggcttcaacgagatcatggaatgctgcctgccggctgaagactctgttaagcccaacccaggatcggacatgaatgcccgcaaggattacatcacagccaaatacatagagcggcggtatgcgcggaaaaagcatgctgacaacgccgctaaactgcatagcctctgtgaagcagttaaaacccgtgacatttttggacttctccaagcctacgctgatggtgtggatctgaccgagaagataccgctagcaaatggtcatgaacctgacgaaacagctttgcatctggcggtccggtctgtggatcggacttcacttcacattgtggattttcttgtgcagaacagcggtaacctggataaacagactggaaagggcagcaccgccctgcactactgttgcctcaccgacaacgccgagtgtctgaaattgttgcttcgggggaaggcatccattgaaatcgctaatgagtccggggagacccctctagacattgccaagcggctgaaacacgagcattgtgaggaactgctgacccaggccctcagcggaagattcaactctcacgtgcatgtggaatacgaatggcgcctcttacacgaagacttagacgagagcgacgatgatatggatgagaaactgcagccttccccgaaccgtcgggaggacaggcccattagcttctaccagctgggatcgaaccagttgcagtctaacgcggtgtcccttgcaagggacgccgccaacctggcaaaggaaaaacagcgcgccttcatgccgtctattctgcagaacgaaacctacggggccctgctatccggaagtcctcctcccgcccagccggctgccccttctaccaccagcgctcctccactccctccaagaaacgtaggcaaagatccacttacccccactcctcccccaccagtcgccaaaacccccagcgttatggaagctctctcacagccttccaaacccgccccccccggcattagccagattcgtcccccccctcttcccccccaacctccttcccgtctcccccagaagaaacccgcacccggggccgataagtctacccctcttactaataagggacagccacgtggcccagtcgatttgtcagctactgaggccctcggtccattgtcaaacgccatggtgctgcagccccctgcccccatgccccgcaagtcccaggctacaaagctgaagcctaagcgtgtgaaagccctctacaactgtgtggccgataacccggatgagctgactttctctgaaggcgatgttatcatcgtggacggggaagaggaccaggagtggtggattggtcacattgacggggatcccggtagaaagggagccttccctgtcagcttcgtccatttcatagcggactag

SEQ ID NO: 24419 - DNA, 849 bp, Artificial Sequence
  Description of Artificial Sequence: Synthetic coding sequence
atgaattctagcaccagtaccatgagtgaggagccggacgctctgagcgtggtcaaccagctgagggatctcgcggccgatccactgaataggcgagctatcgttcaggatcagggatgtctgcccggactcatcttgtttatggaccaccccaatccaccagtcgttcattccgccctgctagcactaaggtatttggctgagtgcagggctaaccgggaaaaaatgaagggcgaactagggatgatgctgagcttgcagaacgttatacagaagaccacaacacccggagagacaaaacttctggccagtgagatttatgatatactccagagctcaaacatggccgacggcgactccttcaatgaaatgaacagtagaagacggaaggcccaattcttcctcggaaccactaataaacgagcaaaaacggtcgtgctgcacatcgacggcctagatgacacaagtagaagaaacctctgtgaggaggcactgttgaagataaaaggagtcataagtttcactttccaaatggcggtccagaggtgtgtcgtgaggatccggtctgaccttaaagccgaggccctggcaagcgccatcgcaagcaccaaggttatgaaagctcagcaggtagtaaaaagcgagagcggggaagaaatgctcgtgcctttccaggacactcctgtggaggtcgagcagaacacagagctgcctgactacctgcctgaggacgagtcgccaaccaaagaacaggataaggcggtgagtagggtgggttcacaccctgagggcggagctagctggctatctactgccgcgaatttcctgagtcggagcttctattggtag

SEQ ID NO: 24420 - DNA, 543 bp, Artificial Sequence
  Description of Artificial Sequence: Synthetic coding sequence
atgagcgcctggccctactttatttacggccctagtcaacccagtagtagaccgttgcgctttgcctgctcctctattctggggaggatgccatgcaaacaaaggaaggatgagaggcgcaccggatacgacgtcgaacttaccaaatgttataccgaatcgcgtcgcaatctctgtgaagaggccctattaaaaattaagggggtcatctctttcactttccagatggctgtccagcgatgtgtagtgaggattaggagcgatctcaaagctgaagcactcgcctccgccattgcatccacaaaggtgatgaaggctcagcaggttgtgaaatccgaaagcggggaagagatgttggtcccatttcaggacacaccggtggaggtggaacagaatacagagctgccagattatttgcctgaggacgagtctccgaccaaagagcaggataaagccgtttcacgtgttggaagtcatccagagggaggggcaagctggcttagtaccgccgcgaattttctgagcaggtccttctattggtag

SEQ ID NO: 24421 - DNA, 6873 bp, Artificial Sequence
  Description of Artificial Sequence: Synthetic coding sequence
atgggcaggattcaggaggtgggctgggtgaccgccggcttagtgatctgggccggaacatgctattatatctacaagtttaccaagggacgggcccaatcagtccgtactttggcccgcaacgggtcaacggtgaaaatggaaactgtcgtcggtgtccaatcccaaaccctggcgatcaacgaagcggaaatcaagactaagccacaagtcgagattggagcggaaaccggagctagatcaggaccccgggctgaggtggagacaaaggccacagctatcgccatccaccgtgccaacagtcaggccaaagccatggtaggggccgagcccgaaacacagagcgagtcaaaagtggtcgcaggcacgttggtcatgaccgaagcggtgacactgaccgaggtgaaagccaaggctagagaagtggccatgaaggaggccgtcacacaaaccgatgccgaggctggcaaaatcgttaaaaaagaggccgtgactcagaccaaggctaaagcttgggccctggtggccaagaccgaagcgaagcgtgaggctatgactcaaaccaaggcggaaacacacatccttgctgagaaagagactgagatcaacagggtgatggtgacccagagcgaaaccttagccgtcccaagagaggttgccaaaatgggcgctactaacaagaccggaattgttgacgaaaccaaaacccgagctctggaagaaactgtatccgttgccaagactcagagcgaggcccgacctggcgctacagtcgatgccaggggcaaccctaacgggatgtcgcgggaggtggcgggcgttgatatgaagtcatgtgctcaaagccaggccgtgaccaaaatccagggcgacgatatgcctgggaccggggtcgaagatatgggcaattgtaagaccatgtcaagagcagagtccggggcggatactcgggcctctgcacaaccacaaatattcgcaaaaacccagaccgaagctatccctggtgcgaagattgatgcaggtggaaacacaaacgccatgtgtaaggtgggcgcgggcgcagacgttagagcttgtattcagccgcagaccgtcgctaaaaagcaggctgaggtcacctcaggggccagggtcgacggacgcggcaatacaaacgtaatctccaaagcgatcaccggggccgacatgcgtgctgcggcccagccacaggctgtcgccagtactcacgcggaggcaatgtctgatgccaaggtgaaaaatcgaggaaaccccaacgccatgaccaaggctggggccaaggcgaatttaagagccaactcccaggtcgaggcattacctgacgctagagacaagtcaagggggaaccccaacgttatggctaaggtgggcgatggtactgacatgctgtcctgtactcaaccccagttggttgcctccgttcaagctgatactctgagcgatgggaagataaaggtgcgcgggaatgtgaatactatgccgaaagagggcgctggtgtggatatgaaagctcaaggcatggcgcagtcccaaggtgaagctcttcctaatactcgggggaaggcgcgggggaaggccaaggccaagtgtaaaaccggtccggggatggacatgaagacttgtactcagccacaggcaggggtgaagactcctgcagaggccctgctcgactcccgagttgatggtcggggcaatcccaacgcaactagcaaagccgggacgaaagccgatcaaagggtgtgcggtcaacccttagtggtcgcaaacccacaaggtgaagctctacccggggccaaaaataaggtgaagggcaacccccacacagtgttaaaagtgggagccggagaggggactactgactcggcccagcccgaagcagttgtttcttttcagggcgaggcacttctgggcactaagaataaggttaagggcaatccaaatgtagtgctgaaagctgaggtgggggagggggctatggggactgcccagcttcaaattatggcttcatctaaaggagaggccctgctggactcaaaaaacaaggtcaaggggaacagtaacgccgtgtctaaggctggggccgggacagatacaaccgggtccgtgcagcctcagatcgtggctaactctcagggtgaggttctgcccggcgctaaaaacaaaatacgcggaaatccaaccaccgtgcccaacagcggtgttggtccatatacgacggattcagcacgcctgcaggcagtagctaattctcagggagaggttcttccaggcgctaaaaataaggtgaaggcaaatctcaacgctgtgtccaaagcggaagcaggcatgggtgctaccggcagtgtacagccccaggctgtggccaacagtcactgtgagaccctccctggggctaaaaacaaagtcaggggcaactggaatgcagtctcgaaagcgggtgctggcatggacacacggggcagcgcccaacctcaagccgtggcgaacagtcagggcgaggtgctgcctggagcaaagaacaaagttaagggtaatccaaacgttgtgagtaaggccggcgcccgcgaggacacagtggggtctacacagccacaggtgctggcatcttcccagagagaaaccttaccgggcgcgagaaacaaagtaaagggcaactctaacgtggtctctaaagcaggggcccgagaagatactatgggtagcgctcagccccaggtggtggccaactcccagcgtgaaaccctacccggtgccagaaataaagtaaagggcaacagcaacgccatttccaaggccgaagccggagcgggcatcatgggtagcgtgcaggttcaagtcgtcgcatctttccagggggaggtcctgcccggagcaaagaacaaggtcagggggaattctaacgctgtgcccaaagctgaagccggggccgataccgtcggatcggcacaaccgcaggcggttgcaaatagtcagagcgagacccttcttggcgcgcggaacaaagttaagggtaacacgatcgcagtgccaaaggctgggacaggcgctggcacgcgccattctgcccaaccccagattgtggccgggagtcagggcgagactctgccgggcgcccgggacaaaagcatgagtaccagcgaggcagaggctaccgccgaagacgaggcctatgctaaacccgaggccgaggccatgccaacaagcgaatctgaaggagggtccgggacccaggcttgtagaaaaacccagcctaacatccacgactactattggaatggtatcggcgtcgaggactggatagccgccgaaaggtggattaaattcaggttccaaaccatggacggcgattgggaaaatagcgtgagttgggcagatgacgaaaatgaggcgtcaatcggatcctggagtggcgctagcgataaagccggtatcatacgctcttgggccgtggcttgtgatgagacctctgtgaagtcctgggcaggcgctcgggcggagaatgtggtaggtattggcacatgggctcgggccggggaacaggcatcaggaggtctctgggcggggggtcagactagcgaaggaacttgggctggtgacaaagctagcggaggtgcttggactggcgccgagaatcaggcatccgggggaagttgggccttggcgggtaatcaagccattggagaactctgggcagcagggcaggccagtgatggcagttggccggggggccaagccagtggagtgtcatgggtcggggaggaggccataggaggtagctggactggcgccgaaaatcaggcctccgaagggtcctgggccggtgcaggagctggaaacatgtcaagtgtgtcctactgggccggagtggtggaccaggcaggcggtggaagttgggctggcacctctgatcagtccggaggaggttctaaaccacgttttgaggaccaggcttccggagaagggagctgggccggcgccggtggacaggcctccggcggctctatgctgggtccggaagatcagtcctcgggccggagctgggcagacacagccgatcaggctagcggaggctctcgattaggacacgtcgatcagtcaagtgggggcgcgtgggctgggacccttgaccagagtggtggagggtctaaacccaggtttgaaaaccagactacagaggaaggttcatgggccggcgccggaggccaggccggagggggcagcaaagtcgggcctgaggaccaatctagcggccgctcctgggcaaatagcggtgaccagatctcaggcggtttcctggtgggaattgtggaccaagccaatggcggctcatggactggcgccgggcacccagcaagtgtggggcctaaaccaattttcgaagatcaggtaagcggtcggggatcatgggcggacgcccgagagcaggttgtcggcgattcaagactcgggctgcgggaccagagtagcggcgattcctgggccgacaccggtgatcaagcctccggctggttttgtgtgtgtcctggtagtcagacaaacggcggcagctggggcggcgcaagtggccaggatgtgggaggatctcgacctgggcccactaaccagagcagcgccggctcttgggactcccccgggtcacaagttagcggcagctgttggaccggcgcgggcgccgttgatcaagccggcggctgttccaagccgggattcgaagaccaggccataggaggtgggttctggcccggggccggggatcagactggtgggggcagtaggccagggtccgaagaccagagctcaggaatcgggtcctggggagtggctggtggacaggtgttgggcggcgcccgtcctggacctgcggaccagtcctccggcggctcttgggcaggaaccgggaaccagtccagcggccgaagctggatcggtccaggcgaccaggccgtcgactgcagcaagccagaatttgaggaccaagcttgtgggggcggaagctgggccggggcaggtagccaggccagcggcgagtcctgggctggcagtcggcccgggaatgaagcaattggtggcagtcgaatgggctcggaagatcaggctacaggtggttcctgggcccggtctgaagaccaggccagtggtcgtttccaagtgtcttttgaagtggaggccaacgagggattctggttcggcccaggagcagaggctgttatcggttcttggtgttggaccgaggagaaagccgacattgttagtcgtcccgacgacaaggatgaggcaaccactgcgtctcggagcggagcaggagaggaagccatgatatgttctcgtattgaggccgagaataaggccagctccgggtcctggatacgctctgaggaagtggcatacatgggctcatgtgtcggagccgaagccggggcgggagcggaagctggagctggcgcggaagccggcgcaggggccggggcagaggctggcgctgaggctggagcaggggccggtgcgggccccggcacagagagcggcgcagggatttggtcgtgggacggtgatgccacaaccgtggaatccagactcggggctggagaggaggccggggtggagagttggaccctggcccgcaacgtgggagaggacgaactaagcagagagagcagccccgacattgaagagataagccttcggtctttgttctgggccgaatccgaaaactccaatacctttcgtagtaaatcaggaaaggatgccagttttgaatccggagccggcgacaacacctccatcaaagataaatttgaggctgccgggggcgtcgatattggtagctggttttgcgctggaaacgagaatacctctgaggataaatctgctccgaaggcaaaggccaaaaagagttcggaaagccgcggcatttacccctacatggtccctggagccggcatggggtcttgggacggcgcaatgatttggagtgaaaccaagttcgcgcaccagagtgaagcaagctttcctgtggaggatgaatccagaaaacagactcgtacaggggagaaaactcgcccctggagttgtaggtgcaagcatgaggctaatatggaccctcgcgatttggaaaagcttatttgcatgatcgaaatgacagaagacccgtcagtgcacgagatcgctaacaatgccctatataatagtgctgattattcttattcacacgaggtggttcgaaatgtcgggggaatctccgtaatcgaatcactgctcaacaacccctatccctcagtgagacaaaaggcgctgaatgccctcaataacattagcgtggccgccgagaatcacagaaaggtgaagacctaccttaaccaggtgtgcgaggataccgtgacttacccgctcaacagcaatgtccagcttgccgggctccgactcattcggcatctgacaatcacctccgagtatcagcatatggtgacaaattacatttctgagttcctacgactgttgaccgtggggagcggtgagacaaaggatcacgtgttgggaatgttacttaatttttctaaaaacccatcaatgactaaggacctgctgatcgctaatgccccaacgtcactgatcaacattttttcgaagaaggagactaaggagaacattttaaacgcactgtctctgttcgagaatattaactatcacttcaaaaggcgggcaaaagcgttcacccaggacaagttttccaagaacagtctgtattttctgttccagcgtcccaaagcctgtgcaaagaagttgcgagctttggccgcggagtgcaacgaccccgaggttaaggagcgcgtcgaactcctgatcagcaaactgtag

SEQ ID NO: 24422 - DNA, 1083 bp, Artificial Sequence
  Description of Artificial Sequence: Synthetic coding sequence
atgagcgccgccggcctgaaaataaccggctccaaagagacaaagcggaggctgctgctgatttcaatcgattggagtcgagaccttatgaatttatgtatctatttccgggtctactgtcaggaaaagcaggaggagagacgggagctacctcgtatcatcactggcccccctcctgaagctgcagtagtggcttttgaatggctgaagacaagcacgctcacgggcctgcacccccaattacctctgagccttccccaacctgagtgcgccctcccttatcttgtaagggccttttcgcggggtgactacatgggtcggatccaggaggtcggctgggtaactgctggactggtgatatgggccgggacctgctattatatttacaagtttacaaaagggagggcacagtccgtgagaacgctggctaggaacgggtccaccgtgaaaatggagactgtggtcggcgtacaatcccagactttggctatcaatgaggctgagataaaaacaaagcctcaggttgagattggcgctgagaccggagcccggagcggtcctcgcgccgaagtcgagacaaaggctaccgcaatcgcaattcatagagccaacagtcaggccaaggcaatggtgggcgcggaaccagagacccagtcggagtccaaagtagttgctggaactctggtgatgacagaagccgtgaccctgactgaagtcaaggccaaagctcgcgaggttgctatgaaagaagcagtcacacagacggatgcggaagcaggcaaaatcgtgaaaaaagaggccgtgactcagactaaggctaaagcctgggccctggtggcgaagacagaagccaaacgggaggctatgactcagaccaaggcggaaacgcatatactggctgagaaagagactgagattaatagggtgatggttacccagagcgaaacgctggctgtgccccgcgaggtggcgaaaatgggtgccaccaataaaaccggcattgttgatgaaactaagacccgcgccttggaggagacggtactgatcccccgggcctttcccagtaagaatgcttcctgctag

SEQ ID NO: 24423 - DNA, 1083 bp, Artificial Sequence
  Description of Artificial Sequence: Synthetic coding sequence
atgtccgccgcgggcttgaagatcaccggctctaaggaaaccaagcgcagactgctcttgatatctatcgattggtcgcgcgaccttatgaatctgtgcatttattttcgagtctattgtcaggaaaaacaagaggagcgtagggagttgcccaggatcattactggcccccctcccgaggcagctgtcgtggctttcgagtggctaaagacctccaccttgacgggtttgcacccgcagttgcctctgtcactgccacaacccgaatgcgctttgccctacctcgtccgggcatttagccgcggggactatatgggtcggatacaggaagtcggttgggtaacggccggactggttatttgggctgggacatgctactacatatacaagttcactaaggggagagcccagtctgtacgaaccctggccaggaacggcagcaccgttaagatggaaaccgtggttggggttcagagtcagaccctggccattaacgaggcagagattaagacaaaaccccaggttgaaatcggcgccgaaacaggcgccagaagtggcccacgcgcggaggtggagactaaggccacggcaattgccatccacagagccaattcacaggccaaggctatggttggcgccgagcccgagacccagagtgagtctaaagtagttgcagggacccttgttatgaccgaggccgttacattgacagaagtcaaagcaaaagctagggaggtggcaatgaaggaagcagtgactcagactgacgcagaggccggtaagatcgtgaagaaggaggccgtgacacagaccaaagccaaagcatgggcactagttgccaaaactgaggcgaagagggaggccatgacacagactaaggccgagactcatattctggcagaaaaggaaactgagattaacagagtgatggtgactcagtcagagacattggcagtgcccagggaggtcgccaagatgggggcgaccaacaaaacaggaatcgtagacgagaccaaaacacgggctctggaggagacggtcctaatcccccgcgcctttcctagcaagaatgcatcctgttag

SEQ ID NO: 24424 - DNA, 903 bp, Artificial Sequence
  Description of Artificial Sequence: Synthetic coding sequence
atgggtagagcaagggaggttgggtggatggccgccggattaatgataggcgccggtgcctgttattgcgtctataagttgactattggaagagatgattccgagaaactcgaggaggagggggaagaagagtgggacgacgatcaagaactagatgaagaggagcctgacatctggtttgattttgaaaccatggccaggccctggacggaagatggcgattggactgaacctggtgctcctggaggcaccgaagacagacctagtggtggaggcaaagcgaacagggcccaccctattaagcagcggccgttcccctacgagcataagaacacctggtccgcacagaactgtaaaaatggatcgtgtgtgctagatctgtccaaatgcctgttcattcagggtaagttactgtttgccgaacctaaagacgctggttttccattttcacaagacatcaattctcacttagcaagcctgtccatggctcgaaacacatcacccacgcctgacccaactgtgcgagaggccttatgcgctccagacaatttaaatgcttccatcgagtctcagggccagatcaagatgtatataaatgaagtatgtagagaaacagtgagcaggtgctgcaatagctttctccagcaggccggcctgaacctcctgattagtatgacggtcataaataatatgctggccaaatctgcatccgacctcaagttccctctcattagcgagggatctggttgcgctaaagtccaggttctcaagccacttatgggtctgtcagaaaaacctgtgctggctggagaattggttggagcacagatgctgttttcattcatgagtctcttcataaggaacggcaatagagagatattgcttgagactcctgccccttag

SEQ ID NO: 24425 - DNA, 903 bp, Artificial Sequence
  Description of Artificial Sequence: Synthetic coding sequence
atgggtcgcgcaagagaagttggctggatggccgccggtctgatgattggcgctggggcctgctactgtgtgtacaaattaaccattggacgggatgatagcgaaaagttagaagaggagggcgaggaagagtgggatgatgatcaagagctcgacgaagaagaacctgatatctggttcgacttcgaaactatggccagaccatggacagaagacggtgactggactgaacctggcgccccgggtgggaccgaagacagaccgagcggggggggcaaagccaaccgggcccaccctataaagcagagacccttcccatatgagcataagaatacatggtccgctcagaactgtaaaaatggctcctgcgtgctcgacttatcaaaatgtctctttatacaggggaagctcctgtttgccgagcccaaggatgcggggtttccattctcacaagacataaacagccacctcgctagtctatccatggcgaggaatacttcccctacccctgatcctaccgtgcgggaagctctttgcgctcccgacaacttaaacgcatccattgagtctcagggccagattaaaatgtacattaacgaggtgtgtcgtgagacggtgtcgcgctgctgtaattcatttctacaacaggcggggcttaatttgctcatctcaatgacagtcatcaacaatatgctggccaagagtgcctctgacctcaagttccctcttatatctgaggggtctgggtgcgccaaggttcaggtactgaagccgctcatgggcctatcagagaagcccgttctggccggcgagctggtcggggctcagatgctgttcagcttcatgagtttatttattcggaacgggaacagggaaatcctgctagagactcctgccccgtag

SEQ ID NO: 24426 - DNA, 903 bp, Artificial Sequence
  Description of Artificial Sequence: Synthetic coding sequence
atgggccgggctcgggaagtaggatggatggccgccggactgatgattggcgcaggtgcctgttactgcgtgtacaagttaactatcgggagagacgactcagaaaagctcgaggaggaaggcgaggaggagtgggacgacgatcaggaactggacgaggaggaaccagatatatggttcgatttcgagaccatggctcggccttggactgaggatggagactggacggagccaggggcgccgggcgggaccgaagaccggcctagtggcggtggcaaagccaacagagctcatcctatcaaacagagaccctttccctacgaacacaaaaacacgtggtccgctcagaactgcaaaaatggttcctgtgtccttgacctgtccaaatgcctcttcatccagggaaaattattgtttgccgagcccaaggacgccgggttccccttttcacaggatattaacagccacttagcatctttgagcatggctcgaaatactagccctacccccgaccctacggtccgagaagctctctgcgctcctgataatctgaacgcctctattgaatcccagggccagataaaaatgtacatcaacgaagtatgccgcgagaccgtaagcagatgctgcaactcttttctgcagcaggccgggctcaatctcctaatctccatgactgtgatcaataacatgctggccaaatccgcatcagatctcaagtttcctctcatctctgaagggtccggttgcgccaaagttcaggttctcaagccactcatggggctttccgagaaacctgtgctggccggcgagttggtgggggcgcagatgctcttcagttttatgagtctattcatccggaacgggaacagggagattctcttggaaacaccagctccatag

SEQ ID NO: 24427 - DNA, 1302 bp, Artificial Sequence
  Description of Artificial Sequence: Synthetic coding sequence
atgggaagagtgcagctctttgagatttctctcagccacggcagagtcgtctacagtcccggcgaacctctggccgggacggtccgcgtacgtcttggcgctcctcttccctttcgcgccattcgcgtgacttgcatcggcagctgtggagtgtcgaataaagcaaacgatactgcctgggtggtggaggaaggttactttaattcgagcctaagtttggccgataagggatcactgcctgccggagagcattccttcccttttcagttccttctgccagctacggcccctacctccttcgaagggccttttggaaagattgttcatcaggtgcgagctgcaattcatactccacgcttttcaaaggaccacaagtgctctttggtcttctacattctgtccccgctcaatctcaacagcattccggacatcgaacaacccaacgtggctagtgctactaaaaagttctcctataagctggtgaagactggatctgtagtgctgactgccagcactgatctgaggggctatgtagttggtcaggccctccaactgcatgctgatgttgaaaaccagtccggaaaggacacttctccagttgtcgcaagcttgctgcagaaagtgtcctataaggccaaaagatggatccatgatgttcgcaccatcgccgaagtagagggcgccggcgtgaaggcatggagacgggcacagtggcatgaacagattctggttcctgctctgcctcaatcagctttaccaggatgcagcttgattcacatcgactactacctgcaggtgagtctcaaagcccccgaagcgacggtaaccctcccagtctttattggtaatatagccgtgaatcacgctccagtgtcccctcggcctgggctggggcttccaccaggggctccccctctcgttgtgccatctgccccgccccaggaggaagctgaagccgaggccgcggccggcggaccgcatttcttggatccagtgtttctgagcacgaaatcccacagccagcgccaaccgctcctggccacgttaagcagcgtgcctggtgcacccgagccctgccctcaggacggatcccccgcctctcaccccctacacccacccctgtgcatttccacaggcgccacagtgccttatttcgccgaaggatcaggaggtccagtccccacaacaagcactctgattcttcctcccgaatatagtagctggggatatccttacgaggcgcctccatcatacgaacaaagctgtgggggcgttgaaccctcactgacccccgagagttag

SEQ ID NO: 24428 - DNA, 816 bp, Artificial Sequence
  Description of Artificial Sequence: Synthetic coding sequence
atgggaagagtacagcttttcgagatctctctgtcacacggacgggtggtgtattctcccggggagcctttggccggaacggtgagagtccggttaggggccccgctgcccttcagagctatcagggtcacatgcataggctcctgtggggtgtccaataaggctaatgacaccgcgtgggttgtggaggagggatactttaactcttccttgtccctggcggacaaaggatccctacctgcaggcgagcactcatttccctttcagttcttactcccagcaactgcacctacctcctttgagggtccctttggtaagatcgtacaccaggtgcgggccgctattcacacgcctcgtttttccaaagaccataagtgcagtctcgtcttttatattctctcaccgctcaacttgaattctatcccagacatcgaagcactgcagcttcacgccgacgttgaaaaccagtccgggaaagacacaagcccggtggttgcctccctcctacagaaggtcagctataaggccaagagatggattcacgacgtccgcactattgccgaggttgaaggcgctggggttaaggcttggcgccgggcacaatggcacgagcagatcttggtacccgctcttcctcagagtgcactgcctggttgcagcctgatacacatcgactactacctacaagtgtccctgaaagccccggaggccacagttacacttcctgtctttataggcaatatcgctgtcaaccatgccccagtgagtccaagacccgggctggggctaccacccggggccccaccccttgtgtag

SEQ ID NO: 24429 - DNA, 534 bp, Artificial Sequence
  Description of Artificial Sequence: Synthetic coding sequence
atgggccgagttcagctttttgagatcagcctctctcacgggagggtagtatatagtccaggggaaccactggcgggcaccgtccgagtgaggttgggcgcccccctgccattcagagccataagggttacctgtattggcagctgcggggttagcaacaaggctaacgataccgcctgggtggtggaggaggggtatttcaattcgtcattgagcctcgccgacaagggaagtctgccggccggggagcactcttttccttttcagttccttctgcccgccactgctcctacatccttcgaaggcccctttggaaaaatcgtacatcaagtaagagccgccattcataccccacgctttagcaaagatcataagtgttcgcttgtcttctatatcttgtctcccttaaacctgaatagtattcccgacattgagggctcttcattgcgcacccccgctaagccgctgccaggccccccacccaagcagccaaacgtggcaagcgctaccaagaaattcagttacaaattatag

SEQ ID NO: 24430 - DNA, 1224 bp, Artificial Sequence
  Description of Artificial Sequence: Synthetic coding sequence
atggccgtaccatggctggtcctgctgcttgcactccccattttttttcttggcgtcttcgtgtgggctgtgtttgaacacttccttaccacggacataccggcgacactccagcaccccgccaaactgaggtttctacactgtatatttctgtatctggtgacattgggaaacatctttgagaaacttggaatttgcagcatgccaaaatttattaggttcctgcatgacagcgtccggattaagaaagatcccgagttagtcgtgacagaccttcgtttcggtaccattccggtacgtttgtttcaaccgaaagctgcgtcctcaaggcctcggaggggcattatattctatcacggcggggccactgtctttggaagtctggactgttaccacggcctctgtaattatctagctcgcgaaaccgaatccgtgctgttgatgataggatatcgcaagttgcccgaccaccatagtccagccctgttccaagactgcatgaatgcgtccatccacttccttaaggcgttggagacatacggcgtggacccttctcgcgtcgtggtgtgtggcgagtcagtcggaggcgctgcggtggcagcgattacacaagccctcgttgggcggagtgatctgcctcgaataagagcccaggtgctgatctatccagttgttcaggccttttgcctgcagcttccttcctttcagcagaaccagaacgtgccgctgctgagccgaaaattcatggtcaccagcttatgtaactaccttgcgatcgacctttcttggcgagacgcgatccttaatggcacttgcgtgccccctgacgtgtggcgcaaatacgaaaagtggctttcaccagataatatccctaaaaaattcaagaatcgcggctatcagccgtggagtccaggcccgttcaacgaggctgcgtatctcgaagccaaacacatgctcgacgtggagaatagtcctcttatcgcggacgatgaagtcatcgctcagcttcccgaagcctttctcgttagttgcgaaaacgacattctgagggatgattccctcctatataaaaagaggttggaggatcagggcgtgagagtgacgtggtaccacctatatgacgggtttcatgggagtatcattttcttcgacaagaaagccttgagctttccttgcagcctcaagattgtgaatgccgtagtgtcctacatcaagggaatctag

SEQ ID NO: 24431 - DNA, 8910 bp, Artificial Sequence
  Description of Artificial Sequence: Synthetic coding sequence
atggacccaagaaatactgcgatgctaggcctgggaagtgattccgaaggttttagtcggaagtcgccatcagctatctccaccggtactctggtctcaaagcgggaggtggaactggagaagaataccaaagaagaggaagacttgagaaaacgtaaccgtgagaggaacatcgaggctggaaaagacgatggtctgacagacgcgcagcagcagtttagtgtcaaggagactaacttcagcgaggggaatctcaaactaaagattgggttacaggccaaacgaaccaagaagccgcctaaaaacctggagaactacgtgtgccggcctgcaatcaagacgaccattaagcatcctaggaaagcccttaaaagtggcaaaatgacagatgaaaagaatgagcattgtccttctaagagggatccatcaaagctctacaaaaaggcagacgatgtagccgccattgagtgccagtccgaagaagtaatcaggctgcacagccagggggaaaataatccccttagtaagaagctgagtccagtgcattccgagatggcggattacattaacgccacaccatccacccttctaggtagccgggatccggaccttaaagatcgggctctcctgaacggcggcacaagcgtgactgagaaattggcccaactgatcgcgacctgtccaccaagcaagtcatccaagaccaaaccaaagaaactcggcaccggcaccaccgccgggctggtaagtaaagacctgatcagaaaagccggcgtaggctcagtcgccggaatcattcataaggacctcataaagaagcctactatctccactgctgtgggactggtcactaaagaccctggcaaaaagccagtgttcaatgccgcggtgggcttggtgaacaaggacagcgttaaaaaactcggaaccggaactactgcagtgtttatcaacaaaaacctcggcaagaagccggggactatcactactgttggattgctttcaaaggacagcggaaagaagttggggattgggattgtacctggcctcgttcacaaagaatccggaaagaagctgggattgggcacagtcgttggcctcgtcaacaaggacctgggcaagaagttaggatccactgtgggcctggtggcgaaggattgcgccaaaaagatcgtggcttccagtgctatggggctggttaacaaagatatcgggaaaaagctgatgagttgccctttagccggattaatttcaaaagatgctattaatctaaaagcagaagccctcctcccgacccaggagccgctgaaggcaagttgctccacgaacattaacaaccaagagtcccaagagcttagcgagtctctgaaagacagcgcgacaagcaaaaccttcgagaagaatgtggtgagacaaaacaaggaatctatcctagagaagttcagtgtgcgaaaggaaataatcaatctggagaaagagatgtttaacgaaggcacttgcatccaacaggattctttctcttctagcgagaaaggatcttacgaaacaagcaaacatgaaaagcagcctccagtgtactgcacatccccagacttcaagatggggggcgccagtgatgtgtctacagctaaatcgccctttagcgcggtcggggagtccaaccttccctccccgagcccgaccgtttctgtgaaccctctgacccgaagcccaccggagactagctctcaactggcaccaaacccactgttgctctcgtcaacaacagagctgatcgaggaaatttcagaatccgtgggcaagaaccaatttaccagtgaatctacacacctcaatgtcggtcacagatccgttggccatagcatcagtatcgagtgcaagggcatcgacaaggaagtgaatgactctaaaaccactcatatcgatatccccagaatttctagtagcctcggcaagaaacccagcctgacctctgaatcctcgatacatactatcaccccctctgtggtgaacttcacctccctgttcagcaacaagccattcttaaagctgggagctgtgagcgcgtcagacaaacattgtcaggtggctgagagcctgtccacctctcttcagtccaaacccctgaaaaaaagaaagggtcgaaagccccgctggacaaaagtggtagccaggtccacctgccgtagccctaaggggctcgagcttgagagatcagagctgtttaagaatgtttcatgcagtagcctcagtaatagtaactctgagcctgcgaagtttatgaagaacatagggcccccatccttcgttgaccacgatttcttaaaaaggagactccctaagctctcaaaaagcaccgccccaagtttagctcttctggcggatagcgagaaaccgagccataagtctttcgcaacacataaactttcgtcttcaatgtgtgtgtcttctgatctgctgtctgatatatacaaacccaagagagggcgccctaaatccaaagagatgccacaacttgaaggcccccccaagcgcacactgaagattccggcttcaaaggtgttcagcctgcagtctaaggaagaacaagagccaccaatactgcaacccgagattgagatacccagtttcaaacagggcctcagcgtatctccattcccgaaaaaacgcggccgacctaaacgccagatgagaagcccggtcaaaatgaaaccccccgtgttgagcgtcgcaccatttgtagccaccgagtcccccagcaaacttgaatccgaatctgacaaccaccgcagttctagtgattttttcgaatcagaagatcaactgcaggaccctgacgacctggatgactctcatagacctagcgtttgctccatgtcggatctggagatggagcccgacaagaagataactaagagaaacaacggtcaactgatgaagactattattagaaagattaataagatgaagacattaaagcgaaagaagctgctcaatcagattttgtcctcctcggtggagtccagtaacaaaggcaaagttcagtccaaactgcataatactgtcagctctctggcagctacctttggctctaagctggggcagcagatcaatgtaagcaaaaaaggcaccatttacattggcaagcggaggggccgcaaacccaaaaccgtgctgaacggaatactgtcaggcagtcctacaagtttggcagtgctcgagcagacagcgcagcaggcggccggctccgcactgggccagatcctccccccacttctccctagttcggcgagtagctccgagattttgccgagtccaatttgcagccagagctcagggactagtggtggacaatcaccggtctcttccgacgccggcttcgtagagccttcatccgtgccatacctgcacctccactcccggcaggggtccatgatccagactttggccatgaagaaggcttcaaaagggcggcgcagactaagcccacctaccttattgccgaattctcccagtcatctgtctgaacttacttccttgaaagaagccacaccctccccgatttcagagtcccacagtgatgagacaatcccttccgacagtggaattgggaccgacaataacagtacttccgatcgcgcagagaaattctgcggtcagaagaaaagacgtcactcgttcgagcacgtctccctgattccacctgagactagcaccgtattgagttctctgaaggagaagcataagcataagtgtaagaggcgcaaccacgattatctttcatatgacaagatgaagcgccagaagagaaagagaaaaaagaaataccctcagctcagaaatcgacaagatccagactttattgctgagctggaggaactcattagccggctctccgaaatccgcattacacatcgcagtcatcacttcattccccgtgatcttctgccaactatattccgaatcaatttcaatagcttttacacgcatccctcttttcctctggacccgctgcactacatacgcaagcctgatctgaagaaaaagcgaggccgcccaccaaaaatgagggaagccatggctgaaatgccctttatgcactctctatccttcccactgtcctcaaccggattctatcctagttacgggatgccatactctccgtcacctttgactgccgcacctatcggtcttggctactacgggaggtacccccccactttatatcccccacctccgagtccaagctttaccacccctctccctccaccctcctacatgcatgccgggcatctgctgctcaacccggcaaaatatcacaaaaaaaagcataaattgctcaggcaggaagctttcctcaccaccagccgcacacccttgctcagtatgagtacgtacccctccgtcccccctgagatggcttacggttggatggttgaacataaacatagacacagacataaacaccgggagcacagaagctccgagcaacctcaggttagcatggacaccgggtctagtcggtcagtcctcgagtccctcaagcgataccgatttggaaaggacgccgtcggcgaacgatacaagcacaaagagaagcaccgttgccacatgtcatgtccgcatctgtcgccgagcaaatcgctgataaatcgcgaggagcagtgggtgcatagagagccgtccgaatcctcaccactggcccttggccttcagactcctttgcagattgattgttcggaatcaagcccctctctctctttagggggattcactccgaacagcgagcctgcgagcagcgatgagcacaccaatctctttactagcgcaatcggatcctgcagagtgagcaatcctaacagctctgggcgcaagaagctcaccgactcccctgggctgttcagtgctcaagatacgtcactgaatcgtctgcacaggaaggagtcccttccctctaatgagcgggccgtccagaccctggccggcagtcagcctacctcggacaagccttctcagaggcccagcgagagtaccaattgctcacccacgcgaaagcgatcatccagtgaatccacgagttctaccgttaacggggtccccagtagatccccccgcttagttgcaagtggcgatgacagtgtggacagcctgctgcagcggatggtccagaacgaagaccaggaacccatggaaaaatcaatcgatgcagtgattgctaccgcctcagctccaccctcttcaagtccagggagatcccattcaaaggatcggacgctcggcaagcctgattcccttctggtgccagcagtcacctctgattcttgtaacaattccatctctctcctgtctgagaagctcacctcctcctgttctccccaccatatcaaacggtcggtggtcgaggccatgcagcggcaagctcgcaagatgtgtaactacgacaagattttggcaaccaagaagaacttggaccacgttaacaaaatcctgaaggccaagaaactgcaacggcaagcaaggactggcaataactttgtcaaacgtcgacccggaagaccacggaagtgccctctgcaggccgtggttagtatgcaggcatttcaggccgctcagttcgtaaatcccgagctcaacagagacgaggagggagccgctctgcaccttagtccagacacagtcacagacgtgatcgaggcggtcgtacaatccgtcaatctcaacccagaacacaagaagggtctgaagcgaaagggctggttgctggaagaacaaactcggaagaagcaaaagccgcttccagaggaagaggaacaggaaaataacaagagcttcaatgaggctccagtggagatcccttctcccagcgaaactcccgcgaaacccagcgaacctgagtccacacttcagccagtcttgagtctgattccccgcgaaaaaaaaccaccaaggccacccaagaaaaagtatcaaaaagccgggctgtactcagatgtatataagacgacagacccaaaaagcaggctgattcagctgaagaaagaaaaactggagtacactccaggggagcatgaatacggcctctttcctgctcctattcacgtggtcttcttcgtttccgggaagtacttgaggcagaagaggatcgactttcaacttccttatgatattctttggcagtggaagcataaccaactatataaaaaacctgatgttccattgtataagaaaattcggagtaatgtgtacgtggatgtaaagccgctgtcaggatacgaggcgacgacatgcaactgtaagaagccagatgacgatacaaggaaaggatgcgtagatgattgtctgaatcgaatgatattcgcggagtgttctcccaacacctgcccttgtggagaacagtgctgtaaccagcgaatccagcgacacgagtgggttcaatgtttggagcggtttcgcgctgaggagaagggctgggggatcagaacgaaagagcctcttaaagccgggcagttcatcattgagtatctgggcgaagtcgtgagcgagcaggagttccgtaatcggatgatagaacagtaccataaccactctgaccattactgcctgaatctcgacagtgggatggtgatagatagctatcgcatggggaacgaggctcggttcattaatcatagctgtgatcccaattgcgagatgcagaagtggagcgtaaacggtgtgtacagaattggcctttatgccctgaaagacatgcctgccggcaccgagctgacctacgattataacttccatagcttcaatgttgaaaagcagcagttatgtaaatgcggctttgagaagtgtaggggaatcatcggggggaaatctcaaagagttaatggactcacctcctccaaaaatagtcagccaatggcaacccataagaagtccggtcggtccaaggagaagcggaagagcaagcacaaacttaagaaaagaagaggtcatttgtctgaggagccctctgaaaacatcaatacgccaacgcgcctgactccgcagctccagatgaaacctatgagcaaccgcgaaagaaattttgttctgaaacatcacgtatttttggtccggaattgggagaaaattaggcagaaacaggaagaagttaagcacacatccgataacattcactcagcaagcctgtatacacgatggaatgggatttgtagagatgatggcaatatcaagtcagacgtttttatgactcaatttagcgctctgcagaccgcccgatcagtgcggaccagaaggctcgcagccgcggaggagaacatcgaagttgcgcgggcagcccgcttggcgcaaattttcaaggaaatttgtgatgggatcataagctataaggactccagtcgacaggccctcgccgctccactgctcaatctcccacccaagaagaagaatgcagattattacgaaaagatctctgatcccctggacctgatcactatcgaaaagcagatcttgacaggctattacaagacagtggaggcatttgatgcagacatgctaaaggtatttagaaatgcggaaaaatattacgggcgcaagtcgcccgtgggccgcgacgtgtgccgccttaggaaagcatactacaatgctcggcatgaggcctccgcccagatcgatgagatcgtgggcgagacagcttccgaagctgatagtagcgaaaccagtgtctcagaaaaagagaatggccacgaaaaggatgatgatgtcataaggtgtatctgcggcctctataaggacgagggcctcatgatacaatgtgataagtgtatggtgtggcagcactgtgactgtatgggtgtcaattccgatgtcgagcattacctctgcgaacagtgcgatccgaggcccgtggacagggaggtgcccatgattcctaggcctcactacgcgcaacccggctgtgtgtattttatttgcctcctgcgggacgacctgctcttgaggcaaggagactgtgtttacttgatgcgcgactccagacggacccctgatggtcatcctgttagacagtcctaccgcctgctcagccacattaaccgcgataaactggatatcttcagaattgagaaattatggaaaaacgaaaaggaggagcggttcgcatttggccatcattattttcggccgcacgagactcaccacagcccttcaaggcggttctaccacaacgagctgtttagggtgccactatatgagattattccattagaagcggtcgtcggaacatgttgcgtgcttgacttgtacacctactgtaaggggagaccaaaaggcgtgaaggagcaggacgtgtatatctgtgattacagactggataagtctgcacacctcttctacaagatccaccggaacagataccccgtgtgtaccaaaccatatgcatttgatcactttcccaaaaagctgactcctaagaaagacttctcccctcattacgtcccagacaattacaagaggaatggtggcaggagcagctggaagagcgagcggagtaaaccacctctgaaagacctcggccaagaagacgacgccctaccattgattgaggaggtcctggccagccaagaacaggctgcaaatgaaatcccgtcgcttgaggagccggaaagagagggggccacagcgaacgtgtcagagggtgagaagaaaaccgaggaatcaagccaggagcctcagtctacatgtactccagaggagcgccggcataatcagcgagaacggctgaaccagatcctgctgaacctgctggaaaagatcccaggtaagaacgccatcgatgtgacctacctcttagaagagggtagtggtcggaagctgagacgccgaactctgtttataccggaaaatagctttcgaaaatag

SEQ ID NO: 24432 - DNA, 8895 bp, Artificial Sequence
  Description of Artificial Sequence: Synthetic coding sequence
atggatccccgcaacacagcgatgctgggccttggctccgacagcgagggattctccaggaagtcacctagtgcaattagtacaggcacgcttgtctctaagagagaagtagagctggagaagaatacaaaagaagaggaggaccttcgcaagagaaaccgagaaagaaacattgaggccgggaaagacgacgggctgaccgatgcgcagcagcagttcagcgtcaaagaaactaactttagtgaggggaacctaaagctcaaaatcggccttcaggccaaacgcacgaaaaaacccccaaagaatctggaaaactacgtttgccgaccagccattaaaaccaccatcaaacatccccgcaaggcacttaagtcgggcaaaatgacagacgagaagaacgagcattgcccgagcaagcgggatcccagcaagctgtataaaaaagccgacgacgttgccgctattgagtgtcagtctgaggaggtgattagactacactctcaaggcgagaacaatcccctgagcaagaagttgtccccggttcattctgagatggctgactacattaacgccacaccgtctaccttgctgggctctagggaccctgaccttaaagacagagccctcctaaatggtgggactagcgttaccgagaaactggcccagttgatcgccacttgtcctccttcgaagtcatcaaagaccaagcctaaaaaactgggaactggaaccacagccggcttggtatctaaagatctcattcggaaggctggtgtcggtagcgtggcaggtattattcataaagacctgattaagaagcctacaatcagtaccgcggtgggtctcgtaaccaaggatcccggaaaaaagcctgttttcaacgctgccgtgggtctggtaaacaaagattccgtgaaaaagctcggcaccggtactaccgctgtgttcattaataagaatctcggaaagaagcccggcacgattacaactgttgggctgctttctaaggactcaggaaaaaagttaggtatcggaatcgtgccaggcctagtgcataaggagtccggcaagaaattgggactgggaaccgttgttggattggtgaataaagacctcggcaaaaagctaggcagcacggtgggactcgtggccaaagactgtgcaaaaaaaatcgtggcctcctctgccatgggcttggtgaataaggatatcggaaagaaattgatgtcatgtcccctcgcagggctcatcagtaaagatgctatcaacctcaaggcagaggcgctgctgcccacccaggagcccctgaaagcgagctgtagtacgaatatcaacaatcaggaatctcaggagctcagtgaaagcctcaaggactctgccacgagtaaaaccttcgagaagaatgtcgttagacagaataaggaatctatactcgagaaattctccgttaggaaagagatcataaatttagaaaaggagatgttcaacgaaggcacctgtatccagcaggatagttttagctcttccgagaagggcagttacgaaaccagtaagcatgaaaagcagcctcccgtatactgcacaagcccggacttcaaaatgggcggagccagtgatgtaagcaccgccaagagcccattcagcgcggtgggcgagagcaacctgccaagtcctagccccactgtgtccgtcaacccgctaacacgcagccccccagagacttcaagtcaacttgcgccgaaccccctgttactttcaagtaccacagagctgatcgaggagattagtgagtctgtgggcaagaatcagttcactagcgagtctacacaccttaacgtaggccatcgatctgtggggcattctatctcaatcgagtgcaagggcattgacaaagaagttaatgatagcaagacaacacacatcgacatacctaggatctcctcatctctggggaagaaacctagcctgacatccgaaagctcgatccacaccattaccccctctgtggtcaatttcacctcactgttcagcaataaaccatttttgaagctgggtgcagtgtccgcctcggataagcactgtcaagtggctgaaagcctgagcactagcctgcagtccaagcccttgaagaaaaggaagggaaggaaaccccgctggacgaaggtggtggccagatcgacttgtcgctctcctaaggggttggagttggagaggagtgaactgtttaagaatgtgagctgtagtagcttgtccaactcaaactccgagcccgccaagtttatgaagaacatcgggccccccagttttgttgaccacgacttcctgaagcggagactgcctaagttatccaagagcactgcaccttctttagctttgctggccgattcggaaaaaccatcccacaagtcctttgctacccacaagcttagctccagtatgtgtgtatcaagcgatttgctctctgacatttacaaacccaagcgcggccggccaaagtccaaggagatgccccaacttgaaggaccgccaaaaagaaccttgaagatacccgcaagcaaggtgttttcactgcaatctaaagaggagcaggagcctcctattttgcaacctgagattgagattccgtccttcaaacaaggattgtcggtaagccctttccctaaaaaacggggaaggccgaagaggcagatgaggtcccccgttaagatgaagcctccagttctcagtgtcgcccccttcgttgctaccgagtcgcctagcaaactcgaatccgagtccgacaatcatcgttctagttcagatttctttgagtcagaggatcagttgcaggatcctgacgatctggatgactcacatcgccctagcgtatgctccatgtccgatctggagatggaaccagataaaaagattacgaaacgaaacaacgggcaactgatgaaaaccataattcggaagattaataagatgaagacacttaagaggaaaaagctgctcaatcaaattttgagctcatcggttgaatcatctaataaagggaaggttcaaagtaaactgcacaatactgtgagctcactggcggcaactttcgggtcaaagctgggccagcagatcaacgtatctaagaagggcaccatctacataggcaagagacgtggtcgcaagccaaagaccgtgcttaacgggatcctgtctgggtccccgacctccttggctgtcctggagcagacagcccagcaggccgccggaagcgccctcggtcaaatcctccctcccttgctgcccagctcagcatccagtagtgaaattctgccgtccccaatttgcagccagagttccggcacctctgggggccaatcacctgtgagctcagacgctgggtttgtggaacccagctcagttccatacctgcacctccactctcgacaggggtcaatgattcagactcttgccatgaagaaagccagcaagggccgacgccggttatcacctccgacattattgccaaatagtccctcccacctaagtgagttgacaagtcttaaggaagcaactccatccccaatttcagagtcccactctgacgagactattccatccgactctggcattggcacagacaacaatagcacctcagacagagcagagaagttctgcggacagaaaaagaggcggcattcttttgagcacgtgagtcttataccgcctgaaactagcactgtgttgtcatctttaaaggagaagcacaagcataaatgtaaacgaaggaaccatgattacctgtcgtatgataagatgaagagacagaaacgcaaacgcaagaagaagtatccccagctcaggaatcggcaggaccccgattttatagctgagctggaggagctcatttccagactgtccgagattcgaattactcataggtcccaccactttattccccgcgatctcttacctaccattttccgtattaactttaatagcttttatactcatccgtcattccccctggacccactgcactacatcaggaagccagatctgaaaaaaaaaagggggcggcccccgaagatgcgggaagctatggcagaaatgccttttatgcactccctgtctttccctttgagttccacaggattctacccatcgtacgggatgccgtattccccatcacctctaaccgcagcacccatcggccttggctattacgggagatacccaccgaccctgtatccacctccgccttccccgtctttcaccacacccctgccacccccgtcttacatgcacgctggacatctgcttttgaaccctgcgaagtaccataaaaagaagcacaagctgctacggcaggaagctttcctgacaacctctcggactccactgctgagcatgagcacgtacccctcggtcccacccgaaatggcctatgggtggatggtcgagcataaacataggcacagacacaagcatagggaacaccgctcgtctgagcagcctcaggtgagcatggatacaggaagctcacgcagcgtcctggagagcctgaagcgttatagatttggaaaggacgccgtcggagagcggtataaacacaaagagaaacacaggtgtcacatgtcctgccctcatctgtcccccagtaagagcctgattaatagagaggaacagtgggttcacagggaaccatcagagtcttcaccattagctctggggctgcagacgccactgcagattgactgctcagaaagttcaccctccctttcactgggcggattcaccccaaattccgagcccgcttccagcgatgagcatacgaatctgttcacttcagccattgggtcctgccgggtctccaaccctaattcttccggacgcaagaaactaactgacagtcctggtctttttagtgctcaagacacctcactaaatcggctccaccggaaggagtccctcccctcaaacgagcgcgctgtgcagaccctcgctggaagccagccaacaagtgacaagccatcacagcgacccagcgagagtaccaactgctctccgacacgcaaaagatccagctctgaatctacctctagcactgtcaatggcgtcccgtctagaagcccacgcctggtggcttcgggcgacgattctgtggactccctcctgcagcggatggtacagaacgaggaccaggagcccatggagaaaagcatagacgccgtcatagcaactgcttctgcgccaccttcatccagccccggccgtagccatagcaaggacagaactctaggcaagcctgatagtctgctggtcccagctgtcaccagcgacagctgtaataacagtatcagtctactctccgagaaactcacctccagctgcagtccccaccacatcaagaggtctgtggtggaggctatgcagcgccaggccaggaagatgtgcaattacgacaagatactggccacgaaaaaaaatctcgatcacgtgaacaagatcctcaaggcgaaaaagctccaacgacaagctcgtaccggaaacaattttgttaagaggcggcctgggcgccctcgcaagtgtcccctacaggccgtggtttcaatgcaagcctttcaggccgcgcaatttgtaaatcccgagttaaacagagatgaggagggagcggcattgcacctgtccccggacacagtaacagacgtgatagaggcagtcgtgcagtcggtcaatctcaacccagagcataagaaggggttgaagaggaaaggttggctcttagaggaacagactaggaagaaacaaaaacccctaccagaggaagaagaacaggagaacaacaaaagcttcaacgaagctccagtggaaatcccaagcccctccgagactccggcaaaaccgagtgagccggagagtaccctccagcctgtactgtcactgattccacgtgaaaagaagcctcctcgtccgcccaaaaaaaaataccagaaggccggcctctacagcgacgtctataaaactacagacccgaaatcgaggttaatccaactgaagaaagaaaagttggaatatactcctggcgagcatgagtacggtctgttccccgcccccatacacgtgggtaaatacctccgtcaaaaaagaattgactttcaactcccctacgatattctgtggcagtggaagcataatcagctgtacaagaaacctgacgttcccctatataaaaagattaggtccaatgtgtatgtcgacgtgaaaccccttagcggatacgaagcgaccacttgtaactgtaaaaaaccggatgatgatacccgcaagggttgtgtcgatgattgtctgaaccggatgatctttgccgaatgctcccccaatacatgcccatgcggcgagcaatgctgtaaccagcggattcagcgccatgagtgggtgcagtgtttggagcgctttagggccgaggagaagggctggggcatcaggactaaagagccactcaaggccgggcagttcattattgagtatcttggagaagtggtgagcgagcaggagttccgtaatcgcatgatagaacagtatcataatcactccgaccactattgcctaaacctggactcggggatggtgattgactcctatcgtatgggaaatgaggccaggttcattaaccatagttgtgacccaaactgcgagatgcaaaagtggagtgtgaatggtgtgtacagaattggcttatatgctctgaaggatatgccagccggcacagaactgacctacgactataactttcacagctttaacgtcgagaagcaacagctgtgcaagtgtgggttcgaaaagtgtcgcggcatcataggcggaaagagccaacgcgtgaacggcctcacttccagtaaaaatagccagccaatggctacacacaagaaaagtggaaggagtaaagaaaagagaaaaagtaagcataagctaaagaaacgccgcgggcacctctccgaagagcctagcgagaatattaatacacccacccgactcacacctcagttgcagatgaagccaatgtccaatagggagagaaactttgttttgaaacatcacgttttcctggttaggaattgggaaaaaatccgccaaaagcaggaagaggttaaacataccagcgacaacatacacagcgctagcctctacactcgttggaatgggatttgccgtgatgatggcaacatcaagagcgacgttttcatgacacagttttctgccctgcaaacagcacggagtgttcggaccaggcgtcttgcagctgctgaagagaatattgaagtggcccgcgccgcaaggctagcacagatcttcaaggaaatttgcgacggaatcatttcttacaaagacagttcaagacaggcccttgctgcacctttgctgaacctgccgccaaagaagaagaatgctgactactacgaaaagatctctgatcccctggatctaattaccatagaaaagcaaatactgacaggctattataagaccgtggaggcgtttgatgccgacatgctgaaggtgttccgcaacgcagaaaaatactatgggagaaagagcccagtagggagagacgtttgtcgtctgcggaaggcttattataatgcccgacatgaggccagcgcgcagatcgacgagatagtaggagagaccgcatctgaagcggattcaagtgagactagtgtttctgaaaaagaaaacggacacgagaaagacgatgacgttatccgatgtatttgtggtctctacaaggacgagggtttgatgatccagtgtgacaagtgcatggtgtggcaacattgcgactgcatgggagtgaactctgacgtcgaacattacctgtgcgaacagtgtgatccccgaccagtagaccgcgaggtgcccatgatcccgaggcctcattatgcccagccaggttgtgtctattttatctgcctgcttagggacgatctgttgctacggcagggcgactgtgtctacctgatgagggactctaggcgcacccccgacgggcatcctgtcagacaaagttaccgattgctctctcacattaatagggataaactggacatcttccgcattgaaaagctgtggaagaatgagaaggaggagagatttgcgttcgggcatcattatttcaggccccacgagacacaccatagtccttctaggcggttctatcacaacgagcttttccgtgtacccttatacgaaattatccccctggaggctgtcgtcggcacctgttgtgttctcgacttatacacttactgcaaaggccggccaaaaggggttaaggaacaggatgtatacatctgtgactacagactggacaaatccgctcacctgttctataaaatacaccgtaaccgctaccccgtgtgtacaaaaccctatgccttcgaccacttcccaaagaaactgacacccaaaaaagatttttcaccccattatgtgccagataattacaaaaggaacggtggccgttcttcgtggaagtctgaaaggtctaaacctccactcaaggacctgggacaggaagatgatgctctccctctaatcgaagaggttctggcatcccaggagcaggctgccaatgagattcctagcctagaagaacccgagcgtgaaggcgcgaccgctaatgtttcagaaggggagaaaaaaacagaagaatcaagccaggaaccccagagtacatgcactccggaagaacgccgccataatcagagggaaaggctgaatcaaatacttctcaatctgttggaaaaaattcctggcaaaaacgccatagacgtgacatatctcctggaggaaggttcagggagaaagttgcgcaggcggaccctctttatcccggagaattcgttccgaaaatag

SEQ ID NO: 24433 - DNA, 864 bp, Artificial Sequence
  Description of Artificial Sequence: Synthetic coding sequence
atggctaaagacttccaagatattcagcagttaagctccgaggagaatgaccatccttttcaccagggccctcctccagcccaacccctggctcagcgcctctgcagtatggtgtgtttcagcctgctggccctgagttttaacattctccttcttgtggtcatctgcgttacaggaagtcaatctgcccagctccaagccgagctccgtagcctcaaggaggcctttagcaacttttcctcttcaactctcaccgaggtgcaggccatatcaactcacggtggctctgtgggggacaagataacctctttaggagccaagctcgaaaagcagcagcaggacctgaaggctgaccatgacgctctgctgttccaccttaagcatttccccgtagatctgcggtttgtggcctgccagatggaactcctgcattccaatgggagtcagcgtacttgttgccccgtcaactgggttgagcaccaggggtcctgctactggttttcacatagtgggaaggcctgggccgaagcagagaagtactgtcagcttgagaatgcccacttagtggttatcaattcctgggaggaacaaaaatttattgtgcaacacactaacccgtttaacacttggattggcctgactgattccgacggaagctggaaatgggttgatgggacagattaccgacataattacaagaactgggcagtaactcaacctgacaattggcacgggcacgagcttgggggatccgaagactgcgtcgaagttcagcctgacggaagatggaatgacgacttttgtcttcaggtttacagatgggtatgtgagaaaaggcgcaatgcaaccggggaggtggcttag

SEQ ID NO: 24434 - DNA, 936 bp, Artificial Sequence
  Description of Artificial Sequence: Synthetic coding sequence
atggcaaaggattttcaagatattcagcagttgagtagcgaagagaacgaccatcctttccaccagggtgagggtcctggcactcgaagactgaatccacggaggggtaaccccttcctaaagggaccgccaccagcccagcccctagcacaaaggctgtgtagcatggtctgctttagtctgcttgcactatcattcaacatcctgctgctcgtggtgatttgtgtaaccgggagtcaatccgagggccatgggggggcacaactgcaggctgagctcagaagcctgaaagaggcattcagcaacttctcatcctctactcttaccgaagtgcaggccatttcaactcacggaggatcagtcggggacaagattaccagcctaggcgctaaactagaaaagcaacagcaggatctgaaggcagaccatgatgctctgctgttccacttaaaacactttcctgtggatctcaggttcgttgcctgtcagatggagctgctgcacagcaatggctcacagcggacatgctgtcctgttaactgggtagaacatcaaggctcgtgctactggttcagtcacagcggcaaggcttgggcggaggctgagaaatactgccaactggagaatgcgcacctggtagtcataaactcctgggaagagcagaagttcatcgtacagcacacgaatccttttaacacctggatagggctgacagacagtgacgggtcatggaaatgggtggatggtactgattacaggcataattacaaaaactgggcggttacccagcccgacaactggcacgggcacgaactggggggcagtgaggactgtgtcgaagtgcagccggacggccgttggaatgacgatttctgtctgcaggtttacaggtgggtctgcgagaaaagacgtaatgcaactggcgaggtggcctag

SEQ ID NO: 24435 - DNA, 936 bp, Artificial Sequence
  Description of Artificial Sequence: Synthetic coding sequence
atggccaaggacttccaagatattcagcaactgtctagtgaggaaaacgatcacccttttcatcagggcgagggccccgggaccagacggcttaatcccaggagagggaatccttttcttaaaggacctccacccgcacagcctctcgcccagaggctgtgttcaatggtgtgtttctctttactcgctttgtccttcaatatcctgctcttggtggtcatctgcgttacaggcagccagtccgagggacacggtggggctcagctccaggccgagctgcggtccctgaaggaagctttcagtaattttagcagctctaccttaacagaggtgcaagcaatctctacgcacgggggcagcgttggggataaaattacgtcactaggagcaaagcttgagaagcaacagcaggacctgaaagctgatcacgacgcgttactgttccatctgaagcacttcccagtggatctgcgattcgtcgcctgtcagatggaactcctacactccaatggcagccaacgaacatgttgccctgttaactgggtcgaacaccagggaagctgctactggttctcacactcgggtaaggcctgggcagaagcagagaaatactgccagcttgaaaacgcccatctcgtggtgattaattcatgggaggagcagaagtttattgtgcagcacactaaccctttcaacacatggatcgggctgacagactcagacggcagctggaagtgggtggacggaactgattataggcataattataagaactgggcagtgactcagccagataattggcacggccatgaactgggaggatctgaagactgtgtggaagttcagcccgatgggcgctggaatgacgacttctgcctgcaggtgtacaggtgggtttgcgagaagcgacggaacgccactggcgaggttgcctag

SEQ ID NO: 24436 - DNA, 879 bp, Artificial Sequence
  Description of Artificial Sequence: Synthetic coding sequence
atggccaaagatttccaagacatccagcagctgtcaagtgaggaaaacgaccacccttttcaccaggggccgccacctgcccagcctttagcccagagactttgtagtatggtgtgtttcagcctgctagctctcagctttaatatcctacttctggtggttatatgtgtgaccgggtcccagtccgaaggccatgggggagcccagctccaggcggagctgcgatcccttaaggaagcattcagcaacttttcgtcatcaactctgacagaggtgcaggctatttcaacccacggcggtagcgtgggtgataagattacctccctgggcgccaaactggaaaagcaacagcaggacctgaaagccgaccatgacgcactcttgttccatttaaaacatttccccgtagacctgagattcgttgcctgtcagatggagttgttacatagcaacgggagccaacgcacttgttgccctgtaaactgggttgaacatcaaggatcctgctattggttctcacactcggggaaggcatgggccgaagctgaaaagtattgtcagctggaaaacgcccacctggttgtaattaattcttgggaggaacagaagtttattgtgcagcatacaaaccccttcaatacatggatcggtctcaccgatagcgatggatcttggaaatgggtggacggcactgactataggcacaattataagaattgggccgtcacacagccggacaactggcatggtcatgaactgggtgggagtgaggactgcgtagaagtgcagcctgacggtcggtggaatgacgacttttgcctccaagtgtatcgctgggtgtgcgagaaaaggaggaacgctactggggaagttgcctag

SEQ ID NO: 24437 - DNA, 414 bp, Artificial Sequence
  Description of Artificial Sequence: Synthetic coding sequence
atggccaaggacttccaagacatccagcagctgtcttcagaagagaacgaccacccgttccaccaggggccccccccagcacagcctctcgcacagcgcttgtgttccatggtctgtttcagcctcctggccctctcatttaatatactgctgctagtggtgatctgtgtgaccggcagtcaatctgctcaacttcaagccgaactaaggtccctgaaggaagcattttccaattttagttcatccacactgaccgaggttcaggcgatctccactcatgggggatcagtcggtgataaaatcacaagcctaggggctaaactggaaaagcaacagcaagatctgaaagctggccagcgagcaagcggagtgtgtgcccatgtgagagcctgtgtgagagtcaggtgcgtttag

SEQ ID NO: 24438 - DNA, 1422 bp, Artificial Sequence
  Description of Artificial Sequence: Synthetic coding sequence
atggcccagctagaggggtactgcttctccgccgcattgagctgcaccttcttagtttcctgccttctctttagtgcattttcccgtgcactccgggagccttatatggacgagatctttcatctgcctcaggctcagagatactgcgagggacatttttccctgtcacaatgggaccccatgattactacacttcccgggctctacctcgtgtcggtgggggttgtgaagccagctatctggattttcgcttggtctgagcacgtcgtttgctcaatcggcatgcttagatttgtgaatctgttattttctgtcggcaatttctatctcctctaccttttgtttcataaagttcaaccacgcaataaagctgccagttctatccagagagtgctttccacgcttacactcgcagtgtttccaaccctttattttttcaatttcttatattacaccgaagctgggtcaatgtttttcacactattcgcttatctgatgtgcctgtatggtaaccataagacttctgcgttccttggattctgcggcttcatgttccgacaaactaacatcatctgggccgtgttctgtgccgggaacgtgatcgcccagaaactgacagaggcttggaaaactgaactccagaaaaaagaggatcgactgccccccatcaaaggccccttcgccgaatttcgtaagattttacagttcctgctcgcctatagtatgagcttcaagaatctctccatgttattttgcctgacttggccatacatacttctagggtttcttttttgcgcgtttgtggtggttaacggaggtattgtgataggtgaccggtctagccacgaagcttgcctccacttcccccagctattctacttcttctcattcaccttgttcttttcattccctcaccttctgtcaccatcaaaaataaagacatttttaagcctggtgtggaaacacggaattcttttcctagtagtcactctggtgtccgtgttcctggtgtggaaatttacatacgcacataagtacctgcttgctgacaaccgtcactatactttttacgtgtggaagagagtgtttcagcggtatgccatcctaaagtatctcctggttcccgcatatatatttgcaggttggagtatagctgattcacttaagtctaaacccatcttttggaatctcatgttctttatatgcctgttcatcgtaatcgtgccccagaaactgctggagttcaggtattttatactgccctacgtgatttataggctgaatatcaccctccctcctacaagccggctggtgtgtgagctctcatgctatgctattgttaacttcattacgttttacatcttcttgaataaaaccttccaatggccgaactctcaggacattcaacggtttatgtggtag

SEQ ID NO: 24439 - DNA, 1173 bp, Artificial Sequence
  Description of Artificial Sequence: Synthetic coding sequence
atgtttcccgcccaggctaaggaaaacgctggatttagtgggtgtggaggggatacggagatcgactggaaggcctacatggctgaggtggaaggagtaattaatgggacttatgattacacacaactgcaaggagataccggacccctagtctaccccgccggattcgtgtatatcttcatgggattgtattatgccactagcagaggcaccgacatcaggatggctcaaaacatcttcgccgtgctgtacttagcgacattgctgctggtctttctgatatatcatcagacctgtaaggttcctccattcgtgtttttctttatgtgttgcgccagttatcgcgtgcacagtatctttgtactgagactgttcaacgacccagttgcgatggtgcttctgtttttgagcataaatctccttttagcacagcgctggggctggggttgttgcttcttctcactggccgtcagcgtcaagatgaatgtcctgctgtttgcgccagggttgctttttttgctgctgactcagttcgggttccgaggtgcgctcccgaagttgggcatatgcgccggacttcaggtcgtgcttggcctgccatttctgctggaaaaccctagtgggtacctatccagatcatttgacctgggccgtcagttcctattccactggacagtcaattggcgctttctgcccgaggcgctgtttttgcatcgggcattccatctggctctcctgaccgcccaccttacactgctgctcctgtttgccttgtgtaggtggcaccggaccggtgagtcaattctgtcattattgagggatccatctaaacgcaaagttcccccccagcctctcacccccaatcagattgtgtccacactgttcacctctaatttcataggcatctgttttagccgaagtctgcattaccagttttacgtctggtactttcatacattaccctatctgctctgggctatgcccgcgcgctggctgacccaccttctgcgccttttggtccttggccttatcgaattgagctggaatacatacccttcaactagctgctcctccgcagcacttcacatctgccatgccgtgatcttgctccagctgtggctgggtcctcagcccttccctaagtctactcagcatagcaaaaaggcccattag

SEQ ID NO: 24440 - DNA, 975 bp, Artificial Sequence
  Description of Artificial Sequence: Synthetic coding sequence
atggcgcctttgctgttacaactcgccgtcctgggcgcggccctggctgctgccgctctggtcttgatttctattgtggccttcactacagcgaccaagatgccagcactccaccgtcatgaagaagagaagttcttcctgaatgctaagggccagaaagaaaccctaccaagtatctgggatagtccaaccaaacagctctccgtggtcgttccaagttacaatgaggagaagagactacccgtcatgatggacgaggctttatcctatctggagaaacggcagaagagggaccctgctttcacttatgaagtcatcgtggtggatgacgggagtaaggatcaaacctccaaggtagcatttaagtattgccagaagtacgggagtgacaaagtacgtgtaataacactggtgaaaaatagaggaaaaggcggcgccattaggatgggaattttttcttcaaggggagaaaaaatcttaatggctgatgcagatggtgcaactaagttccccgatgtggaaaagctggaaaagggtctgaacgatcttcagccgtggccaaatcagatggccatcgcatgtggatctagggcacatctggagaaggagtctatcgcccaaaggagctattttcggactctgcttatgtatgggttccattttctggtgtggttcctctgcgtgaaggggattagggatacacaatgcggattcaaactgttcacaagggaggccgcttcccgtaccttcagttcgttgcacgtagagcgatgggcctttgacgtggagctgctgtacatcgcccagtttttcaagatcccgattgcggaaatcgctgtaaactggactgaaattgagggctcgaaactcgtaccattctggtcatggctccagatgggcaaggacctattgttcatcagactgaggtacctgactggcgcctggaggctggagcagactcgcaaaatgaattag

SEQ ID NO: 24441 - DNA, 693 bp, Artificial Sequence
  Description of Artificial Sequence: Synthetic coding sequence
atggctcctctgctgctccagctcgccgtgctcggggcagccctagctgccgccgctctagtacttatctccatagtcgcattcaccactgcaaccaagatgcccgccctgcatcgccacgaagaagagaagtttttcctgaacgcgaagggtcagaaggaaaccctgccatcaatctgggacagtcccacaaaacagctgtctgtggtggtcccgtcttataacgaggagaagcgcctgcctgtgatgatggatgaagctctgagttacctagaaaagaggcaaaagagagatcccgcattcacctacgaggtcatcgtcgtcgatgacggctccaaagaccagacctcaaaggttgctttcaagtattgtcagaagtacgggtctgacaaagtccgggtgataaccttggtgaagaaccggggaaaaggaggagccataagaatggggatttttagcagccggggggaaaagattcttatggcagatgctgacggagccacaaaattcccggacgtagagaaactggagaaagggctaaacgacttacagccttggcccaatcagatggctattgcctgcggctctcgagcgcacctcgaaaaggagagtatcgctcagcataaatgttcgttcgggggcctaatctcgcaacctgtttttataggatctatactatatggacggcactag

SEQ ID NO: 24442 - DNA, 885 bp, Artificial Sequence
  Description of Artificial Sequence: Synthetic coding sequence
atggcaccactgctcctccagctggccgtgcttggcgccgccctggccgccgccgccctcgtcctgatttccatagttgcattcacgacagctacgaagatgcctgcgctgcatagacacgaggaggagaagtttttcctgaacgcgaaagggcagaaagagacccttccttccatttgggactctccaaccaagcagttatctgtcgttgtgccctcctacaatgaagaaaagagattaccggtcatgatggatgaggccctgtcatacctcgaaaagcgacagaagtacggctctgacaaggttagggtcattaccctggtgaaaaatcgagggaaaggcggagcaatacggatgggcatctttagttcccgcggcgaaaaaattctgatggccgatgccgacggtgctacaaagttcccagatgtggaaaagcttgagaaaggcttgaacgatttgcaaccatggcctaaccagatggctatcgcttgtggctcacgggcccacctcgagaaggagtcaattgcacaaaggtcctattttagaacattactaatgtacggcttccactttctggtgtggttcttgtgcgttaagggaatacgcgacacccagtgcggatttaaactctttaccagagaggcggcatccagaacatttagttccctacatgtcgaacgttgggcgttcgatgtcgaattgctgtatatagctcaattctttaaaatacccattgctgaaattgccgtgaactggactgagatcgagggctccaagcttgtaccattctggtcttggctgcaaatgggtaaggacctgcttttcattcgactgcgatatctcacaggggcgtggcggctggagcaaactcggaaaatgaattag

SEQ ID NO: 24443 - DNA, 1173 bp, Artificial Sequence
  Description of Artificial Sequence: Synthetic coding sequence
atgaaagagggtcgtggctccttttcagtcgaaagaggtcccaggaaagagagagagacagcacaaagtggcatgtggaagggaaattcccccgcagggagccagggggcagctatggaaggcacgggcggagagctgggaggtcagggaaactgggggccagaggatgccccgggcctcttagctagggcctccctcattatgctcccctggcctcttcctctcgccagctctgccttaaccctcttatttggagccttgaccagtttgttcttgtggtattgctatagactggggtctcaagacatgcaggctctgggagcaggatcaagggctggaggggtgagaggcgggcccgttgggtgcagcgaggcgggcggcccctctcctggtggtccgggtgatccaggcgagggaccaaggaccgaagggctagtctcacgtagactgagggcgtatgcaaggcggtactcatgggctggtatgggccgggtgcgccgagcagcacagggcggaccaggcccagggaggggccccggagtgctggggatccagagaccagggttactgttcctacctgaccttccatccgctccttttgtaccccgggacgcgcaaagacacgatgtggagcttttggaatcttcctttccagccatactaagagattttggcgcagtctcttgggacttctccgggactacgccccctccgcggggctggtcccctcccctagccccaggttgttaccagttgctgctctatcaggctggacgctgtcaacctagcaattgcaggcgatgccctggagcataccgggctctaagaggcctccgctccttcatgagcgccaatacctttgggaacgccggattcagcgtcctcctgcccggcgcaagactggaaggcaggtgtggtccaaccaacgccagggtgagatgccacctaggcctcaagatccctcctggttgtgaactcgtggttgggggcgaaccacaatgctgggcggagggacattgcctcttagtggatgattcttttctccacaccgttgcccataatggatctcctgaggatgggcctcgggtcgtcttcattgttgacctgtggcaccccaacgtcgcaggcgcagagcggcaggccctcgactttgtcttcgctcctgacccctag

SEQ ID NO: 24444 - DNA, 1173 bp, Artificial Sequence
  Description of Artificial Sequence: Synthetic coding sequence
atgaaggagggacggggatcctttagcgtcgagcgggggcctaggaaggagcgcgaaacagcccagtccggcatgtggaagggtaacagccccgctggcagccagggcgccgccatggaaggcaccggcggcgaactgggaggacaaggaaactggggtcccgaggatgcacccggtctgctcgcccgggccagcctgatcatgctgccctggccactgccattagcctcttccgccctgacgctgctttttggagctctgacctccttgttcctgtggtactgctatcggctggggagccaggatatgcaggctctcggtgctggcagtcgcgctggaggggtcaggggaggcccagtgggctgcagcgaggctggcggcccttcccctggcggcccaggcgatccgggagaagggcctaggaccgaaggacttgtttctaggagactcagagcgtacgctagacgatatagctgggctggtatggggcgggttcgacgggccgctcagggtggccctggtccaggcagaggccccggggttctggggatccaaaggccagggcttctcttccttcccgacctgcccagtgctccatttgtcccacgggatgctcaaagacacgacgtcgagctcctggaaagctcatttcctgccatattgcgcgactttggtgccgtctcatgggattttagtggcactacccctccaccgaggggatggagtccccctttggcccccggctgttatcagctcctgctctatcaagcggggcgctgccagccctcaaactgcagacggtgcccaggtgcatatcgcgccctcagagggctgcggtcttttatgagcgcaaatacctttgggaacgctggtttcagtgtgctcttgcccggggctagactggagggcaggtgtggtcctactaatgcacgagtccggtgccatctaggcctgaagattccaccaggctgcgaactggtggtgggtggtgagccccaatgctgggccgaggggcactgtctgctcgttgatgactctttcctgcacaccgtggcccataatggaagtccagaagatggtccaagggtggtttttatcgtggacctgtggcatccgaacgtggcaggtgccgaacggcaggcactcgatttcgttttcgcccccgacccctag

SEQ ID NO: 24445 - DNA, 891 bp, Artificial Sequence
  Description of Artificial Sequence: Synthetic coding sequence
atggcaagatgcgagcggctgcggggggctgccctccgggacgtactggggcgcgcccagggggttcttttcgactgcgacggtgtactgtggaacggcgagcgggctgtccctggggccccagagctgctcgagcgcctggctcgtgctggtaaggcagccctattcgtcagtaataacagtcgccgtgctcgcccagagttagctcttcgatttgcccgtctaggcttcggcggcctcagagctgaacagctgttcagcagtgctctctgcgcggcacggctgttgcggcagagactaccaggccctccagacgctcccggggctgtgttcgttctcgggggtgaggggctcagagctgaattacgcgcggccggcctgagactggctggagacccttctgctggcgatggtgcagctcccagagtgcgcgcagttctcgtcggatatgacgaacactttagctttgctaagctcagggaggcctgtgctcacctgcgtgaccctgaatgtctgttggtggcaactgaccgcgacccctggcacccactcagcgatggctccaggactccagggaccgggtctcttgcagcggccgtggagacagcgtcaggaagacaggcactcgtcgtggggaaaccctctccttacatgttcgagtgcatcactgagaatttctcaatcgacccagcccgaactctgatggttggggaccggttggaaacagatatcctgttcggccaccgttgcggaatgaccaccgttttgactctcacaggcgtcagccgacttgaagaggctcaagcatacctggctgccggccagcatgatttagtcccccactactacgtagaaagcattgcagacctcactgagggactcgaggactag

SEQ ID NO: 24446 - DNA, 1506 bp, Artificial Sequence
  Description of Artificial Sequence: Synthetic coding sequence
atgccatcggcctctgcctccagaaaatctcaggagaagccaagagagatcatggatgccgccgaggactatgccaaggagcgctacggaatcagttccatgatccaaagtcaagaaaagccagatcgagtgctggtgagagtccgcgacctgacgattcagaaggcagacgaggtggtctgggtgagggctagagtgcacaccagtagggcgaaaggaaagcagtgtttcctggtgctacgacagcagcagtttaacgttcaggctctcgtggccgtgggggaccacgccagtaagcagatggtcaaattcgctgcgaacatcaacaaagagtcaatcgttgacgtggaaggcgtggtaagaaaagtgaaccaaaagatcggaagctgcacccaacaggacgtcgaacttcacgtccagaagatctacgtcatcagcctcgccgagccacgcctgcccttgcagctcgacgatgctgtgcgccccgaagcagaaggggaagaagaaggacgggccaccgtgaatcaggacacccgtctggacaatcgagtgattgacctccggacctctacatcacaagcagtgttccgacttcagtccggcatttgtcacctcttccgtgaaacactgattaacaagggttttgtggagatacagacccctaagataatctccgctgcttctgaggggggcgcaaatgtatttaccgtttcttacttcaaaaataatgcctatctggcccagagccctcagctctacaagcagatgtgcatatgtgcagactttgagaaggtattctcaatcggtcctgtctttagggcagaagacagtaatacccatagacaccttacagaatttgtgggcctagatattgaaatggcgtttaattatcattatcatgaagtcatggaggagattgccgacaccatggtacagattttcaaagggttgcaggagaggtttcagactgagatccagactgttaacaagcagttcccatgtgagccttttaaatttctggagcccacactccgcctggagtactgtgaggcgctcgcgatgctgagagaggccggggttgagatgggtgatgaagacgatctctccacccctaatgagaagctactcggccacctggtaaaggaaaagtatgatacggatttctatatcctagataagtatccactggccgtacgcccattttacacaatgccagacccgagaaacccgaagcagtcaaatagttacgatatgtttatgcggggggaggaaatcctttcaggcgctcagcggatccacgacccccagcttcttaccgaaagagccctgcatcatggcatcgatctagagaagataaaggcctacattgattcctttaggttcggagcccccccacatgccggtggtggtattggattagagagggtgactatgctcttcctgggacttcataatgtgcggcagacatcaatgttcccacgggacccgaagagactcactccctag

SEQ ID NO: 24447 - DNA, 1206 bp, Artificial Sequence
  Description of Artificial Sequence: Synthetic coding sequence
atggtcaagtttgcagccaacatcaacaaggagtcaattgttgacgtggagggtgtagtcagaaaggtgaaccagaagatcggcagctgcacgcagcaggatgtggagctgcacgtacagaagatctacgtcatatcacttgctgagcctagactgcccctccaattggacgatgccgtccggccggaagctgagggagaggaggagggacgggccactgtgaaccaggacacccgtttggacaacagagtcatcgacctgcgcacctcaacttcgcaggccgtgttcagactgcagagcggcatctgccacctgtttagggagacattgataaacaaaggattcgttgagatccagactcccaagattattagtgctgctagcgagggaggcgcgaatgtgtttactgtgagttattttaagaataatgcttatctcgcccagagtccccagctctacaaacagatgtgtatctgtgcagacttcgaaaaggtcttctctatagggcctgtcttccgggcagaggatagcaacacacaccgacacttaaccgagttcgttggattggatattgagatggcttttaactaccattaccacgaggttatggaagagatcgcagacaccatggtccagatttttaagggccttcaagaaaggtttcagacagagatccagactgttaacaagcagttcccctgcgagccctttaagtttttggagccaaccctgcgactagagtactgcgaagctttggctatgctgagggaggccggcgtggagatgggtgacgaggacgacttgagcacccccaacgagaaattgcttggacatctggtgaaagaaaaatatgacacagacttttatatcctcgataaataccctctcgctgtgcggcctttctacacgatgccagatccacgaaaccctaagcagagtaactcttatgatatgttcatgcgtggggaggaaatcctttctggcgcacagcggatccacgatccccagcttctcaccgagagagccctccatcacggcatcgacctggagaagatcaaggcatatatagactcgtttcggtttggcgcgcctcctcacgccggtggaggaattggcttagagagggtcactatgctttttctgggtttgcacaacgtccgacagacgagcatgttccctagagacccaaaacggctgactccctag

SEQ ID NO: 24448 - DNA, 564 bp, Artificial Sequence
  Description of Artificial Sequence: Synthetic coding sequence
atgacatcacgggagcatcaagtttccctatgcaattgtgtacccctgctccgccggctgctttgcgatgcaccctggcgaaaagctaggcccctgcatgccctttcccgctactttaggagccgtgtgtcaccttccaaaatggccgaagagccccaatctgttctgcagctgccaacatcaattgctgctggcggggaggggctaactgacgtgtcccccgaaacgactaccccggagccaccctcgtcagcggcagtgagcccaggcactgaggaacccgcgggagacacaaagaaaaaaatcgatatcctgttaaaggcggtcggtgatacccccatcatgaagacgaagaaatgggccgtggagcgtacacgtactattcaaggattgatcgactttataaagaagtttcttaaattggttgcctcagaacaactgttcatctacgtaaaccagtcattcgcaccctcacccgaccaggaggtgggcacactttacgagtgctttggctcagacggcaagcttgttctgcattattgcaaatctcaggcatggggttag

SEQ ID NO: 24449 - DNA, 225 bp, Artificial Sequence
  Description of Artificial Sequence: Synthetic coding sequence
atggcagaagaaccacagtcagtccttcagctccccacaagcatcgcggctgggggagaaggcctcacggatgttagtccagagacaactacacccgagccaccctcatctgcagccgtttccccgggaaccgaggaacccgcaggggacacaaaaaagaaaatctatctctgcgaatctgttctgtgctctttccccagaccaaggagttggaattctctgtag

SEQ ID NO: 24450 - DNA, 423 bp, Artificial Sequence
  Description of Artificial Sequence: Synthetic coding sequence
atggcggaagagccacaatccgtactgcagttacccacttccattgccgcagggggggaagggctgaccgacgtctcccccgagaccacaacaccagagccaccctcgtctgccgctgttagcccgggtactgaggagcccgccggcgatacgaaaaagaaaatcgacatcctactcaaggccgttggcgacacccctattatgaagaccaagaagtgggcagtggaacgaacgcgcactattcagggcctaatagactttatcaagaagtttctaaaattagttgcctccgaacagttgtttatttacgtgaatcagtcatttgccccgtcccctgatcaggaagttggtacattgtatgaatgctttggcagtgacggtaaactggtgcttcactactgtaaatcgcaggcttgggggtag

SEQ ID NO: 24451 - DNA, 1479 bp, Artificial Sequence
  Description of Artificial Sequence: Synthetic coding sequence
atggcttcaccctccggcaagggggctcgggctctcgaggcgccgggttgcggccctcgcccgttagcccgtgaccttgtagatagtgtggatgatgccgaaggcctctacgttgcggtggagcggtgcccgctctgtaacacaacacgcagacgtctgacctgtgccaaatgcgtccagtccggcgactttgtgtacttcgacggcagagaccgcgagaggtttattgacaagaaagagagactgtctcggctgaaaagcaagcaggaagagtttcagaaagaggtcctgaaggcgatggagggcaagtggataaccgatcagttacggtggaagatcatgtcctgtaaaatgcgcattgagcagctcaaacagaccatctgtaagggtaacgaggagatggagaaaaattccgagggcctgctgaagacgaaagaaaagaaccagaagctctacagtcgagcgcagagacatcaagaaaagaaggaaaagattcagcgtcacaacagaaagctgggtgatctggtggaaaaaaaaactatcgacttgagatctcattatgaacggctggctaacctgcgccggtcccacatcctagagcttacttctgtgatctttcctatcgaagaagtgaagactggagttcgggacccagcagacgtgagtagtgagtcagactccgcaatgacatctagtactgtaagtaaattggccgaggccaggcgcacgacgtacctcagcggtaggtgggtgtgtgatgatcataacggcgatacttctatttcaattacggggccatggatttccttgcccaacaatggcgactactctgcctactacagctgggttgaggaaaaaaagaccacgcagggtccggacatggagcagtcaaatccagcatataccataagcgcagccctctgttatgccacccagctggtgaacatcctatcccacatactagacgtgaatctgccgaagaagctgtgtaacagtgagttctgtggggaaaatctttctaagcagaagttcaccagagccgtcaaaaagctcaatgctaatattctttacctgtgtttcagccagcatgttaacctcgaccaactacaacccctccacactctcaggaacttgatgtatctggtctccccctccagcgaacacctggggcgcagcggacctttcgaggttagggccgaccttgaagaaagcatggagttcgtagatccaggcgtggcgggcgaaagcgatgaatcaggagacgagcgcgtctcggatgaagagacggatctggggactgactgggagaaccttccatcacctcgcttttgcgatattccttcgcaatctgttgaagtgtcacaaagccagtccactcaggcctccccgcctattgcctcctcaagcgctggagggatgatctcatcggccgctgcctctgtgacgtcatggtttaaagcttatactggacaccgatag

SEQ ID NO: 24452 - DNA, 828 bp, Artificial Sequence
  Description of Artificial Sequence: Synthetic coding sequence
atgaccgatgataaagacgtgctacgcgatgtctggttcggacgaatacctacttgctttacactgtaccaggatgagattactgagagggaggcagaaccttattacctgctgctccccagggtttcatacctaaccctcgtgaccgacaaggtcaagaagcactttcagaaggtgatgcggcaagaagatattagtgagatatggtttgagtatgaaggaactcccctgaaatggcactaccctattggcttactgttcgacctcctggcaagttcctctgccctgccatggaacatcacggtacacttcaagtcgtttcctgaaaaagacctcctgcattgccccagcaaagacgctatcgaagcccactttatgagctgcatgaaagaggccgatgcactcaaacacaagagccaggtgatcaatgagatgcagaagaaggaccacaaacagctatggatgggcctccagaacgataggttcgatcagttctgggctatcaataggaaacttatggagtatcccgccgaggagaatggcttccggtatattcctttccgtatttatcagactactaccgagagaccgttcatccagaagctctttcggcctgtcgcagccgacggtcagttgcacacactgggagacttactaaaggaggtgtgtccatccgcaattgatccagaagacggagagaaaaagaatcaggtgatgattcatggcatagaacctatgttggagacgcctcttcaatggctgagtgaacatctcagctatccggataactttctccatatttccataatcccacaaccaacagactag

SEQ ID NO: 24453 - DNA, 276 bp, Artificial Sequence
  Description of Artificial Sequence: Synthetic coding sequence
atgaccgacgacaaggacgtcctccgggatgtctggttcggtcgtattcctacgtgttttaccttgtatcaggacgaaataacggagcgtgaagcagaaccatattacaccgatttgacgagctttggccccagcatcgggaattcttggaatattcttcaaaaaaagatggacttcgtgatttcccctttagagtacataagacagcggctaaaagacctctcattccggagctgttttgtcctttggctgcaaatggatagctgcactcactag

SEQ ID NO: 24454 - DNA, 594 bp, Artificial Sequence
  Description of Artificial Sequence: Synthetic coding sequence
atgcattatcccatcggtctgttgttcgatcttctggccagcagtagcgcccttccgtggaacattactgtgcactttaagagcttcccagagaaggatcttttgcactgtccttcgaaagatgctatagaagcacacttcatgtcttgcatgaaggaggccgacgctctgaagcacaagagtcaggtgatcaacgagatgcagaaaaaagaccataagcagttgtggatgggccttcaaaatgatagattcgaccaattctgggctatcaaccggaagctgatggagtatcctgctgaggagaatggttttcggtacatacctttcaggatatatcagactactactgaaaggccatttatccagaagctctttaggcccgtggctgccgatggccagttacacacactaggggacttgcttaaggaggtttgcccctcagccatcgacccggaagatggggagaaaaagaaccaagtgatgatccacgggatcgagccaatgttggagacgcctttacagtggctttcagaacacctttcttaccctgacaattttctgcacatctctatcatccctcagcctactgattag

SEQ ID NO: 24455 - DNA, 828 bp, Artificial Sequence
  Description of Artificial Sequence: Synthetic coding sequence
atgactgacgacaaggatgtgcttagagacgtgtggttcggtaggatccctacctgtttcactctctaccaggacgagatcactgagcgagaagccgaaccctactacctgttactgccaagagtgtcttacttgactctcgtgacagataaagtgaaaaagcattttcagaaggtgatgcggcaagaagatatcagcgaaatttggtttgaatacgaggggaccccactgaaatggcattaccccatcggactcctgttcgatctgctggctagctcgagcgccctgccctggaacattaccgttcacttcaaaagcttccctgagaaagacctgttgcactgcccttcaaaggatgctatagaagctcacttcatgtcctgcatgaaggaggccgacgctctgaaacataagagtcaggttataaacgagatgcaaaagaaagaccataaacaactctggatgggacttcagaatgaccgttttgatcaattctgggcgattaaccggaagctgatggaatacccagctgaggagaacggattccgatacattccttttagaatttatcaaactacaaccgagagacctttcattcaaaaactgtttcgacctgtggccgctgacggccaactccatacgttgggtgacctcctcaaggaagtctgccccagcgcgatagatcctgaagatggcgagaaaaaaaatcaggtcatgattcacggaattgagcctatgttagaaacaccgctccagtggcttagtgagcaccttagttaccccgataattttctgcacatttccattattcctcagccaactgactag

SEQ ID NO: 24456 - DNA, 384 bp, Artificial Sequence
  Description of Artificial Sequence: Synthetic coding sequence
atgtgctgcgccgtgtccgaacaacgcctgacttgtgccgaccaaatgatgcccttcggtaagatcagccagcagttatgtggagtgaagaagttgccctggagttgtgactcacgatatttctgggggtggcttaatgcagtcttcaacaaagtcgactatgaccggataagggacgtcggacccgatagagcggcctcagagtggctgttgaggtgtggggccatggtgagatatcacggacaggagcggtggcagaaagactataaccacctgcctaccggacccctcgacaagtacaagattcaagcaattgatgccacggattcctgtataatgagtatcggtttcgatcatatggagacctctaatatatgttgttag

SEQ ID NO: 24457 - DNA, 411 bp, Artificial Sequence
  Description of Artificial Sequence: Synthetic coding sequence
atgtgttgtgcggtatcagagcagagattgacttgcgcggaccaaatgatgccctttgggaaaatcagccagcaactgtgtggcgttaaaaagctgccctggtcgtgtgattcacggtatttctggggatggttaaacgccgtgtttaataaagttgactatgacagaatccgggacgttggcccggatagggctgcatctgagtggttactgcgttgcggcgccatggtccgatatcacggacaagagaggtggcaaaaggattataaccaccttcccactggccccctcgacaagtacaaaatacaagccatcgacgcaacggatagctgcattatgtctattggcttcgatcacatgggaaattacccgatagtgctgctcatcgaaaatgcagacgatctgcaatag

SEQ ID NO: 24458 - DNA, 783 bp, Artificial Sequence
  Description of Artificial Sequence: Synthetic coding sequence
atggcagcagtagtggtagccgccgctggcggagccggacccgcagtgctgcaagtagccgggctctatcgcgggctgtgcgctgtcagaagccgggctttgggcctaggcctggtcagtcccgcccaattaagagtcttccccgttcggcctggcagtggccgccctgaaggtggcgcggatagcagtggcgtgggcgccgaggccgagttacaggctaatccgttctacgaccggtacagagacaaaatccaactgctgagaagatccgaccccgctgcattcgaatctcgtcttgaaaagagatcagagttccggaagcagccagtggggcactccaggcagggcgactttatcaagtgcgtggagcaaaagaccgacgccctcggtaaacaaagtgttaatcgggggttcaccaaggataaaactttatcttccatcttcaatatagagatggtgaaagagaagacagctgaagagatcaagcaaatctggcagcagtacttcgcagccaaagacactgtgtatgcagtgatccccgccgagaagttcgatctgatatggaatagggcgcagagttgccctacaaacgtggcggaagctcagtgcatcgctaaccaggttcagctgttctacgctacagaccggaaggagacctacggtctcgttgaaacatttaacctcagaccaaacgagttcaagtacatgagcgtgatcgccgagcttgagcaatcagggttaggcgctgagttgaaatgcgcccagaaccaaaataaaacttag

SEQ ID NO: 24459 - DNA, 987 bp, Artificial Sequence
  Description of Artificial Sequence: Synthetic coding sequence
atggctgcagtcgtggttgcggccgcagggggtgctggacctgccgtgctgcaagtcgccggactttacaggggattgtgcgccgtcagatcccgggctttaggacttggactcgtctcgcctgctcaactgagggtttttccagtgcggcctggcagcggtcgtcccgagggcggtgccgattcttctggggtaggtgccgaagccgagctgcaggcaaatccattctatgaccggtaccgcgacaaaattcagttacttagacggtctgatcctgctgccttcgagtctaggttggagaaacggtcagaattcaggaaacaacccgttgggcacagcagacagggggatttcataaagtgcgttgagcagaagacagacgccttagggaagcagagcgttaatcgcgggttcacgaaggataaaaccctgagtagtatttttaacattgaaatggttaaggaaaaaaccgccgaagaaatcaagcagatctggcagcagtactttgctgccaaagacaccgtctatgccgtgatccccgcggagaagtttgatctgatctggaatagggcccagagctgtccgaccttcctatgcgctttaccacgccgggaggggtacgagtttttcgtgggccaatggaccggaaccgaactccacttcactgcacttataaatattcaaacacggggggaagcagctgcatcacagcttatcctttatcactaccccgagctaaaggaagagaagggcatcgtcctgatgaccgccgagatggacagtacattcctgaacgttgccgaagcccagtgcatcgccaaccaagtccagctcttttatgccaccgatagaaaggagacctacggtctcgttgagaccttcaatctgcggcccaatgagtttaagtatatgagcgttatcgccgaacttgagcaatctgggcttggcgcagaactaaagtgtgcccagaatcagaacaaaacttag

SEQ ID NO: 24460 - DNA, 723 bp, Artificial Sequence
  Description of Artificial Sequence: Synthetic coding sequence
atgagcgatccggcagcgtttgagtcccggcttgaaaagaggagcgaattccgcaagcaacctgttggacatagccggcagggggatttcatcaagtgcgtcgaacagaaaactgacgctctcggcaaacagtctgtgaacagaggctttaccaaggacaagacgctttcctccatcttcaatatcgaaatggtgaaggaaaaaacagcagaagagattaagcaaatatggcagcagtactttgctgccaaggacaccgtttatgcggttattccagctgagaaattcgacctgatttggaaccgagcccagagctgtccaacgttcctgtgtgctctgcctcgtcgcgagggatacgagttttttgtgggccagtggacgggtaccgagttgcacttcacggccctcataaacattcagacccgcggcgaggcagccgcctcccaacttattttgtaccactatccagaacttaaggaggagaaaggaatcgtgctgatgaccgcagagatggattctaccttccttaacgtagccgaggctcagtgcatcgccaatcaggtccagctgttctacgccactgatagaaaggagacctatgggcttgtggagacatttaatctgcggccaaacgagttcaagtacatgtcagtgatagccgagttagagcagtcaggtcttggagctgaattaaagtgtgcccagaaccagaacaaaacctag

SEQ ID NO: 24461 - DNA, 534 bp, Artificial Sequence
  Description of Artificial Sequence: Synthetic coding sequence
atggtaaaagaaaaaacagctgaagagattaagcaaatttggcagcagtactttgctgctaaagatacagtgtacgcagtgatccctgcagagaagttcgatctgatttggaacagggcccagtcttgtcctacctttctctgtgcactcccccgccgagaaggctacgagttctttgttggacagtggaccggcacagagcttcactttacagcactaattaacatacagacccgtggcgaggccgccgcctcacagctaattctttaccactatccagaactcaaggaggaaaaaggcatcgtattgatgaccgcggaaatggactcaactttcctgaacgtggccgaagcccagtgcatagccaatcaagtgcagctgttctacgccaccgacagaaaagaaacatatggactggtggaaacatttaacctgagacctaatgagttcaagtatatgtctgtgattgcagaactcgagcagtccggactaggggctgaactaaagtgcgctcaaaaccagaataaaacctag

SEQ ID NO: 24462 - DNA, 138 bp, Artificial Sequence
  Description of Artificial Sequence: Synthetic coding sequence
atgagcgacccagcagcgtttgagtccagattggagaagagaagcgagttccgtaaacagccagttggtcactccagacagggtgatttcatcaaatgcgtggagcaaaaagacggggcccaaaacaagctggtatag

SEQ ID NO: 24463 - DNA, 783 bp, Artificial Sequence
  Description of Artificial Sequence: Synthetic coding sequence
atggccgctgttgtcgtggccgctgcaggaggggcagggcctgcggtcttgcaggtagccggcctgtacagaggtctatgtgcagtacgctcacgcgccctgggcctgggactagtatcccctgcgcagcttcgggttttccccgtgcgcccaggcagtggcaggcccgagggtggagcagactctagcggcgttggagcggaggccgaactccaagccaacccattttatgacaggtatagggacaaaattcagctactcaggcggtctgacccagccgctttcgagtctagactggaaaagcggagcgaattccgaaaacaaccagtggggcactcacgccaaggcgattttataaagtgtgtggagcagaaaaccgacgcactgggtaaacaatccgttaacaggggcttcactaaggataagacactgagctccatcttcaacattgagatggtcaaggagaagacggccgaggaaatcaaacaaatttggcagcagtatttcgcggcaaaggatactgtttacgctgtgattccagcggaaaagttcgaccttatttggaaccgcgctcagtcgtgcccaactaatgtggctgaagcccagtgtatcgccaatcaggtccaacttttttatgctacagaccgcaaggaaacatacgggttggtcgagacttttaacttgagaccaaatgagttcaagtacatgagcgtaatcgccgaactggagcagagcggtctaggggcggaactaaagtgtgcccagaaccagaacaagacatag

SEQ ID NO: 24464 - DNA, 207 bp, Artificial Sequence
  Description of Artificial Sequence: Synthetic coding sequence
atgccccaactcaacactacagtgtggcctacgatgattactccaatgttgctcaccctgtttcttattacgcagcttaaaatgctcaacaccaactatcacttgccacccagtcctaagccaatgaaaatgaaaaattacaataaaccatgggagcctaagtggaccaagatttgctctcttcattctctgcccccccagtcttag

SEQ ID NO: 24465 - DNA, 642 bp, Artificial Sequence
  Description of Artificial Sequence: Synthetic coding sequence
atggcgccggctcagcggcccctgctgcctctgctgttacttttactacccctgccacctccaccctttgcacgcgccgaggacgctgcacgcgcaaattccgataggtacgctgtgtactggaatagatcaaacccgcgattccatgcaggcgctggcgacgacggcggtggctatacagtggaggtgagcataaacgattacctggacatctactgcccacattacggcgcgccgctgccccccgctgagcgaatggagcactatgtcctttatatggtcaacggtgaggggcatgcctcctgcgaccaccgacagcgcggcttcaagcgatgggagtgcaacagacccgcagcacccggaggcccactcaaattttcagaaaagtttcagctgttcacaccattctctctgggcttcgagttcagacctggacacgaatattactacatctccgcaaccccacccaacgcggtcgatagaccatgtcttcgactcaaagtgtacgtgcgcccgacaaatgagactctgtacgaagctccagagccaatcttcacaagcaacaactcttgttcaagtcccgggggctgccgactgttcctaagcactatccctgtactatggaccttactgggctcctag

SEQ ID NO: 24466 - DNA, 507 bp, Artificial Sequence
  Description of Artificial Sequence: Synthetic coding sequence
atgctgccggcagcactcctcagacgccctggcctcggtagattggttagacatgcacgggcctatgccgaggccgccgcggccccagccgccgcctcgggcccaaatcagatgagctttacctttgcaagcccaacccaggtgttcttcaacggggccaatgtgcggcaagtggacgtgccgacactgaccggcgctttcgggatcctggcagcccatgtgccaacccttcaagtcctccgtccaggactggtagtggtgcacgcagaggatgggactacaagcaaatattttgtgtctagtggctccattgctgtgaatgccgactcttcggtgcagctcttagctgaagaggcagtgacactcgatatgctggatctcggggccgctaaagcaaatctcgagaaggcacaggcagagctggtgggcacggctgatgaggccacacgggccgagattcagatcagaattgaggccaatgaagctttagttaaggcactggagtag

SEQ ID NO: 24467 - DNA, 156 bp, Artificial Sequence
  Description of Artificial Sequence: Synthetic coding sequence
atggttgcctattggagacaggccgggctcagttatattcggtactctcagatctgcgcaaaagtcgtgcgcgatgccttgaagactgagtttaaagctaacgccaagaaaaccagcgggaacagtgtgaagatcgtgaaggtgaagaaagagtag

SEQ ID NO: 24468 - DNA, 771 bp, Artificial Sequence
  Description of Artificial Sequence: Synthetic coding sequence
atgctgagcagagtagttctgtctgccgccgccacggcagccccctccctgaaaaatgctgctttcctcggaccaggagtgctccaagcaactagaacctttcacacagggcagccgcacctagtgcctgttcctcccttgccagagtatggcggaaaagttagatacggtctgatccccgaggaatttttccagtttctatatcccaaaactggtgtcaccggcccttatgtgttgggaactggcctcatattgtacgccctcagtaaggaaatttatgttatctctgccgagactttcactgccctgagcgtcctgggcgttatggtctatggcatcaaaaaatacgggccctttgtggccgactttgctgacaagctgaacgagcagaaactggcacagctggaagaagccaagcaggcatccatccaacatatccagaacgctattgataccgagaagtcccaacaggctctagtgcaaaagcggcactatctgtttgatgtacagagaaacaacatagctatggctctggaggtgacctatcgggaacgactctacagggtgtataaagaggttaagaacagacttgactatcatatttcggtccagaacatgatgagaaggaaagagcaggagcatatgattaactgggtggaaaaacacgtggttcaaagcatctcgacacagcaggagaaggagaccatagctaaatgcatcgccgatctcaagctgctggcaaaaaaagcacaagcccagccagtaatgtag

SEQ ID NO: 24469 - DNA, 588 bp, Artificial Sequence
  Description of Artificial Sequence: Synthetic coding sequence
atgttgagcagagtggtgctaagcgctgcggcgacagcaggcccgtacgtgctcggtacgggactaattctttacgctttatctaaagaaatctatgtcatcagcgctgagaccttcactgcgcttagcgtgctgggtgtgatggtgtacggaatcaagaagtatggcccgtttgtggccgattttgccgacaagctgaatgagcagaagcttgctcagctggaagaagccaaacaggcaagtattcaacatatacagaacgccattgacacggagaagagccaacaggctctggttcaaaaaaggcactatcttttcgatgtccagcgtaacaatattgcgatggccctggaggtgacataccgtgagcgcctgtacagagtttacaaggaggtgaaaaacagactggactaccacatctctgttcagaatatgatgcgtcgtaaggagcaggagcacatgatcaactgggtggagaaacatgttgtccagtctatatctacccagcaggagaaagaaacgatcgcaaaatgcatcgccgacctgaagcttctggccaagaaggcccaggcccaaccggtcatgtag

SEQ ID NO: 24470 - DNA, 486 bp, Artificial Sequence
  Description of Artificial Sequence: Synthetic coding sequence
atggccggacgaaagcttgctctgaaaacaattgattgggtagcctttgcggaaattataccccagaaccagaaggcaattgcctcctcactgaagtcatggaacgagaccctgacatctcggctagcggccctgcccgagaacccccccgcaatagattgggcctattacaaggccaatgtcgccaaggcaggactggtcgacgatttcgagaaaaaatttaatgctctgaaggttcccgttcccgaggacaaatatactgcacaagtggacgccgaggaaaaggaggacgtgaaaagctgtgcagaatgggtgagcctcagtaaggctagaattgtggaatacgagaaagagatggaaaaaatgaagaatttgattccattcgatcaaatgactattgaggacctaaatgaagcatttcctgaaaccaaactggacaagaagaagtacccatactggccccaccagccgatcgaaaacctctag

SEQ ID NO: 24471 - DNA, 414 bp, Artificial Sequence
  Description of Artificial Sequence: Synthetic coding sequence
atggccggccggaaactggcacttaagaccatcgactgggtggcgtttgcggagatcatcccccagaaccaaaaggccatcgccagttcattgaagtcttggaacgagactctgacatccaggttggcggctctgcctgaaaatccccccgctatcgactgggcctattataaggctaacgtggctaaagccggactggtcgatgactttgaaaaaaaggtgaaaagttgcgcggaatgggtctccctttccaaggcaaggatagtggaatatgaaaaagaaatggaaaagatgaaaaatctgataccctttgatcaaatgactatcgaggatttgaacgaggccttcccggaaaccaagctcgataaaaagaagtatccctattggcctcaccagcctattgaaaacctgtag

SEQ ID NO: 24472 - DNA, 309 bp, Artificial Sequence
  Description of Artificial Sequence: Synthetic coding sequence
atggcgggtcgaaagttagcccttaaaactatcgactgggtggcctttgccgagatcattcctcagaaccagaaggcgatagccagttcacttaaatcttggaacgagacacttaccagccggctggcagccctccctgagaatccccccgctatcgactgggcgtactacaaagcaaatgtagcaaaggccgggctggtagatgatttcgaaaagaaattcaacgctcttaaagtaccggtgcctgaagataagtatactgcgcaggtggatgccgaagagaaggaagacaagaagaagaagaaatag

SEQ ID NO: 24473 - DNA, 285 bp, Artificial Sequence
  Description of Artificial Sequence: Synthetic coding sequence
atggcttccgtgggcgaatgccccgcacccgtgccggtgaaagataagaaattactggaggttaaactaggagagttaccttcttggatactgatgagagatttctcgccatcaggcattttcggggcctttcagcggggatactatcggtattataataagtatatcaatgtaaaaaagggctctatttccggtatcacaatggtgctcgcatgctacgtgctgttctcctactcctttagctataagcatctcaagcacgaaagactccgaaaatatcactag

SEQ ID NO: 24474 - DNA, 168 bp, Artificial Sequence
  Description of Artificial Sequence: Synthetic coding sequence
atggcgagtgtaggggaatgtccagctcccgtgccggtgaaagacaaaaagctgctagaagtgaaactgggcgaattgccctcctggatcctgatgcgagacttcagccccagtggtattttcggagcatttcagagggagcatgaacggctgagaaaatatcactag

SEQ ID NO: 24475 - DNA, 267 bp, Artificial Sequence
  Description of Artificial Sequence: Synthetic coding sequence
atggcgtcagttgtgcccgttaaagataaaaagcttctggaagtcaagctgggagagctgccatcctggattctgatgcgggacttttccccaagtggcatttttggagccttccagcgcggatactaccgctactacaacaagtatattaacgttaaaaagggcagcatatccggaataactatggtactggcatgttacgtgcttttctcctactcttttagctacaagcacctgaaacacgaaaggctaagaaaataccactag

SEQ ID NO: 24476 - DNA, 150 bp, Artificial Sequence
  Description of Artificial Sequence: Synthetic coding sequence
atggccagcgtggtgcccgtgaaggacaaaaagttgttggaagtcaagcttggcgagcttccctcgtggatcctcatgcgtgactttagcccatcaggcatctttggagcgttccagcgggagcacgagaggttgaggaagtatcactag

SEQ ID NO: 24477 - DNA, 267 bp, Artificial Sequence
  Description of Artificial Sequence: Synthetic coding sequence
atgagcagcaagctgcctgttaaagacaaaaagctgcttgaagttaaactgggggaactccccagttggatcctgatgagggatttttcccccagcgggatttttggagcctttcagaggggctattacagatattataataagtatatcaatgtcaaaaaaggcagcataagcgggatcactatggtgcttgcctgttacgtgctcttttcatactctttcagttacaaacacctgaagcacgaaaggctgaggaagtaccattag

SEQ ID NO: 24478 - DNA, 312 bp, Artificial Sequence
  Description of Artificial Sequence: Synthetic coding sequence
atggctcagtttgttagaaatttagtcgaaaaaactccggcgctggtcaatgccgccgttacctatagcaagcctagactggcaaccttctggtactatgccaaggttgagcttgtgccacccactcccgccgagattcccagggccattcagtcccttaagaagattgtaaattccgctcagaccgggtcttttaaacagctgacggttaaagaggcggtgctgaatgggctggtcgcaacagaggtactgatgtggttctacgttggagagatcataggcaagaggggaatcattggatatgatgtgtag

SEQ ID NO: 24479 - DNA, 303 bp, Artificial Sequence
  Description of Artificial Sequence: Synthetic coding sequence
atggcgccatttgtgagaaatcttgtggagaagactccagcccttgtcaatgccgccgtgacataccttaaacctcggctggcagctttttggtattacaccacagtcgagcttgtgcccccaacgcctgctgaaattcctcgggcgatacagtcactgaaaaagatagtgtcatcggcgcagaccggttctttcaagcaattaactgtgaaggaggccttacttaatgggctcgtggccacagaggtctccacctggttttacgtcagagaaatcactggtaaacgtggaatcattggatag

SEQ ID NO: 24480 - DNA, 648 bp, Artificial Sequence
  Description of Artificial Sequence: Synthetic coding sequence
atgtgctgtgctgtgagtgagcagagattaacatgcgcggaccagatgatgccttttgggaagatttcccagcagttgtgcggagtgaagaagctgccatggtcttgtgactcccgttacttctggggatggctcaatgctgtgtttaataaagtggactacgaccgaattcgcgacgtggggccagatcgcgctgccagcgagtggttactccgatgcggcgcaatggtccggtaccacggccaggagcgctggcaaaaggattataaccatcttcccaccggaccattggacaagtacaaaatacaggcaatcgacgctacggacagttgcattatgtcaatagggtttgatcacatggaagggctagagcacgtggaaaagattagactgtgcaaatgccactacatcgaggatgactgcctcctgaggctgtcccaacttgaaaatttgcaaaaaacaatactggagatggaaattattagctgcggcaatatcaccgataagggaataattgccctgagacacctacggaaccttaagtacctactcctttcagatctacccggagtgagagagaaggaaaacctagtgcaagcctttaaaactgcccttcctagcttggaactcaaactacagctgaagtag

SEQ ID NO: 24481 - DNA, 801 bp, Artificial Sequence
  Description of Artificial Sequence: Synthetic coding sequence
atgattcgcggatctggtgccgaggcatgcagcaacgaagacgggtgctcggagaaaggtatgaagggtgtggattacgaccgtatacgggacgtgggtccagatcgagcggcttccgaatggctactcagatgtggagcaatggtgcggtaccatggccaggaacgctggcagaaagactataatcacttacctacaggccctctggataagtacaagatccaggccattgacgcgacagattcttgtatcatgtctattgggtttgaccacatggaaggactcgaacatgtggagaagatccgattatgcaaatgccactatatcgaggatgattgtcttctccggcttagtcagctggagaacttacagaagaccatcctggagatggaaattattagctgcggtaatataaccgataaaggcatcatcgctctgcggcacttacggaacttgaagtatcttctgctgagcgacctgcctggggccggaaaccccggaccctgcgttgcaagcggctcttctcgcacacgggcaccactggggttcagggagcgcggattgcaggaaaccgatgtccccggcgcactggtcgaccgaagctacgatttgagcccgtcagccggaatgcgaatgctggaacttaaggccacaaccgccattttaaagagtcggtttcagttatcagttccaggcggcagtttgctattcaaacagagtccagtcggtcatagttctattagcttttggccttacaaggcaatactgcgtcagtcacgcgccggcgataaccaggaatag

SEQ ID NO: 24482 - DNA, 444 bp, Artificial Sequence
  Description of Artificial Sequence: Synthetic coding sequence
atggcagggaggggcaagttgattgctgtcattggcgatgaggataccgtgaccggcttcttacttgggggtattggggagctgaataaaaataggcaccccaactttctcgttgtggaaaaggataccaccattaatgagatcgaggacacatttaggtcccttggaagtttgccgggctccgtggtggaggccaacccaaatcagagggacccccctctctgggacgagatcgattcacgtcaattcctgaaccgcgacgatataggtattattctcatcaaccagtatatcgccgagatggtgcgtcatgcgctggacgcgcaccaacagagtataccagcggtgttagaaatcccaagtaaggaacatccatatgacgcagcaaaggattccattctccgcagggcccgggggatgttcactgccgaggatttgcgttag

SEQ ID NO: 24483 - DNA, 321 bp, Artificial Sequence
  Description of Artificial Sequence: Synthetic coding sequence
atggccgtgactgctttggctgcaaggacttggctgggcgtgtggggcgtgcggactatgcaggcaagaggcttcggatccgaccaatccgagaatgtggatcgaggtgcagggtctattcgtgaagctggtggtgcattcgggaagcgagagcaggccgaggaggagcggtactttcgggcacagtcaagagagcagctggctgcactgaaaaagcatcatgaagaggaaatagttcatcacaaaaaagagattgaacgcttgcagaaagagattgaacgccacaaacagaagattaagatgctgaagcacgacgactag

SEQ ID NO: 24484 - DNA, 183 bp, Artificial Sequence
  Description of Artificial Sequence: Synthetic coding sequence
atggctgtaactgccctggctgccaggacttggctgggagtgtggggtgtcaggacaatgcaggcccgtggctttggcagcgatcagtcggagaatgtggatcgtggggctggttcaatacgtgaagcgggcggcgcttttggtaagagggaacaggccgaggaagagagatatttccgatag

SEQ ID NO: 24485 - DNA, 216 bp, Artificial Sequence
  Description of Artificial Sequence: Synthetic coding sequence
atggccgtgactgcccttgccgcccggacatggctcggggtgtggggcgttcgcacgatgcaggctcgaggctttgggagtgatcaaagtgagaatgtggatcgaggagctggttcaattcgcgaggccgggggagccttcggcaaacgggagcaggctgaggaggagagatatttccgccactacaggctgtgttttgaaatctcattggggtag

SEQ ID NO: 24486 - DNA, 3261 bp, Artificial Sequence
  Description of Artificial Sequence: Synthetic coding sequence
atggagaagtgggaggaactgaattctcaccagccaggcgaagagtacgatccctctaaggcaaccttcgttaaggtggtgccaacccccaataatgggtctactgaactggtggccctccacagaaacgaaggtgaggacggattagaagtgctgtcatttgaatttcagaagattaaatatagctacgatgcactggagaagaagcagttcctgcccgtagcctttcctgtcggcaatgcattcagctattatcaatctaataggggcttccaggaagactctgagataagagccgcagagaagaagttcggttctaacaaagccgaaatggtcgtgccggatttttcagagctcttcaaggagagagccactgctccgttttttgttttccaggttttctgcgttgggctttggtgcctcgatgagtattggtattacagcgtgtttacattgtctatgcttgtagcttttgaggcctctctagtgcagcaacagatgagaaacatgagcgaaattaggaagatgggcaacaaacctcacatgatccaggtttaccggtcccggaagtggcgccccattgccagcgatgagatcgtgcccggcgatatagtttccataggtcgttctccgcaggaaaacctagtcccttgcgatgtgctgctgttgcggggccggtgtatcgtcgatgaagccatgttgaccggcgaatcagtgccccagatgaaggagccaatcgaagacctgtcccccgatcgagttttagatctccaggctgacagcagacttcacgtgatctttgggggaacgaaggtggttcagcacataccaccccagaaagccactaccggtctcaaacctgttgatagcggatgtgtcgcctacgtgctgaggaccgggtttaacacaagccagggcaaactgctccgaaccattctgttcggcgtcaaaagagttacagccaacaatcttgagacgttcatcttcattctattcctcttggtattcgccattgcagctgccgcatacgtgtggatcgaaggcacaaaggacccatcccggaatcggtacaagctgttccttgaatgcacactgatccttacctctgtagtcccacccgaactgcccatagagctgagtctggctgtcaacacgtcactgatcgccttggccaagctctacatgtattgtacagaaccttttaggattcctttcgcaggaaaggtagaagtgtgttgctttgacaagaccggtactttgactagcgacagcctcgtggtgcgcggcgtggccggtttacgggatggcaaggaagtgacccctgtgagttctatacccgtggagacccatagagccctggcctcatgtcacagcttgatgcagcttgatgacggaacgttggtaggagatccactagaaaaagccatgttgacagccgttgactggaccctcactaaggatgaaaaagtatttcctcgatctataaaaacgcaagggctgaagatccatcagcgcttccatttcgcatctgcactcaaaagaatgagcgtgttagccagttatgagaagctgggaagcactgacctctgctacatcgctgctgttaagggcgccccagaaactctgcactccatgttctcacagtgtccaccagactaccaccacatccatacagagatttctagggagggggcccgggttctggccctgggctacaaagagctgggtcacctgactcaccaacaggccagagaagtcaaacgcgaggcattagaatgctcattgaagttcgtgggtttcatcgtggtctcttgccccttgaaagccgacagtaaagccgttatccgtgagattcagaacgcttcacatagagtcgtgatgatcactggcgacaaccctcttacggcctgtcatgtcgcccaggagctgcactttatcgagaaagcccacaccttaatactccagcctccaagcgaaaagggaagacagtgtgagtggcgctctattgacggcagtatagtgttgccattagccagaggctcgcccaaggctctcgccctcgagtacgctctttgcctgaccggagacggattagcgcatttacaggctactgacccacagcagctactgagactaatccctcacgtacaggtcttcgcgagagtggctcctaaacagaaggaattcgtcattactagtctcaaagaactgggttacgtgacactcatgtgcggtgacgggacaaacgatgtgggcgcactcaagcatgctgatgtgggtgtcgcgctgctcgccaatgctccagagcgtgttgtggagaggagaaggcgtcctagggatagtccgacactcagcaattcgggaatacgtgcaacttcccgcaccgcaaagcagcggagtggactgcccccctcggaggaacagccaacttctcagagggaccggctttcacaagttctgcgcgaccttgaggatgagtctacaccaatcgttaaactcggtgacgcttcaatcgcggcacccttcaccagcaaacttagcagtattcagtgtatttgtcatgtcatcaaacagggccgctgcaccctggtcactaccctccagatgtttaagattctggcacttaacgcattgatcctggcgtattcccagtccgttctatacctagaaggagttaaattcagcgattttcaggcaacactgcagggcctgttattagccggatgtttcctttttatcagtcgaagcaaacccctgaagacgctgagccgcgaacgcccgctacctaacatattcaatctttataccattctgaccgtaatgctccaattttttgtacatttcctgtccttggtatatctttaccgcgaggcacaagcccgtagtccggagaagcaggaacagtttgtagacctgtacaaggagtttgagccaagtctggtcaactccaccgtctacattatggccatggcgatgcagatggcaacattcgctattaactataaggggccccccttcatggagtctcttcccgagaacaaaccactcgtctggagcctggctgtgtccctgctggctattatcggcttgttgctaggcagttcacccgacttcaactcacagtttggcttggtggatattccagtcgaattcaagctcgtaatcgcacaagtccttttgctagatttctgcttggctctgcttgcggatcgtgtacttcagttttttctgggtaccccaaaattaaaggtcccttcttag

SEQ ID NO: 24487 - DNA, 3615 bp, Artificial Sequence
  Description of Artificial Sequence: Synthetic coding sequence
atggctgctgctgcagcagtgggaaatgcggtgccttgtggcgcacggccctgcggtgttagaccggatggccagccaaaacccggaccccagccccgcgctttgttagctgccggccctgccttgatcgctaatggtgacgagctggtggctgctgtttggccctaccgccggttggcattgcttaggcggctgacggttcttcccttcgccgggcttctctatccagcctggctcggtgccgccgccgccggctgctggggatggggctccagctgggttcaaatacctgaggctgccctgctcgtattagcaaccatctgtctggcccatgccctgaccgtcctgagcggccactggtcagttcatgcccattgcgcgctcacatgcacgcccgagtacgacccgtcaaaagccactttcgtaaaagtagtgccaacaccaaacaacggaagtactgagctggtggccttgcatcggaatgagggcgaggacggacttgaggtgctgtctttcgaatttcagaagattaaatactcttacgatgcactggaaaaaaagcaattccttcctgtcgctttccccgtcgggaatgccttctcctactaccaatccaaccggggatttcaagaggattctgaaatccgggctgccgagaagaagtttggttctaataaagcggagatggtggtgcccgatttttccgagctgtttaaagagagggctaccgctcctttttttgtatttcaagtgttctgtgtgggtctctggtgtctcgacgagtactggtattactccgtctttactctcagcatgttggttgcctttgaagccagtcttgtgcaacagcaaatgaggaacatgagcgagattaggaagatgggcaataagccacacatgatccaggtttacaggtcccgtaaatggagacctatcgcttcagatgaaattgtcccaggggatatcgtgagcataggccgctcaccgcaggagaatctcgtgccttgcgacgtgctcctgctccgcggaaggtgtatcgtggatgaggcaatgctaaccggcgagtccgtgccacagatgaaagaacccatcgaagacctgagccctgacagggtgctggacctgcaggctgatagccgcctgcacgtgatttttggaggaactaaggtcgtccagcacatacccccacagaaagctactacggggctgaagcctgtagatagcggctgtgtggcttatgtcctgcgcaccggcttcaatacatcccaaggtaaactgctgaggacaatcctgtttggcgtcaaacgggtgacagcaaataacctggaaacattcatctttatcctgttccttctcgtgttcgcgattgcagctgctgcttatgtatggattgagggcactaaggacccaagcaggaatcgatataagctcttcctcgagtgtactctgattctgacaagcgtggtgccacctgagcttcccattgagttaagtctcgccgtcaatacgtccctcattgctctcgcgaagttgtacatgtactgtacagagccgttccgaattccgtttgctggaaaggtcgaggtgtgctgtttcgataaaacaggcacactgacatcagatagcttagttgttcgaggcgtcgccggcctacgagacggcaaagaagtgactccggtatcaagtatacccgtggaaactcatcgtgccctcgcaagttgtcactcactcatgcaactggatgatggaaccctggtgggcgacccattagagaaagcaatgctgaccgcggtggactggacactgacaaaggatgagaaagtgttcccccggagcattaaaacacagggcctgaagatccatcagagattccactttgccagcgcacttaagagaatgagcgtgctggcgagttatgagaaactgggatccactgacttgtgctacatagccgccgtgaagggggccccggagactctgcactccatgttcagccaatgcccccccgactatcatcacattcacaccgagatcagtcgagaaggggctagggtgctggctctgggttacaaggaactcggtcacctgacccaccagcaggctcgagaggtgaaaagagaggctctggaatgttcgttaaaatttgtcggttttattgtagtctcttgcccccttaaggccgatagcaaggcggtcatccgtgaaatccagaatgctagtcaccgcgttgtgatgatcaccggtgataatcccttgacagcatgtcatgtcgcacaggaattacacttcatcgagaaagcacacacactgatattgcagcccccgtccgagaagggcaggcaatgtgaatggagatccatagacggtagcatcgtacttcccctggcgaggggcagtccaaaagcattagctcttgaatatgccctgtgtctgaccggggatggcctggcccacttacaggcgaccgacccacaacaactcttgagattaatccctcatgtccaggtgtttgcccgcgtagcacctaagcagaaggaatttgtgattacaagcctaaaagaattaggctatgtgaccttaatgtgtggcgatggaaccaatgatgtgggtgcacttaagcacgccgatgtgggcgtcgccctgttggctaacgcccccgagcgagttgtagagcgacgtagacgcccccgcgattccccaaccctgtccaattctggtatccgcgccacgagcagaaccgccaagcagagatcaggtttacccccaagcgaagagcagccaacgagtcagcgcgaccgtctaagccaggtactacgcgatctggaagatgagtccacaccgatcgtgaagctgggggacgcctccattgccgcaccattcaccagcaagctgagctcgatccagtgtatctgccacgtgattaaacagggcaggtgcacgttagtgactacattgcaaatgtttaaaatccttgctttgaacgcacttatcctcgcatactcacagtccgtgctgtatctcgaaggggtgaagttttctgatttccaagccactctgcagggcctgctcttggccgggtgtttcctgttcatctcacggtctaagcctctgaagaccctgagtcgggagcgacccctgcccaatattttcaatctttacacaattttgaccgtgatgcttcagttttttgtccacttcttatcattggtctacctctaccgagaagcccaggcaagatcccccgaaaaacaggaacagtttgtggacctgtataaggaatttgagccaagtctggtgaactctacagtctacattatggcaatggctatgcagatggctacctttgccattaattataagggtcctccatttatggaatcccttccagagaataagccgctcgtttggtccttggccgtctcccttttggccatcatcggcctgctactcggctcgagtcctgatttcaatagtcagtttggtctggtggacattccggtcgagtttaagttggtcattgctcaggtgctgcttctggatttttgtctcgccctactggcagacagggtgcttcagttcttcttagggactccgaagcttaaagtgccatcatag

SEQ ID NO: 24488 - DNA, 3681 bp, Artificial Sequence
  Description of Artificial Sequence: Synthetic coding sequence
atggatagagaggaacgtaaaacaataaatcagggacaggaggatgagatggaaatttatgggtacaacctgagcagatggaagcttgccatcgtgtcattaggggttatctgttccggtggcttcctgctgctgttactttattggatgcccgaatggcgggtgaaggccacttgcgtgcgggcagccatcaaagactgcgaggtcgtcttgctgagaacaacagatgaattcaaaatgtggttttgcgccaaaattcgcgtgctttccctagaaacgtatcctgtgtcttcacctaagtctatgtctaataaactgtctaatggacatgcagtctgcctgatcgagaatccaaccgaggagaaccgccacaggatcagcaagtactctcagactgagagccagcagattcgctatttcacccaccacagtgtcaagtacttctggaatgacacaatccataactttgatttcctcaaaggacttgacgaaggggtgtcatgcacatctatctatgaaaagcactccgccggattgacaaaaggtatgcatgcctatcgcaagctgctttacggggtcaatgagatcgccgttaaagtcccttctgtgttcaagctgttgataaaggaggttttgaaccctttctacatcttccagctgtttagcgtgatcctgtggagtaccgatgagtactactattacgccttggctatcgtcgtgatgagcatcgtaagcattgtgtcttcactgtattccatccgtaagcagtacgtcatgctccacgatatggtcgccacacactccactgtccgcgtatcagtttgcagggtgaatgaggagattgaagaaatcttttctacggacttggtcccaggggacgtgatggtgattccactcaacgggaccatcatgccatgtgacgctgtgctgataaacggcacttgcatcgttaacgagtccatgcttaccggagagagcgtacccgtcactaaaactaatctgccgaatccatcagtagacgtcaaaggaataggggacgagctctataatcccgaaacgcataagcgccatacattgttttgtggtacaactgttatccagactcgcttctacacaggcgaacttgtcaaagccatcgtggtgcggaccgggttttctaccagtaagggccagctggttcggagcatattgtacccgaagccgacagatttcaagctgtacagggacgcatatctgttcctcttgtgtttggtcgctgtggccggaataggcttcatttacaccatcatcaactccattctgaatgaggtgcaggttggagtcatcattatcgagagcctggacataattacaatcacagtgcctccagccttacctgcggccatgaccgccggcattgtatacgcccagcggaggctgaagaaaatagggatcttttgtatttcgccacagcgtataaatatttgcggccagctgaacctagtttgtttcgataagacaggcactcttaccgaggatggactggatctctggggcatacaaagagtagaaaatgctaggttcctttctcctgaggaaaatgtctgcaatgaaatgttggtaaaatcacagtttgtggcgtgcatggctacgtgtcattcactgaccaaaatcgaaggagtcctcagcggcgaccctctggatctgaaaatgttcgaagctatcggttggatactggaggaggccacagaagaggagactgctttgcacaacaggataatgcctactgtggtgagaccaccaaaacagctactgcccgaaagtacccccgcaggcaaccaagaaatggaattgttcgaattgccagcaacctacgagatcggcatcgtacgccaatttccattttcctcagccttgcaaaggatgtcggtagttgcacgagtcttgggggacaggaagatggatgcatacatgaagggcgcgcctgaggctatcgctgggctctgtaagcccgagacagtgcccgttgactttcaaaatgtgctggaggacttcaccaaacagggattccgtgtgattgccttagcccatcgcaaactggaaagcaagctcacttggcacaaggtgcagaacatatcacgggatgctatagaaaacaatatggactttatgggtctgattattatgcagaacaaattgaagcaagagaccccggccgtgttggaggatctccacaaagccaacatcagaacagtaatggttactggcgacagcatgctcaccgccgtttccgtggctagggattgcggaatgattcttccccaagataaggtcataatcgccgaagcactccctcccaaagatggcaaggtcgcgaaaattaactggcattacgccgatagcctgacacaatgttcacaccctagtgcgattgaccctgaagctatccctgtgaagctagtccatgatagcctcgaggatctgcaaatgacccggtaccatttcgcaatgaacgggaagtcctttagtgtaatcctggagcacttccaggatcttgtacccaaactgatgctccacgggacggtctttgctcgtatggcgcccgaccagaaaacccaattaatcgaggccctccaaaatgtggactactttgtcggaatgtgcggcgacggcgcaaatgactgtggcgccctgaagagagcgcatggaggcatcagtttaagtgaactggaggcatctgtggcctccccttttactagcaagacaccatctatttcttgtgtccctaacctcataagagagggtagggccgccctaataacttccttctgtgtatttaagttcatggcattatactctatcatccaatatttttcagtgactttactctactccatcctgagcaatttaggcgactttcagttcctgtttatcgacctcgccatcattctcgttgtagtcttcacaatgagcctcaatccagcttggaaagaactcgtcgcacagaggcctcctagtgggctcatttctggcgccctccttttttctgtgctgtctcagatcatcatctgcatagggtttcaatccttgggcttcttctgggtgaaacagcagccttggtatgaggtatggcaccctaaaagcgacgcctgcaacacaaccggctcaggcttctggaattccagccatgtggataacgaaaccgagctggatgagcacaatatccagaactacgagaacacaacggtattctttattagtagctttcagtacttaattgtggcaatcgccttctccaaaggaaaaccatttagacagccatgctataagaactatttcttcgttttcagtgttatcttcctatacatcttcatcctttttatcatgctgtatcccgttgcgtccgttgaccaggtcctgcagatcgtgtgtgtgccttatcagtggcgcgtgacaatgctaattatcgtcctcgtcaatgcatttgtttccataacggtagaagagagtgtggataggtggggcaaatgctgcctaccatgggctttgggctgtcgaaaaaagactccgaaggccaaatatatgtatttggctcaggaacttctcgtagaccctgaatggccacccaagccacagactacaacggaggctaaagcactcgtgaaagagaatgggtcttgccagataatcaccattacatag

SEQ ID NO: 24489 - DNA, 2151 bp, Artificial Sequence
  Description of Artificial Sequence: Synthetic coding sequence
atggttgctacacattccactgtgagggtcagcgtttgcagagtgaatgaagaaatcgaggaaatattttccaccgatctggtgccgggcgatgtgatggttatccctttaaacggtactatcatgccttgtgacgcagtcttgataaacgggacgtgcattgtcaacgagtccatgcttactggagagtctgttccggtgacgaagacaaatctgcctaacccttctgtggatgttaaagggatcggagatgaactgtacaatccggagacccataagaggcataccctcttttgtggcactacagtgattcagacccggttttacacaggggagttggtcaaggccatcgtggtgaggaccgggttttctaccagcaagggacagttggtgcgctcaattctgtatccgaagcccaccgatttcaaactctaccgcgacgcttatttgtttctgctctgccttgtggctgtggccgggattgggtttatatacacaattattaacagcattctgaacgaagtgcaagtcggcgtgatcataatcgagtccctggatattattacaattacagtcccacccgcattgccagccgctatgaccgccggaatcgtgtacgcccagagacgactaaagaaaattgggattttctgtattagcccccagcgaataaacatttgtggacagctcaacttggtatgttttgacaagacaggaactcttacagaggatggcctcgatctgtggggaatccaacgggtcgagaacgcccgattcttatcccccgaagagaacgtatgtaacgaaatgctcgtgaaaagtcaattcgtggcatgcatggcaacttgccattctttgacaaagattgaaggggtcctgtccggggatccacttgatctgaaaatgttcgaagccatcggatggatcctggaggaagccaccgaggaggaaactgctctacataacagaatcatgccaacggtcgtgaggccaccaaagcagttgctcccggagtccaccccggctggcaaccaggagatggaactgttcgaattgccagcaacctacgagatcggtatcgtaaggcagtttccgttttcatctgcattacagaggatgtctgtcgtggctagggtcctcggagatagaaagatggatgcatatatgaaaggtgctcctgaggctatcgcgggtctttgtaagcctgaaactgtccctgtcgattttcagaatgtactggaggactttactaagcaggggttcagagtgattgcccttgcacaccgcaagctcgaatctaaacttacctggcataaggtgcaaaacatctcccgtgacgccattgagaacaacatggactttatgggcctgataattatgcaaaataaactgaaacaggagacaccggccgtcctggaagacctgcataaggctaatattaggactgtgatggtcaccggggattccatgctgacagccgtgagcgttgcaagagattgtggtatgatcctgcctcaggataaagtgatcatcgctgaggccctgcccccaaaagatggaaaggtagctaaaatcaactggcactatgccgattctctaactcagtgctcacatccctctgccatagatcctgaagcgattcctgttaaactggtacacgactctctggaagacttgcaaatgacacggtaccacttcgcaatgaatggaaagtcgttctctgtgattctggagcactttcaggacctggtacctaagctcatgctgcatggtaccgtgtttgccagaatggcaccagatcaaaagacccagctcattgaggcgttgcaaaatgttgattacttcgtgggaatgtgcggcgacggggccaatgactgtggggcgctgaaaagggcccacgggggcatttctctgtccgagctcgaagcctcagtcgccagtccatttacttccaagacaccctccatttcctgtgtaccgaacctgattagggaggggagggcggctcttattacttcattctgcgaactggccctattcagcattgtgacatattctttagatcacttcattatctccattcttatcagtaacatgctggtcctgttcttttccgattttcacaattgtgctttttattcactggtctag

SEQ ID NO: 24490 - DNA, 3681 bp, Artificial Sequence
  Description of Artificial Sequence: Synthetic coding sequence
atggatagagaggagagaaagaccatcaatcaaggccaagaagacgaaatggagatatacggatataacctctcccgttggaaacttgcaattgtctcgctgggagtgatctgctctggagggtttctgcttctgctgctctactggatgccagaatggcgtgtgaaggccacctgcgtgagagccgctatcaaagactgcgaagtggtgctcctgcgaacaaccgatgagtttaagatgtggttttgtgccaaaataagagttctctcgctggaaacctaccccgtgtctagtccgaagtctatgagtaataaactgtcgaacggacacgccgtctgtctgattgagaaccccaccgaggagaacagacaccggatctccaagtatagccaaaccgaatcccagcagattagatattttacacaccacagtgtgaaatacttttggaatgataccatacataattttgacttcttaaaaggactggacgaaggagtgtcttgcacctcgatctacgaaaagcacagcgcgggccttactaagggtatgcacgcctaccggaagttgttgtatggggttaacgaaattgccgtaaaagtccccagcgtttttaagctgctgattaaagaggttttaaatcccttctacatattccaactgttcagcgtgatcctgtggtccactgatgagtactactattacgccctggccattgtggtgatgtctatcgttagcatcgtttcttctctctactctattcgtaagcaatacgtgatgttgcacgacatggtggccacccactcgactgttagagtgtcagtgtgccgagtcaatgaggaaatcgaagaaatattctcaactgacctggtccccggagacgttatggttattcctcttaatgggacaattatgccatgcgatgcagtgttgattaatgggacctgtattgtgaatgagagcatgctcacaggcgagtccgtgcccgtgactaagactaacctccctaacccctccgtggacgtcaaggggattggtgatgaattatacaaccctgagacccataaaagacatacgctgttctgtgggaccaccgtgatccagactaggttttacactggggaactcgttaaagcaatcgtcgtaaggactggcttcagcacgtcgaaaggacagctggtacggagcattctttaccccaaacccaccgactttaagctgtaccgggatgcttatctatttttgctctgtctcgtggcagttgctggcatcggttttatctatactataattaatagcatactcaacgaagttcaggtcggggtgatcatcatcgagtctctggacataataaccatcaccgtccctcctgcgctgccagctgcgatgactgccggcatcgtgtacgcccaaaggcgactaaaaaaaattggcattttttgtattagccctcagcgcattaatatctgcggacaactcaatcttgtctgtttcgataaaaccggcactctcacagaggacggactggatctttgggggatacagcgggttgagaacgctcgattcctgtcccctgaggagaacgtctgcaatgagatgctagtaaaaagtcagttcgtagcctgcatggctacatgtcacagtctgaccaagatagagggagtcctgtctggagatccgctcgacctgaagatgttcgaggcaattggttggatcctggaggaagctacggaggaagagaccgctttgcataatcgcataatgccaaccgttgtgaggccacctaaacaactgctgccggagagcacacctgccggcaaccaggaaatggagctcttcgaactgcctgccacctacgagattggaatcgtcagacaatttccgttcagctctgcactgcagaggatgagcgtggtcgcacgcgtcctgggcgaccgaaagatggatgcttacatgaaaggcgctccggaagccatcgctgggctctgtaaacctgagacagtgccagtggatttccagaatgtgcttgaagatttcaccaagcagggttttagagttatcgccctggcccaccgcaagctggagagcaaactcacctggcataaggtccaaaatatctcaagagacgccatagaaaataacatggacttcatggggctcataattatgcagaacaagttaaaacaggaaacacctgccgtgttagaagatttacataaggctaatatccggacagttatggttacaggagactcaatgcttaccgctgtcagcgtcgctcgagattgcgggatgatcctcccccaggataaggtgattattgcggaagccttaccccctaaagatgggaaggtagcgaagataaattggcactatgcggatagcctcactcagtgctcacaccctagcgctatcgatcctgaggcaattccagtcaagcttgtacacgactctttggaagacctgcagatgactcggtaccattttgcgatgaacggaaagtcatttagtgtaatccttgagcactttcaggaccttgtgcccaaactaatgctgcatggcacagtcttcgccagaatggcaccagatcaaaagacccagttaatcgaggccctccagaacgtggattattttgtggggatgtgtggcgatggtgcgaatgattgtggagctttgaagcgggcccatggcgggatctcccttagcgaactggaagccagcgtggcttcaccttttacttctaaaactccttcaatttcctgtgtgcctaacctcatcagagagggacgggccgctctgatcactagtttctgtgtcttcaaatttatggctttatatagcatcatccagtatttctctgtcactctgctttacagcatcctttctaatttaggtgattttcaatttttatttattgatttggccataatcctggtagtcgtgtttactatgtccttaaacccggcctggaaggaacttgtcgcgcagcggcctccttcaggactcataagtggcgctctactctttagcgtcttgagtcaaattattatttgtatcggattccaaagtctcggtttcttttgggtgaaacagcagccttggtatgaggtgtggcatcccaaatctgacgcgtgtaatacaaccggatctggcttctggaattcctcacacgtagataatgaaacagagctggacgaacataatattcagaactacgaaaacacaacagtgttctttatttcttcgtttcaatacctgatcgtcgccatcgcgttttctaagggtaaaccgtttaggcagccctgctacaagaactattttttcgtcttttcagtgatcttcctgtacatatttatattgttcattatgctctatcctgtcgcctctgtggaccaggtgcttcagatcgtttgcgtgccttatcagtggagagtaacaatgctgattatagttcttgtgaacgccttcgtgtccataacggtggaggaatccgtcgaccgctggggcaagtgttgtctgccatgggccctcgggtgtagaaagaagactcccaaagctaaatatatgtacctggctcaagaactgctcgtggaccctgagtggcctccaaagccacagacgaccaccgaagccaaagctcttgtaaaggaaaacggttcctgtcagatcatcacgatcacttag

SEQ ID NO: 24491 - DNA, 144 bp, Artificial Sequence
  Description of Artificial Sequence: Synthetic coding sequence
atggaccgggaggaacggaagaccatcaaccagggacaagaggacgagatggaaatttatggatataacctgagcagatggaagcttgccatcgtcagcctaggtgttatttgctcagggggattcctgctgctgctgctgtag

SEQ ID NO: 24492 - DNA, 312 bp, Artificial Sequence
  Description of Artificial Sequence: Synthetic coding sequence
atggaccgcgaagagcggaaaacaattaatcagggtcaggaggacgaaatggagatctacggctacaacctatcgcgttggaagctcgccattgtgtcactcggggtcatctgttccggggggtttttgctgcttctactgtactggatgccggagtggagagtgaaagccacttgtgtccgcgctgcgatcaaggactgtgaggtggtgcttctccgaactactgatgagttcaagatgtggttctgtgctaaaatcagggtcctgtctcttgagacctaccctgtgtcaagcccaaaaagtatgagctag

SEQ ID NO: 24493 - DNA, 1731 bp, Artificial Sequence
  Description of Artificial Sequence: Synthetic coding sequence
atgggccattttgaaaaaggtcagcatgccctgctcaatgagggcgaggagaacgaaatggaaatttttgggtataggacccaggggtgcagaaagtcattatgcctggcgggctccattttttcctttggcattctccccctggtcttctactggcgcccagcctggcacgtgtgggcccactgcgtgccctgttctcttcaggaagcagatacagtcctactgcgtaccaccgacgaatttcagatttattcctggaagaaagtgatatggatttatctgtcagcattaaacagtgcctttggcctgacacccgatcaccctctcatgaccgacgaggaatacattattaatcgagctatccggaagcccgatttgaaggtaaggtgcatcaaagtgcagaagattcgctacgtgtggaattatctagaggggcagtttcagaaaattgggtcactggaggattggctctcctctgccaagatccatcaaaagttcggcagcggacttaccagggaggagcaggagatcaggcggcttatttgcggtccaaacactatcgacgtggaagtgacgcctatctggaaactgctgatcaaggaggttctcaacccattctatatctttcagctcttttctgtgtgcttgtggttcagtgaggattacaaggagtacgccttcgccatcattattatgagtattatatcgatctccttgaccgtttatgatctgcgggaacagtctgtgaaactccaccatttagtggaaagtcataactccattaccgtttctgtatgtggacggaaagccggggtccaggaactagaatcacgcgtgctcgtcccaggagatctgctcatcctaactgggaacaaggtcctgatgccctgcgatgcagtactcattgagggctcctgcgtggtcgatgagggcatgctaacaggtgagagcattcccgtgaccaagacccccttgccaaagatggacagttcggtgccatggaaaacacagtcggaggccgactataaaagacacgtactgttttgtggcactgaagtgatccaggctaaggccgcctgctccggcactgtgagggccgtggtgttacagacaggatttaacacggccaaaggtgacctcgtacggtccatcctctatccgaaacccgtaaacttccagctgtatagagatgcgatccggtttctgctgtgtcttgttggcacggccacaatcggcatgatttacacattgtgcgtttatgttctttcaggcgagccacccgaggaagtagtgcgtaaggccttggacgtcatcactatcgctgtgcctcccgcactcccagccgccttgaccacggggatcatatacgcccagaggaggctgaagaagagggggatcttctgtatatcaccccaacggataaatgtttgcggacagctgaacctcgtctgcttcgacaaaactggcactctaacacgggatgggttggatttgtggggtgtggtatcctgcgacaggaatgggtttcaggaagtacactcctttgccagcggacaggccctgccttgggggccattatgtgccgccatggcctcatgccattcactgatactgttagacggcaccatccagggtgacccactcgacttgaagatgtttgaggccactacctgggtgtccctgtgcagctcagagaacctacggagcttttttaatgctagggctacctag

SEQ ID NO: 24494 - DNA, 3591 bp, Artificial Sequence
  Description of Artificial Sequence: Synthetic coding sequence
atggggcactttgagaagggccaacatgctctgttgaacgagggcgaagagaatgaaatggaaatattcggttaccggacccagggttgcaggaaaagtctttgcttagccggctccatcttttccttcggtatactcccgctggttttttactggcgtcccgcttggcatgtctgggcccactgtgtgccatgttcattgcaggaggctgataccgtcctcctgaggactaccgacgagttccaaatttattcttggaagaaggttatctggatttacctgagcgcattgaattctgctttcggcctaacgcccgatcacccgctcatgacagatgaagagtatatcattaatcgtgctattcgcaagcctgatcttaaggttaggtgcattaaggtacagaagatacgctatgtgtggaattacctagagggtcagtttcagaagataggcagcctcgaggactggttgagcagtgcaaagatacatcagaagtttggttctggccttacacgagaagaacaagagatacgccggctcatctgtgggccaaatacaatcgacgtagaggtcacgccaatttggaagctgcttatcaaggaggtcctgaatcccttctatattttccagctgttttccgtctgcctttggttcagcgaggactataaagaatacgcctttgccatcatcattatgtctatcattagcatcagtctcacagtttacgatctacgggaacagtctgttaagctgcaccacttagtcgaatcacataacagtataactgtgtccgtctgcggtcgcaaggcaggtgttcaagagctggagagcagagtgctggtccctggagacctccttatcctgactgggaataaggtgctgatgccctgcgatgcagtgctgattgaggggtcgtgtgtcgtggacgagggcatgctcactggtgaatccatccccgtaactaaaacacccttgccaaagatggatagttccgtgccttggaaaacacagtccgaggcagattataaacgacacgtgctattctgcggcactgaggtgattcaggcaaaagccgcgtgctctggaacagtgcgcgctgtggtgctccagaccggcttcaatactgctaaaggcgatttggtgagaagcattctatatcctaaaccagtcaatttccagctttaccgcgatgcaattcgatttctgctgtgtttagttggcaccgcgacaataggaatgatttatacactttgtgtgtacgttctgtcgggagagcctcctgaggaagtggtacgaaaagccttggacgtgatcactatagccgtgccccccgccctgccagcggccctgaccaccggcataatatacgcccagcgcaggctcaagaagagaggcatattttgcatttcccctcagaggatcaatgtatgcgggcagctgaatcttgtgtgtttcgataaaacaggtactctcacccgtgatggcctagacctgtggggagttgtgagctgtgatagaaatggatttcaggaggtccattcgtttgcatcaggccaagccctgccctggggacccctgtgcgcggctatggcgtcatgtcacagcttgatactcttggacggcaccatacagggtgatccgctcgatttaaagatgttcgaggccaccacatgggaaatggcctttagcggagatgatttccacatcaaaggagtgcccgcgcatgctatggtagtcaaaccttgtagaaccgcgagccaggttcccgtcgagggaatagctatcctccatcagttcccatttagtagtgctctacagcggatgaccgtgatcgttcaggagatggggggcgaccgcctagcctttatgaagggcgcacctgagagagtagcttccttctgccagcctgaaactgttcccacatcattcgtaagcgagctccagatttacactacccaaggtttcagggtgatcgcattagcttataaaaagcttgagaatgaccatcacgctacaactttgacaagggagaccgtggagagcgatctaatttttttgggactgcttattctcgagaatcggttgaaggaggagactaaacctgtgctggaagagttaatctcagcaagaatcaggactgttatgattacaggggacaacctacagactgctattactgtagcacgaaagtccggaatggtctctgaaagccagaaggtgattctgattgaagccaacgagaccaccggctcatcaagcgcctccattagctggacattagtcgaagaaaaaaaacatatcatgtacggaaatcaggacaattacatcaacatcagggacgaggtcagtgataaaggaagggagggctcctatcacttcgctctgaccggtaagtccttccacgtgatcagtcagcattttagttctctcctgcctaagattctcataaatggcacaatctttgcaagaatgagccccggccaaaaaagctcgctggtggaggagtttcaaaagcttgactattttgttggaatgtgtggagacggcgctaatgattgcggggcactcaaaatggcacacgtgggcattagcctatcagaacaggaagcatccgtggcatcaccctttactagcaagaccccgaacatagaatgcgtcccacatcttataaaggaagggcgcgcagccctggtgacatctttctgtatgttcaagtatatggccctttactcaatgatccagtacgtaggggtgctgctcttatactgggagactaacagcctgtctaattaccagttcctttttcaggacctcgctattactacactaataggcgtgaccatgaacctgaatggggcttatccaaagcttgtccctttccgacctgcgggcagactcatctcccccccactcctcctctccgtcatatttaacattctactctcccttgccatgcacatcgcagggtttatcctggtccagcgacagccatggtactctgtggagattcacagtgcctgtacagtccagaacgagtcaatttctgaactgacaatgtcaccaaccgcaccagagaagatggaaagcaacagcacattcacctctttcgagaacactactgtctggtttttgggcacgatcaactgcattaccgttgcgcttgttttttcaaaaggaaaaccattccggcagcctacttataccaactatatctttgtactggtgttaattattcagctaggggtgtgcctgtttattctgtttgctgacattccagagctgtaccggagactcgacctcttgtgcactccagtgctctggcgagcatcaatcgtgatcatgcttagtctgaatttcatcgtgagtctggtggctgaggaggccgtgattgagaatagggctctgtggatgatgatcaagcggtgtttcggttaccagagtaagtctcaatatcggatatggcagcgcgaccttgccaacgatccaagttggccaccattgaaccagactagccacagtgatatgcctgaatgcggtcggggggtgagctatagtaatccggtatttgagtccaatgaggagcagctttag

SEQ ID NO: 24495 - DNA, 639 bp, Artificial Sequence
  Description of Artificial Sequence: Synthetic coding sequence
atgcacattgctggttttatactggtccagaggcagccctggtacagtgtggagattcattctgcctgcacggtgcaaaatgagtccatctccgagcttactatgtcgccaactgccccagaaaagatggagagcaactctacttttacttcttttgagaacaccactgtttggtttctgggaacaataaactgcatcactgtggccctagtattttccaagggaaagcctttccgccagccaacctacacgaattacatctttgttttggttttgatcatccagttgggcgtgtgccttttcatcctctttgctgatatccctgaactgtaccggagactggacctgctctgtactcctgtgctctggcgagcatccatcgtaattatgttaagcctcaatttcatagtctcattagtggccgaagaggccgtgatcgaaaaccgggccctttggatgatgatcaagcgctgtttcggctatcagagtaaatctcagtatcggatctggcaacgcgacctcgctaatgacccaagttggcccccattgaaccagactagccatagtgacatgccagagtgcggacgaggcgtcagttactctaaccctgtcttcgagtctaatgaggagcagctttag

SEQ ID NO: 24496 - DNA, 3657 bp, Artificial Sequence
  Description of Artificial Sequence: Synthetic coding sequence
atggaggagaactcaaagaaagatcatagggcgctcctgaatcagggggaagaagatgaattggaagtgtttggatatagagatcacaatgtgcgcaaagccttttgcctcgttgcttccgtgctgacgtgtgggggcctgcttctggtgttttactggcggcctcagtggcgtgtgtgggctaactgcatcccctgtccacttcaggaagcggacactgtgctgcttagaaccaccgatgagttccagagatatatgcggaaaaaggtgttttgcctgtacctctcaactcttaaattcccagtgtctaaaaagtgggaagagtcgctcgtcgcagaccgccattccgtgatcaatcaggcactaattaaacctgagctgaagctccgttgtatggaggttcagaagatccggtacgtgtggaatgatctggagaagcgatttcagaaggtcggtctgctagaagactcaaatagctgctcagacattcatcaaacgttcggactgggcttgaccagcgaagagcaggaggtccggaggttggtgtgtggccctaacgccatcgaggtcgagatccagcccatctggaaactattagtgaaacaggtactgaacccattctatgtattccaagcattcacactcactttatggttgtctcaaggttacatcgagtactccgtcgccattattattcttacagtgatcagcattgtgcttagcgtgtacgatcttaggcagcagagtgttaagttgcacaatctggttgaggatcataataaagtccaggtcacgattattgtcaaggataaaggtttggaagagctggaaagtagacttctggtccccggcgatattcttattttaccaggcaaattttctctaccttgcgacgccgtcctgatagacgggtcttgcgtggtgaatgaggggatgttaaccggcgagtccatcccggtcaccaaaacgcctctccctcaaatggaaaacacgatgccatggaagtgtcatagcctggaggattataggaaacacgtgctgttttgtggtacagaggtcattcaggttaagcctagcgggcagggccccgtgcgggctgtcgtgctgcaaacgggctacaatacagcaaaaggcgatttggtgcggagtattctgtaccccagacccctcaacttcaaactttactctgacgcattcaagtttattgtctttttggcatgtctgggcgttatgggattcttttatgccctgggggtgtatatgtaccacggggtgccaccgaaggacaccgtcacaatggctctcatattactcaccgttactgtgccccctgtcctgcctgccgccctaacgatcggcaatgtctacgcccaaaagaggctgaaaaagaagaagatattctgtatctctccacagcgcatcaacatgtgtgggcagatcaatctcgtgtgcttcgataagaccgggaccctaactgaggatggcctggatctttggggcacagtgccaaccgccgataattgttttcaggaggctcattcattcgccagtggccaggctgtgccttggagtccactgtgtgccgccatggcctcttgtcacagccttatcctgctgaatggtacgatccagggggatccgctggatctcaagatgtttgaagggactgcctggaagatggaagattgcatcgtagatagctgtaaattcgggacttccgtgagtaatattatcaagcctggacccaaggcaagcaagtcccctgtggaagccattataaccttgtgccagttccctttctcctcgagcttgcagcggatgagcgtgattgcccaactggcgggagagaaccatttccacgtgtacatgaaaggcgctcctgaaatggtcgcccgattctgcaggagcgagaccgtacctaagaactttccacaggagcttaggtcttatactgtacagggattcagagttatcgctctcgctcataagaccctcaagatgggtaatctctctgaggtggaacatctcgcacgcgagaaagtcgagtcagaattaacatttttaggcctgcttataatggaaaaccgcctgaagaaggagactaaactagtcctgaaggagcttagtgaagcacgtatcagaacagtcatgatcacgggggacaacctacagacagccataacagttgctaagaattccgaaatgatccccccaggctctcaagtgatcatagtggaagctgacgagccagaggaatttgtgccggcgagcgttacctggcaattggtggaaaatcaggaaaccggtcccggaaaaaaggagatctacatgcatactgggaactcttctactccaagaggcgagggagggtcctgctatcattttgccatgtccggaaaatcctaccaagtcatcttccagcatttcaattctcttctccccaagattctggtgaatggcaccgtcttcgcacggatgtccccgggacagaaatcatcactgattgaggaatttcagaagctgaactattatgtgggcatgtgcggggatggggcaaatgactgtggcgctctgaaggccgcacacgcaggcatctccctaagcgagcaggaagcctccgtggcatctccttttacgtctaagacaacaaacatccaatgcgtgccccacctaatccgcgaggggcgggccgctctggtgtcctcctttggtgtgttcaaatacctgaccatgtacggtataattcaatttatctctgcgctgctcctatactggcagcttcagctgttcgggaactaccagtacctgatgcaagacgtcgctatcacactgatggtgtgccttaccatgagtagcacacatgcataccccaagctggccccatatcgccctgctgggcagctcctctcaccaccgctcctcttgtcaattttcctgaatagctgctttagttgtattgtgcagatttctgcgttcctctacgtgaaacaacagccatggtactgtgaagtgtaccagtacagcgagtgcttccttgcgaaccaaagcaatttttccacaaatgtgtctcttgagcgtaattggacgggaaacgctaccctgattcctgggtccatcctcagctttgaaacgactacactttggccaatcaccaccatcaattacattacagtcgcttttatttttagtaaaggcaaaccatttcgtaagcctatatacaccaactacatcttctcctttctgctcttagctgctctcggcctgaccatattcatacttttctcagacttccaggtgatctataggggaatggaattaatccctactattacctcctggcgggtgcttatacttgtggtggccctgacacagttctgcgtggccttttttgtggaagattcaatccttcaaaaccatgagctgtggctactgataaagcgggagttcggcttttatagcaaatcccagtatcgcacttggcagaaaaagctcgcagaagattccacatggcccccaatcaatcgcactgactacagcggagacggtaagaatgggttctatattaacgggggctacgagtctcacgaacagattcccaagagaaaactcaagctaggcgggcagccaaccgagcaacacttttgggcgcgattgtag

SEQ ID NO: 24497 - DNA, 3450 bp, Artificial Sequence
  Description of Artificial Sequence: Synthetic coding sequence
atgccgacaatgaggcgcactgtttctgagatccgctccagagccgaaggttacgaaaaaactgacgacgttagcgaaaaaacctccctcgcggaccaggaagaagtccgtaccatcttcatcaatcagccccaactgactaaattctgcaataaccacgtatccaccgcaaagtacaacatcataacttttttgcccagatttctctatagtcagttcagacgagccgccaatagtttctttctttttatcgcgctgttgcagcagatccccgatgtgtcgcccacaggtcgatatactaccttggtgccgctcctgtttatcctcgcggtggctgccattaaggaaatcatcgaagatataaaaaggcacaaggcagataatgcggttaacaagaagcagactcaagtgctgaggaatggcgcatgggagattgtgcactgggagaaggttaacgtaggggacatcgtcattatcaaaggcaaagagtacataccagccgatacggtacttttgagctcaagtgagccacaagccatgtgctacattgagacctctaacctcgatggcgaaacaaatctcaaaattagacaggggctgccagccacctcagatatcaaggatgtggacagcctgatgaggatttccggccgaattgagtgtgagtcacccaatcgccatctgtacgattttgtgggtaacattagactggacggacatggcacagtgcccctgggcgctgatcagatcttgcttagaggcgcccaactgcgtaacactcagtgggtgcatgggatcgtggtgtacaccggccacgacactaagctcatgcagaacagcacctccccccccttgaaactatctaatgtagagcggattaccaacgtgcagatcctcatcctcttctgcatactgattgctatgtcattagtctgctcagttggttcagccatctggaaccgacgccactcaggcaaagattggtacctcaacttgaactacggcggtgctagcaactttggccttaatttcttgacattcataattctgttcaacaatctgattcccatctcattactggtcactttagaggttgtaaaattcacacaggcctactttattaactgggatctggatatgcactatgagcctactgacactgccgctatggccagaaccagcaacttgaacgaggaactagggcaggtgaaatacatcttctcagataaaacaggcaccctgacatgtaacgtaatgcagtttaagaagtgcaccatcgccggtgtggcctacggccagaatagccaattcggcgatgaaaaaaccttctccgacagtagtctgctcgagaacctgcaaaacaaccacccaaccgctcctatcatttgtgaattccttactatgatggctgtgtgccacactgctgttccagagcgtgagggtgacaaaatcatctaccaggctgcgagccccgacgagggcgctctggtgagggctgcaaagcaactaaatttcgtattcacggggaggacgcccgattccgtcattatcgacagcctgggtcaggaggaacgatacgagctacttaatgtgttagagtttactagtgcaaggaaaagaatgtcagtgattgtgcgaaccccctccggaaagctcaggctctattgcaagggggctgacacagtgatctacgataggctcgcggaaacttccaaatacaaagaaatcactttaaagcacctcgaacagttcgccacagagggattgcgaactctgtgctttgctgtggccgagattagcgagagcgacttccaagagtggagagctgtttaccagcgagcctcaacctccgtgcaaaataggctgctgaagctcgaagaaagttatgaattgatcgagaaaaacctgcagcttctgggggcaacagcaatcgaagacaaactacaggaccaggttcccgaaaccattgagactctgatgaaggcagatatcaagatctggattctgacaggcgacaaacaggagaccgcgatcaacattggccacagctgcaaattgctcaaaaagaacatgggtatgatcgtgattaatgaaggctcgctcgatggaaccagggaaacactttcacgacactgcacaactctaggtgacgccttgaggaaagagaacgatttcgcacttatcatagatggtaaaaccttaaaatacgcactcacgtttggcgtgcggcaatactttttggacctggcgttgtcatgcaaggccgtcatctgctgtcgagtctctccgctacagaagtcagaagtggtcgaaatggtaaaaaaacaggtgaaagtcgtaacattggctatcggagatggggcgaacgatgtctctatgattcagacggcccacgtgggagtcggcatttccggtaacgaagggttgcaggctgctaactcgagcgattattctattgcccagttcaagtatctgaagaatctgttgatgatccatggtgcatggaattacaatcgagtttcaaagtgcatcctttactgcttctataagaatatcgtgttatacataatcgagatctggttcgcgttcgtgaatgggttctctggccaaatcctatttgagcggtggtgtattggcttgtacaatgttatgttcacagccatgcccccgctcacactgggaatttttgaaaggagctgtagaaaagagaacatgctgaagtaccctgagctgtacaaaacttcccaaaatgccctggatttcaatactaaggtgttctgggtacactgcttgaatggactgtttcacagcgtcattctgttttggtttccgctcaaggctctccagtatggcacggccttcggcaacggtaagacttcagattatttactcctgggtaattttgtatatacgtttgtggtaatcactgtgtgtctcaaagccggtctggagacctcatactggacctggttctcccacatcgccatatggggctccatagcgctgtgggtagtgttctttggtatttattcatcattgtggcctgcaattcctatggccccggacatgagcggagaggcagccatgcttttcagttccggagtattctggatgggtcttttgttcatccctgtggcctccctgctgttggacgttgtttacaaggtgatcaagcggacagcctttaaaacattagttgacgaggtccaagaactggaggccaagtctcaggatcccggggctgtcgtactcggcaagagcctcaccgaacgtgcccagctgctcaagaatgtattcaaaaaaaaccatgtgaacctgtacagatcagaaagtctgcagcaaaatttattgcatgggtacgccttctcacaggacgaaaacggaatcgtgagccagagtgaggtcattagagcatatgacaccacgaaacagcgcccagatgagtggtag

SEQ ID NO: 24498 - DNA, 3495 bp, Artificial Sequence
  Description of Artificial Sequence: Synthetic coding sequence
atgccaactatgagacggactgtgtccgaaattcggtcccgcgcggaaggatatgaaaagacagatgacgtgtcagagaaaacatccctcgccgaccaggaggaggtgcggacaatcttcattaatcagccccagctgacaaagttctgcaacaaccatgtgagcaccgccaaatataatatcattacattcctgcctcggttcttatactctcagtttagacgggcagcaaactccttcttcctgttcattgcattgctccagcaaatcccagacgtgtctcctaccgggcggtatacaaccctcgtaccactcctcttcattctggccgtggctgccattaaagagatcattgaagatatcaagaggcataaggcggacaatgcagtgaacaagaagcagacacaggtgctgcgaaacggtgcctgggagatagtccactgggaaaaagtggccgtgggcgaaatagtaaaggttacaaatggcgaacacttgcctgcagacctcatttccttaagtagtagcgaacctcaggcaatgtgttatatcgaaacctcaaaccttgacggagaaacgaacttgaagatacggcaaggcctccccgcgacttctgatataaaagacgtcgattccttgatgcgcatctccgggcgaatcgagtgtgagtcccccaacagacatctttacgacttcgttggcaatatcagattagatgggcacggtacagtccctctgggtgccgaccagatattattgcggggagcgcagttgcgcaacactcagtgggttcatgggattgtagtctataccgggcacgacaccaaacttatgcagaacagcacttcacctcccttgaagctgagtaacgttgagcgtatcaccaatgtacagatcctgatcctgttctgcattctcattgccatgtcactggtttgcagtgtggggagcgcaatttggaatcgcagacacagcgggaaagactggtaccttaacctgaattacgggggcgcgtcaaacttcggactgaattttctcacatttatcattctcttcaacaacctaatcccaatcagtctcctagtgactcttgaggtagtgaagttcacccaggcctattttataaattgggacctggatatgcactacgagcccactgatacagcagctatggctagaacgagcaacctgaatgaggaacttggacaggttaagtacatatttagcgataagacaggcacgttaacttgcaatgtgatgcagttcaagaagtgcacaatcgcaggagtcgcatacggccatgtccctgaaccagaggactatggctgttccccggacgagtggcaaaacagccagtttggcgacgaaaaaacattttccgactcatctctgctcgagaacctacagaataaccatccaacagccccgattatttgtgagtttctcactatgatggccgtgtgccatacagcagttcccgaaagagagggtgataagatcatataccaagcagcatctccagatgagggcgcattagtcagagctgccaagcaactgaactttgtgtttaccggaagaactccagatagcgtcataatcgactctttgggccaggaggagcggtatgagttactcaacgtattggaattcacatccgcccgcaagagaatgtctgttatcgttcgcactccctctgggaagcttagactatactgcaagggcgccgataccgttatctacgacagacttgccgaaacctccaagtataaagagattacgctcaaacacctcgaacagtttgctaccgaaggtctgagaaccctgtgttttgcagtagccgagatttcggaatccgactttcaggagtggagagcagtctatcagagggcctctacgtctgtacaaaacaggttgctgaaattggaagagagttacgagctgatcgagaaaaatcttcaattgctgggagccacagctattgaggataagctacaagaccaggttcccgaaacgatcgagacgcttatgaaggctgatatcaagatttggatcctgacaggagataagcaggaaaccgcgattaatatcggacatagttgcaaattgctcaaaaaaaacatgggtatgattgtgattaacgaggggtccctggacggtacccgcgagactttgtcccggcactgcactactctgggcgacgccctgaggaaagagaacgactttgccctcatcattgacggtaaaacactgaagtacgcacttacattcggcgttcggcagtacttcctggacctggccttgtcctgtaaggctgtgatctgttgcagagttagtcctttgcagaagtcggaggttgtggaaatggtaaagaagcaggtaaaggttgttaccttagccattggagacggtgctaatgatgtgagcatgattcagacagcacacgtgggagttggcatttcaggcaacgaaggtctgcaggctgccaatagttccgactacagcatagcccagttcaaatatctgaagaatctgctgatgatccacggagcatggaactacaaccgcgtgtctaagtgtatcttgtactgcttttacaaaaacatcgtgctctatataatcgagatctggtttgccttcgtcaacggctttagcggccagattcttttcgaaaggtggtgtatcgggctgtataacgttatgttcacagctatgccacccctcacattggggatctttgaacgctcctgccgcaaagagaacatgctgaagtaccccgagctctacaagacttctcagaacgcacttgacttcaacactaaggtattttgggtgcactgtctcaatggccttttccactcagtaatcctgttttggttccccctcaaagccctgcagtatggtaccgccttcggtaatggaaagacttctgactatctcctgctgggcaatttcgtgtataccttcgtggtaattaccgtgtgccttaaagctgggctggagacttcttattggacatggttctcgcatatagctatttggggctctattgccctgtgggttgttttctttggaatctattcaagcctctggcccgcgataccaatggctccggacatgtctggagaagcagccatgctctttagcagcggagttttctggatggggcttttgtttattccggttgcaagcctgctcctggacgtcgtttacaaggttattaagcgcaccgcctttaagaccctggtggatgaagtgcaggagcttgaggctaagtctcaagacccaggagcggtggtgctaggtaagtcgctgaccgagagggcccagttactgaagaatgtgttcaaaaagaatcatgtaaacctgtacagatctgaatcgctacagcagaacctcctacacggatacgcattctcgcaggatgagaacgggatcgtgtctcaaagcgaagtgataagagcctacgatacaaccaaacagagacctgatgagtggtag

SEQ ID NO: 24499 - DNA, 3579 bp, Artificial Sequence
  Description of Artificial Sequence: Synthetic coding sequence
atgttttgcagcgagaagaagctgcgagaagtggagagaattgtgaaggccaatgatcgtgagtacaacgaaaagttccagtatgccgacaacagaatacataccagcaagtataatatattgacttttttgccaatcaatcttttcgagcagttccagagagtggccaatgcttacttcctttgcctgctcattttgcagctgataccagagatttcttctctgacgtggttcacaacaatcgtccctctcgttctcgttattacaatgaccgccgtcaaggatgcaacagatgactacttcagacacaagagcgacaaccaggtgaataatcggcagtccgaagtcctcattaattcgaagttacagaatgagaagtggatgaatgtgaaggtcggcgacatcatcaagctggagaacaatcagttcgtcgccgctgatcttctgttactctcatctagtgagccgcatgggctgtgctatgtggaaacagccgaactagacggggaaaccaatctgaaggtcaggcacgcactctctgtcacgagtgaactcggggctgatatatctaggctcgcaggctttgacggaattgtcgtttgtgaggttccgaacaacaagctggacaagttcatgggtatcctgtcgtggaaggattctaagcactctctgaataacgagaaaattattctacgtgggtgtatcctgaggaatacaagctggtgctttggtatggtgatcttcgccggccccgatacaaaactgatgcaaaacagtggcaaaacaaagttcaaaaggacgtccatagacagactgatgaatactttggttctttggatttttggcttccttatttgtctgggaattatcttagccatcgggaacagtatatgggagagccagaccggtgaccaattcaggactttccttttttggaacgaaggagagaagagttccgtcttctctgggtttttaacgttttggagctatatcatcatcctgaacaccgttgttcctatttcgctctatgtgtctgtggaggtgatacgactaggacacagctactttatcaattgggacagaaagatgtattactctaggaaggctatacccgccgtagcacgaaccaccacactgaacgaggagctgggccagatcgaatacattttttccgataagacaggcactttgactcagaacattatgacatttaagcggtgctcaatcaacggacgcatctatggcgaagtgcacgatgatctcgaccaaaaaaccgaaatcacccaagagaaggagccagtggacttctctgttaagtcacaagcggatcgagagttccagtttttcgatcatcatttgatggagtccatcaaaatgggggaccccaaggtgcacgagtttctcagactccttgcactctgtcacaccgtgatgtcggaggagaattccgccggcgaactgatataccaggtgcagagtccggacgaaggggccctggtaactgcggcccggaattttgggtttatcttcaagtcccggacccccgagactattaccatcgaggaactcgggaccctggtcacctatcagcttctggccttccttgacttcaacaatacgaggaagcgaatgtctgtcattgtaaggaacccagaagggcaaatcaaactgtacagcaagggggcagacacaattctgttcgaaaaactccatccttctaatgaggtgcttctgagcttgacaagcgatcacctttcagaatttgctggtgagggattgcgcaccctagcaattgcttatcgcgacttggatgacaaatacttcaaagagtggcacaagatgttggaagacgccaacgccgccactgaggaaagagatgagaggattgctggactctacgaggaaatagaacgggacctcatgctgctgggagctacagcagtcgaggacaagttgcaggaaggcgtgatagaaaccgtgaccagcctgagcctagccaatattaagatctgggtgttaacgggtgataagcaagagactgccatcaatattggttatgcctgtaacatgctgactgatgatatgaacgacgtgttcgtgatagcaggtaacaatgccgtcgaggttagagaggagcttaggaaggccaagcagaatctctttggacagaatagaaacttctctaacggacacgtggtctgtgagaagaagcagcagttagagctagattcaatagtggaggaaacaattaccggggactatgctttaatcataaatggacactccctggcccacgcattagaatctgatgtgaaaaacgaccttcttgaactggcctgtatgtgtaagacagtgatctgctgtcgggtcactccgttgcagaaggctcaggtggttgagcttgtaaagaaatatcggaacgcggtgaccctggctattggggatggagcgaatgacgtgagtatgatcaaatctgctcatatcggggtggggatatccgggcaagaaggacttcaggcggtactcgcatcggactactctttcgcccaattcaggtatctgcagcggctcttgctcgtgcacggacggtggagctactttcgaatgtgcaagtttctctgctattttttttataagaactttgcatttaccctggtgcacttttggtttggattcttctgtgggttcagtgcccagaccgtgtacgaccagtggttcattacactgtttaacatagtgtatacgtccctgcctgtgctagccatgggtatattcgaccaggacgtgagcgaccagaattctgtggactgcccccagctctataagcctggtcagctgaacctcctttttaacaaacgtaaattcttcatctgtgtgctgcacggcatctacacctcgcttgtgttattctttatcccgtacggcgctttctataacgtcgccggcgaagacggccagcatatcgccgactaccagtcttttgctgtgaccatggccacctcactggtgatagtggtgtccgtccagatagctttggacaccagctattggacgtttatcaaccacgtgttcatctggggaagcatcgctatttatttctccatcctattcacaatgcacagtaacggtatttttggcattttccccaatcagtttccgtttgtaggtaatgcgcggcatagtctcacacagaaatgtatctggttggtcattttgctgaccacagtggcaagcgtcatgcctgtggtcgcttttcggtttctaaaagtcgacctctacccgacgcttagcgaccagatcagaagatggcagaaggcacagaaaaaggcgcggcccccttcctccaggagacctcgtacaagaaggtcttcttcacgtcggagcgggtacgctttcgcccatcaggaagggtatggggaactgattacctcgggcaaaaacatgagggctaaaaatcccccacccacctccgggctagagaaaacacattacaactcaacttcctggatcgaaaacctttgcaaaaagaccacagatactgtgagtagtttcagccaggacaagactgttaagctatag

SEQ ID NO: 24500 - DNA, 162 bp, Artificial Sequence
  Description of Artificial Sequence: Synthetic coding sequence
atgttttgcagtgagaagaaactgcgggaggtcgagcggatcgtcaaagccaatgaccgggagtacaacgagaagttccagtatgccgacaatcgtatccacacctctaagtacaacatcctaacattccttccgatcaacttatttgagcagttccagtag

SEQ ID NO: 24501 - DNA, 3579 bp, Artificial Sequence
  Description of Artificial Sequence: Synthetic coding sequence
atgttctgctctgaaaagaagctgagagaagtcgagcgtatagtgaaggccaacgaccgtgaatacaatgagaagttccagtacgccgacaacaggatccacacttctaaatataatatcttaacctttttgcccataaaccttttcgaacagttccagcgcgtcgcaaatgcttactttctctgccttcttatcctgcagctgattccagagattagctccttaacatggtttactacaatcgtgcctctggtcctggtgataacaatgacggccgtgaaagatgcaaccgacgattacttccgccataaatccgacaaccaagttaataatcggcagtctgaggtgctgatcaatagtaagctgcagaatgagaagtggatgaacgtgaaggtgggcgatatcatcaagcttgaaaataatcagtttgtggctgccgacctcctccttctgtccagttctgagccacacggtctgtgttacgtggaaactgcggaacttgacggtgaaactaatctgaaggtgcggcacgccctgtccgttacgtccgaactcggcgctgatatcagccgcctggcgggctttgatggtatagtggtctgtgaggtgcccaataacaaacttgataaatttatggggatcctcagctggaaggattcgaagcattctctaaataacgagaaaattattctgcggggatgcatcctcaggaacacctcatggtgcttcggcatggtgatctttgccggacctgatacaaaactgatgcagaatagtggaaagaccaagtttaaacgcaccagtatagacagactgatgaataccttggtgctgtggatcttcggcttcctgatctgtcttggcatcatccttgcgattggcaacagcatatgggagagccagaccggcgaccagtttcggacttttttattctggaacgaaggggagaagagtagtgtcttcagcggcttcctcactttctggagctatattatcatcctcaacaccgtggttccaatttcattgtacgtaagcgtagaagttatccgactcggccattcatacttcatcaattgggatcgtaaaatgtactattcacgaaaagccataccagccgtggctcgaaccacaacactgaacgaagaactgggacagattgagtatatcttctcggataaaactgggaccctgacacagaacattatgacctttaaacgctgttcaataaacgggcgcatttatggtgaggtgcatgatgatctcgaccaaaaaactgaaatcactcaggagaaggagcctgttgacttctccgtgaaaagccaggcagatagagaatttcagttctttgaccaccacctgatggagtccatcaaaatgggagacccgaaagtccatgaattcctgcgcttattggctttatgtcacacagtgatgtcagaagagaactccgcaggagaattaatttatcaggtgcagtcccctgacgagggggctctcgtgacagctgctagaaattttggtttcatattcaagtctcggactcccgaaaccattacaattgaggagcttgggacactggttacataccagctgctggcctttctagattttaacaacactcgaaagagaatgtctgtgatcgtcagaaatcctgaggggcagattaaactctactccaagggggccgatactatactcttcgaaaagctccacccaagcaatgaggtgcttctgtccctgacctcagaccacttgagcgaattcgccggggaagggctcagaaccctggccatagcttatagggatttggacgataaatattttaaagaatggcacaagatgctcgaggacgctaatgccgctactgaggagagagacgaaagaatcgcggggctgtatgaagaaatagaaagggacctcatgctcctgggcgcaaccgcagtggaggataagcttcaggagggtgtcatcgagaccgtcacctcgctttccctcgccaatattaaaatctgggtgttaaccggagataagcaagagacagctataaacatcggttacgcttgcaacatgcttaccgacgacatgaatgacgtatttgtgatcgcgggcaacaatgccgttgaagtgcgggaggaattgagaaaggcaaagcagaatctattcggtcagaaccgaaacttctctaacggacacgtcgtctgcgagaagaaacagcagctcgaattggatagcattgtcgaggagacgattactggcgactatgctctgatcatcaacggccattctcttgctcacgccctggaatcggacgtgaagaacgaccttctggaactagcatgcatgtgcaaaacggttatatgttgcagagttacgccattgcagaaggcccaggtcgttgaattagtcaagaagtaccggaacgctgtcaccctggctatcggtgacggggccaatgacgttagtatgatcaaaagcgcacacatcggagtcggaatatccggccaagaggggctccaggccgttcttgccagcgactacagctttgcccagtttcgctatcttcaacggctcctgttggttcatgggcgttggagctattttcggatgtgtaagtttttatgctattttttttataagaacttcgcttttacccttgtgcacttttggtttggcttcttttgcggctttagcgcccagaccgtatatgaccagtggttcattacactgttcaacattgtgtatacctcgttgccagtgctagctatgggaatcttcgatcaggatgtgtctgaccagaacagcgtggactgtccccagctctataaacccggtcagctgaatcttctctttaataaaaggaaatttttcatctgtgtccttcatggaatttatacaagtcttgtccttttcttcattccctatggcgcattctacaacgtggccggtgaggacggccagcacattgccgactaccagagttttgcagtcaccatggccactagcctggtgatcgttgtgagcgtgcagattgctcttgatactagttactggactttcataaaccatgttttcatctggggctctatcgctatttattttagcatcctattcactatgcacagtaacgggatatttggtatcttccccaatcagttcccattcgtgggtaatgcaagacacagcctgacacagaaatgcatttggctggtcatcctgctgactaccgtcgcctcggtgatgccagtcgtagctttcaggtttctgaaagtcgacttgtatcctactctgagtgatcagatccgtaggtggcaaaaagcccagaagaaggctcgacccccaagttcacgtaggccaaggacccgcaggagttctagcaggcgttctgggtacgcatttgcacatcaggaaggctatggagagctaataacatctgggaagaatatgcgggccaaaaaccccccacctaccagcgggcttgagaagacccactacaactccacttcttggattgaaaacctctgcaagaagacaactgatactgtgtcgagttttagtcaagacaaaacagtgaagctgtag

SEQ ID NO: 24502 - DNA, 2736 bp, Artificial Sequence
  Description of Artificial Sequence: Synthetic coding sequence
atggactcgcggccacgcgcggggtgctgtgagtggctgcggtgctgcggcgggggagaggccagaccccggacagtgtggcttggccatcccgaaaaaagggatcagaggtatccccgcaacgtgataaacaaccagaaatacaactttttcacctttctgccaggagtgctgttcaaccaatttaaatatttcttcaatctgtatttcttgcttctcgcttgctcccagttcgtccccgagatgcgcctgggggccctttatacatattgggtgcctttgggattcgtgctagcagtgacagttatccgggaagccgttgaagagatccgctgctatgttagggataaagaggtgaactcacaagtatatagcagactgacagctaggggcactgtcgtgggcgttgttctgtatacaggccgggaattacggtcagtgatgaacacctcaaatcctagatcaaaaatcggtctgtttgaccttgaggtcaactgcttaactaagattttgttcggtgcactggtcgttgtgtcgctggtcatggtggccctccagcacttcgcaggccgctggtatttgcagattatacgatttcttctcctattttctaacatcatcccaattagcctgagagttaacctcgacatgggtaagatcgtttacagctgggtgatccgtagagactcaaaaattcctggaactgtcgtccgttcctccaccattcctgagcaactgggacggatctcctacctgctgaccgataaaacaggaaccctgacgcagaatgagatgatcttcaagcgtctccacttgggtacagtagcttacggactcgacagcatggatgaagtccaaagccacattttttccatctacactcagcagtcacaagaccctcccgcccagaaaggacccacactgacgactaaggttcgccggactatgtcctcgcgggtgcacgaagctgtgaaagccattgctctgtgtcacaacgttactcctgtgtacgagtccaacggagtgacggatcaggctgaagccgaaaagcagtatgaggatagctgtagggtttatcaagcttcctcccctgacgaggtggcactcgtacagtggaccgagtcggtgggcctgactctggtgggaagagatcagtccagcatgcaactgaggacacccggcgaccagatcctcaacttcaccattctacagattttcccgtttacatacgagagcaagcgtatgggtatcattgtccgtgacgaaagcacaggcgaaattactttctatatgaagggagccgatgtggttatggctggcatcgtgcagtacaacgattggttggaagaagaatgcggaaatatggcacgtgagggactgagagtgctggtggtggccaagaagagcctggcagaggaacaatatcaagattttgaggccaggtacgttcaggcgaagctgagcgtgcacgaccggtctctcaaggtggctacggtcattgagagcttggagatggagatggagctgctttgtctgacaggagtcgaagaccagttgcaagctgatgtgcgtccgactcttgagacacttagaaacgccgggatcaaagtttggatgctcacgggcgataaactagaaaccgccacttgtaccgccaaaaatgcacaccttgtaacaagaaatcaagacatccatgtattccgattggtgacaaatagaggcgaggctcatttggaactcaatgcttttcgtcgcaaacacgactgcgccctcgtaatatctggggactctctggaggtctgtctaaagtattacgaatacgagttcatggaactggcttgccagtgcccagccgtggtctgctgtcggtgtgcccccacacagaaggcgcagatcgtgcgacttctccaggaacgaaccggaaagctaacatgtgctgtgggggatggtggtaacgacgtgagcatgatccaggaaagcgattgtggcgtcggagtagaggggaaagaggggaagcaggcctcgttggccgcagatttctctattacgcagtttaagcacctcgggaggcttttgatggtccatggccgaaacagctataaacgaagcgccgctttgtcccagtttgtcattcaccggagtctttgtatctccacaatgcaggccgttttctctagtgtcttttattttgcctcagtccccctctatcagggatttctgatcatcggctattcaacaatctatacaatgtttcctgtgtttagcctcgtgttagacaaggatgtgaaaagcgaagtagccatgctttaccctgagctgtataaggatctgttgaagggaagacccctatcgtataaaacatttctgatctgggtgctgatcagtatttaccagggctcaaccattatgtatggcgcccttttgttgttcgaatcggagttcgtccacatagtggcaatctccttcaccagcctaattctcaccgagctcctgatggtggccctcaccatccagacttggcactggctgatgacagtggcagagctcttgtcacttgcctgttacattgccagcctggtctttttacacgagttcatcgatgtctattttatcgccaccctcagctttttatggaaagtgtccgtgattaccctagtgtcttgtttgcccttatacgtgttgaagtatctccggcggcgcttttccccccctagttactcaaagctaacctcttag

SEQ ID NO: 24503 - DNA, 3144 bp, Artificial Sequence
  Description of Artificial Sequence: Synthetic coding sequence
atgacggacaatatacccctgcagcccgtgagacaaaaaaagaggatggactcaagaccccgggccgggtgctgcgagtggctgcggtgctgtggaggcggtgaggcacgccccagaacggtgtggttagggcatcccgagaagcgcgaccagaggtatcctcggaatgtaatcaataatcaaaagtataattttttcacttttctgcctggggttctgtttaatcaatttaagtacttctttaacttatatttcctcctgctggcctgttcgcagttcgtcccggagatgcgactgggcgctttatatacttactgggtaccgctcgggttcgtactggctgtgacggtgatccgagaggctgtggaggagatccgctgctacgtcagagataaggaagtgaattctcaggtctacagcaggctaactgctagaggcacagtgaaggtcaaaagctcaaacatacaggtgggcgacctcatcatcgtggagaagaaccagagggtccccgccgacatgattttcctgcgcacctccgaaaagaatgggagttgtttcctccggacagatcaactcgatggcgaaacagactggaagctgcgcttgccagttgcatgtacccagagactgccaacagctgcagaccttctccagatccgcagttacgtgtacgctgaggagcccaacatcgatattcacaatttcgtcggcacctttaccagagaggactctgatccccctatcagtgagtcgctgagtattgagaacaccttatgggctgggaccgttgtcgcctctggcaccgtagtgggagtggtgctttataccggaagagagctgcgatcagtaatgaacacgtccaaccctaggagcaagattggcttgttcgacttggaggttaattgtctgaccaagatcctgttcggtgccttggtagtagtaagtctggtcatggtcgccctacagcatttcgccggccgatggtacctgcagatcattcggtttctcctgctgtttagcaatattattcctatctcccttcgcgtcaacctggacatgggtaagattgtgtactcttgggtcattaggcgggactcgaaaattccaggcaccgtggtacggtcttccacaattccagagcagctggggcggatatcatatctgctaactgacaagactggtacactcactcaaaacgagatgatattcaagcgcttgcatctcggcaccgtggcctacgggcttgactccatggatgaagtacagagtcatatatttagcatatatactcagcagtcacaagacccaccggctcaaaaaggaccaacattaacaacaaaggttcggaggaccatgtcatccagggtgcatgaagccgtgaaggcaattgccctgtgccacaatgttacaccagtatacgagtctaatggcgtgacggaccaggccgaggccgaaaagcagtatgaggactcatgccgcgtgtaccaggccagcagccctgatgaggttgcactggtgcaatggaccgaatcagtcgggcttactctcgtgggccgggaccagagcagcatgcagttgaggactccaggtgaccagatccttaatttcaccatactgcagatcttcccatttacgtatgagtccaaacggatgggaatcatagtgagagatgaatccaccggagagattactttttacatgaaaggcgctgacgtggtgatggcgggtattgtgcagtataacgactggctcgaagaggagtgcggcaatatggctcgcgaaggactcagagtgcttgttgttgcaaagaagagccttgctgaggaacagtaccaggacttcgaggctaggtacgtacaggcaaaattgagtgtccacgaccggagtctcaaggtggcgactgtcatcgagtccctggagatggagatggaattgctctgcctcacaggtgtggaggaccagctccaggccgacgtgagaccaacactggaaacgctcagaaacgctgggataaaagtttggatgcttacaggtgataaactggaaacagcaacttgtaccgccaagaatgcacacttggttacgcgtaaccaggatattcatgttttcagacttgtcacgaacagaggcgaagcccacctcgaactcaacgcgttcagacggaagcacgactgcgccctggttattagtggcgacagcttggaggtctgtctcaagtactacgagtacgaatttatggagctagcctgtcaatgccccgcagtggtgtgctgccgatgcgcaccaacacagaaagcacagatcgtcaggttattgcaggaaaggaccggtaagttaacttgcgcagtcggtgatgggggtaatgatgtcagcatgattcaagagtctgattgtggcgttggagtggaagggaaggaaggcaagcaggcatcactcgccgctgatttcagtataacccagtttaagcacctgggtcgccttttgatggtgcatggacgcaactcctataaacggtcagctgctctgtcccaatttgtgattcataggtcactgtgcatatccaccatgcaggccgtgttctcatcggtgttttactttgcaagtgtcccgctgtatcagggatttctgatcattgggtactctacaatatacactatgtttccagtgttttcactggtcctggataaggatgtgaagtctgaggttgccatgctctacccggaactctacaaagacctgctaaaaggccgccctttatcatataaaacgttcctgatttgggtgttgatttcaatttaccaggggtccacaattatgtatggggccctgctcctgtttgaaagcgagttcgtacatatagtagctatatcgttcacaagtctgatcctgacagagctactgatggtagccctgactatccagacctggcattggctgatgacggtggccgagctgctgtccttagcctgttacattgccagcctagtctttcttcatgaatttattgacgtgtacttcattgctacgctgagctttctgtggaaggtcagcgtgataaccctggtaagttgtttacctctgtacgtgctcaaatatttgaggaggagattcagcccgccatcctactctaaactcacctcatag

SEQ ID NO: 24504 - DNA, 2781 bp, Artificial Sequence
  Description of Artificial Sequence: Synthetic coding sequence
atgacagataacataccactgcagcccgttaggcagaagaagcggatggactctcgcccccgcgctgggtgttgtgagtggctgaggtgctgtggaggtggggaggctcgccctagaactgtctggcttggtcaccctgagaagagagaccaacggtaccctagaaatgtgattaataatcagaaatacaatttcttcacctttctcccaggcgtgctattcaaccagtttaaatacttctttaatttgtattttctgctgctggcttgctcacagtttgtcccagaaatgagacttggggctctgtatacctattgggttccactgggcttcgtcctggctgtgaccgtcatacgcgaggcagtggaggagatcaggtgctatgtccgagataaggaagtgaacagccaggtgtattcaagactgaccgctcgcggaacagtggtgggcgtggtgctttatactggaagagagttgcgctctgtcatgaacacttccaatcccaggtccaaaattggcctgttcgacttggaggtgaactgccttactaagattctgtttggagccctggtagttgtcagcctggtgatggtggctctccagcactttgccgggcgttggtacttgcagatcatccgctttctgctgttgtttagcaatatcattccgataagcttacgcgtgaatttggatatgggtaagatcgtctacagctgggtcattagaagggattctaagatccctgggactgtggtgcgctcgtccactatccctgagcagctgggacgcattagctacttactgaccgacaaaaccggcactctaacacagaacgagatgattttcaagcgcctgcacctgggcaccgtggcatacggcctggactcaatggatgaagttcagtcacatattttctccatttatacgcagcaatcacaggacccaccagctcaaaaggggcccacgcttacaacgaaggtcagacggactatgtcctcccgagtgcacgaggccgtgaaggcgatagctttatgtcataatgtgactccagtttatgaatcaaatggagtcacggaccaggccgaagcggagaaacagtacgaagacagttgccgggtctatcaggcctccagccccgacgaggtcgctctggtccaatggaccgagtctgtgggactgactctcgtgggacgagatcagagcagcatgcagctgagaaccccaggtgaccagatattgaacttcaccatcttacagatctttccatttacctatgagtccaaacgtatgggtataatcgtgcgtgatgaaagcaccggcgagatcaccttctacatgaagggcgcggacgtggtgatggccggtattgtccagtacaatgactggcttgaagaggaatgcgggaatatggcacgtgaggggcttagagtacttgtcgtggctaaaaagagtctcgccgaggaacagtaccaagatttcgaggcccggtatgtgcaggccaagctaagcgtgcatgatcggtccctgaaagtagcaacagttattgagagcttggagatggagatggaactgctttgtctgacaggcgtggaggatcaattacaggctgacgtgcgacccacccttgagacgctgagaaacgccggcatcaaagtgtggatgctgacaggagataaactagagacagcaacctgcactgctaagaatgctcatcttgttaccagaaaccaagatatccacgtctttcgtctggtgacaaaccgcggcgaggctcacctcgaactgaacgcctttaggcggaagcacgactgcgcactcgtcatctcaggggattcactggaagtttgtctcaaatattacgagtacgaattcatggaactggcatgtcagtgtcccgctgttgtgtgctgcagatgtgcccccacgcagaaggcccaaatcgtgaggctccttcaggagcggacaggaaaactgacgtgcgccgtgggcgatggtgggaacgatgtgtccatgatacaagagtccgattgcggcgtgggcgtggagggcaaagagggtaagcaggctagcttggccgctgacttttctattactcagttcaaacatctcggtaggcttcttatggtccacggccgcaactcctataagcggtccgctgcactgagtcagttcgtcatccacagatcactgtgtattagcacaatgcaggccgtctttagttccgtgttttacttcgccagtgttcccttataccagggattcctgatcattgggtattctactatatacaccatgttccccgtgttctccttggtgctcgataaagacgtgaaatccgaggtcgctatgttgtatcctgagttgtacaaggatctgcttaaagggcgcccactaagctataagactttcctaatatgggtgcttatctctatataccaagggtctactattatgtacggtgccttgctgctgttcgaatctgagttcgtgcacatcgtggctattagctttacctctctgatcctcaccgagctgttgatggtcgcgctgaccatccagacatggcactggctcatgacagttgccgagttactgtccctggcgtgctacatcgcttcactagtcttcctgcacgagttcatcgacgtctattttatcgccacgctgtcgttcctctggaaggtgtccgtgattactcttgtgagctgcctccccctctacgtcctgaaatacctgaggcgaagattttctccgcctagctactccaagttgaccagctag

SEQ ID NO: 24505 - DNA, 4386 bp, Artificial Sequence
  Description of Artificial Sequence: Synthetic coding sequence
atggccctctccgtggacagtagttggcatcggtggcagtggagggtgagagacggcttccctcactgcccatcagagacaaccccacttttatctccagagaaggggcggcagtcatataatctgacccagcagcgggttgtgtttcccaataattcaatcttccatcaagactgggaagaagtgtctaggcggtaccctgggaatcggacatgcaccaccaagtacactctctttacattcttaccacggaatttgttcgagcagttccaccgttgggccaacctctatttcctgttcctcgtgatacttaattggatgccaagcatggaagtattccatagggaaatcacaatgttaccactggccatagtgttgtttgttatcatgatcaaggatgggatggaggacttcaaacgacacagattcgataaggccatcaactgctccaacattcgaatctatgagcggaaggagcagacctatgtgcagaagtgctggaaagatgtcagggtgggtgattttattcagatgaagtgtaacgagatcgttcccgctgacattttgttgttgttttcctccgaccccaatggaatctgtcatctcgagaccgcctcactggatggagagactaaccttaagcagcgctgcgtggtcaagggcttctcccaacaggaggtacagttcgagcctgagctgttccacaatacaatcgtttgcgaaaaaccaaacaaccatctgaacaaatttaagggctatatggaacacccggatcagacccggactggatttggctgcgagtccctgctgctgcgcgggtgcaccattaggaacacagagatggcggtcggtattgtaatatacgccggtcatgaaaccaaagccatgctgaacaacagcggcccccggtataaaaggtctaagattgagagacgaatgaatatagacatctttttttgcatcgggatattaatcctgatgtgtcttattggcgctgtgggccactccatttggaatggcacctttgaggaacatccaccttttgacgtccctgatgcaaatggctcattcttgccctccgccctgggcggattctacatgttcctgaccatgattatactcctgcaggtcttgattcccatcagtctgtacgtgtctattgaactggttaaattaggacaggtgttcttcttatccaatgacctggacctgtatgacgaggaaacagatctgagcattcagtgccgggccctgaatatagcggaggatttgggacagatccaatacatcttctctgacaaaaccggaactttgaccgagaataaaatggtgttccgccgctgcacaatcatgggcagcgagtactcccatcaagagaatgcgaaacgactagagacaccgaaggagctcgacagtgacggagaagaatggacccagtatcagtgcctgtcattcagcgctcgttgggcacaggaccctgccacaatgaggagccagaagggggcccagcctttgaggcgtagccagtctgcaagggttccgatacagggccattaccggcagcgctcaatgggccaccgtgaatcctcccaacccccagtggccttttcttcgagtatagaaaaggacgtgactccggacaagaacctgcttacaaaggtgcgggacgccgcactctggctggagacgctgtccgattctcgacccgccaaggccagtctttccacaacctccagtatagcagatttctttctcgccctgacaatctgcaattctgttatggtgtcaacaacaaccgagccccggcagagagttactattaaaccttcctccaaggcacttgggacttccctggaaaagatccagcagctgtttcaaaaattaaagctactgagtctgtcgcaatcgttctcgtccactgcccccagtgatacagatctgggcgagagcctgggcgccaacgtggcgaccactgatagtgatgagagggatgacgcctcagtgtgcagcggcggcgatagcaccgatgacggcggctatcggtcatccatgtgggaccagggagacattctggaatcaggctccgggacttccctggaagaggccttagaggccccagccacggacttagccagaccagagttctgttatgaggccgaatctccagatgaggccgctctcgtgcacgccgcacatgcttatagcttcacattggtttctcgaacccccgagcaggtgactgttagactgcctcagggaacctgtctcaccttttcacttttgtgcacactcggctttgattctgttcggaagaggatgagtgtcgttgtgcgccacccactgactggagaaatcgtagtgtacacaaagggagccgatagtgtgatcatggatctcctcgaggatccagcctgcgtgccagatataaatatggaaaaaaagctgaggaagatacgggcccgtactcagaagcatttggatttgtacgcccgtgacggcttgagaactctctgtatcgccaaaaaagttgtgagcgaagaagacttccgacggtgggcttccttccgacgggaggcggaagcgtccctcgataaccgggatgagctcctgatggagactgcccaacatctagagaatcaattaaccctccttggtgcaacaggaatcgaggataggctgcaggagggcgtcccagatactattgccaccctgagagaggcgggtattcagctttgggtcctgaccggagataagcaggaaaccgccgtgaatatcgctcatagctgtcgactcctgaaccagaccgacacagtctacacgattaacaccgagaaccaggaaacctgcgagagcatcctgaactgtgcccttgaagagctgaagcaattccgtgagcttcaaaagccagaccgaaagcttttcgggtttagactgccaagcaagacacctagcatcaccagcgaagcagttgtcccagaagcggggctcgtcatcgacggaaagaccctcaatgcaatcttccaggggaaactcgaaaagaaattcctcgagctgacccagtattgcagatctgtcctgtgctgccgaagtacaccactgcaaaagtcaatgattgtgaaactcgttcgggacaaactacgcgtcatgacgttgagcattggcgatggcgccaatgatgtctcaatgatccaggccgcagacatagggataggcatttccggccaggaaggaatgcaagcagttatgagtagtgacttcgcaattactagattcaaacatctcaaaaaacttctgctcgtgcatgggcattggtgctactcaagattggcccgtatggtcgtctactacctctataagaacgtctgttacgtcaacctgctcttctggtaccaatttttttgtggattttcatccagtaccatgattgactattggcagatgattttctttaacttattttttacgtctttaccgccgctggtctttggagtactggacaaggacatatctgcagaaaccctactcgctttgcccgagctctataaatcaggccaaaactcggaatgttacaatctttcaacattctggataagtatggtggacgccttttatcagagtcttatatgcttttttatcccgtacctcgcatataagggatctgacattgacgttttcacattcggtacacctattaataccattagcctcacaacaattttgctgcaccaggccatggagatgaagacttggacaatctttcacggggtggtgttattagggagcttcttgatgtactttttggtgtcacttctgtacaatgctacctgcgtgatctgcaattctcccaccaacccttactgggtgatggaggggcagctctctaaccctaccttttacctggtctgctttctaacgcctgtggtcgcgctactgcccagatactttttcctaagcctacaaggaacctgtggaaaatccctaatcagtaaagcacagaaaatcgacaaacttccaccggataaacgaaatctggagatccagtcctggaggtcccgacagcggcctgcccccgtacccgaagtcgcaagacccacacaccaccctgtctcttcaatcacgggccaggacttttcagcttcgactcccaagagcagcaatccgcctaaaaggaagcatgtggaagagagcgtgcttcacgagcagaggtgtggaactgagtgtatgcgagacgactcctgtagcggggactccagcgcccagctgagtagcggagagcatctgctcgggcctaacaggattatggcttacagtcgtggccagaccgacatgtgccgttgtagtaagcgaagcagtcacagaagatctcaaagtagcttaacaatttag

SEQ ID NO: 24506 - DNA, 4281 bp, Artificial Sequence
  Description of Artificial Sequence: Synthetic coding sequence
atgaccgaagctctgcaatgggcccgatatcactggagacgtctaataagaggtgccacccgggacgatgatagtggcccatataactacagctccctgttagcctgtggtaggaaatcaagccagacaccaaagctgtctggaagacaccggatcgtcgtgccccacatccagccttttaaggacgagtacgaaaagtttagcggcgcatatgttaataatagaataaggaccaccaaatacaccctcctgaattttgtgcctagaaatctgtttgagcagtttcacagggccgcaaacctgtactttttattcctcgttgtgctaaactgggtgccactcgtggaggccttccagaaagaaataaccatgttgcctcttgtcgtcgttctgaccatcattgccatcaaagatgggcttgaagactaccgaaagtataagatcgacaagcaaatcaacaatcttattacgaaggtgtacagccgcaaggagaagaagtacattgataggtgctggaaggatgtgaccgtcggcgacttcattcggctgagctgtaacgaagtgattcctgcggatatggtcctgctgttctccacagacccggatggcatttgccacattgaaacaagtgggctggatggcgaaagtaacctgaagcagaggcaagttgtcaggggctacgccgaacaggactccgaggttgacccggaaaaattttcttcacgtatagaatgtgaaagcccaaacaacgacctaagcaggtttcgaggattcctggagcactcaaataaagagcgcgttgggctttcaaaggaaaatttgctcttgaggggttgtaccattagaaacactgaggcagtcgtcggcatcgtggtgtacgcgggacacgagacaaaggcaatgcttaacaatagtggacccaggtacaagcgaagcaagttggagcgtcgtgcgaacacagacgtattgtggtgcgtaatgttgctggtgatcatgtgtctcactggtgctgttggccatggaatctggctaagccggtatgaaaagatgcatttttttaacgtgcccgagccagatggacacattatttcccctctattagctggcttttatatgttctggactatgatcatcctgcttcaggtgctgattcctatatcactgtatgtgagcatcgagatcgttaagctcggtcagatatacttcattcagtccgacgtcgacttttacaacgaaaaaatggatagtatagtgcagtgtagggccttgaatatcgccgaggacctcggtcaaattcaatacttgttcagcgataagaccggaacacttacagagaataagatggtgttccggcgatgttccgtcgccgggtttgattattgccatgaagagaatgcacgcagactcgagagttatcaggaggccgtgtctgaggacgaagatttcatcgacaccgttagcgggtccctcagcaacatggctaaaccacgggccccatcttgtcgtacagttcataacggccccctgggaaataagcccagcaaccatctggcaggcagttcatttaccctcggctccggtgagggcgccagtgaggtgcctcacagtcgccaggccgcattcagctcccctatcgagactgacgttgtaccagacactcgacttctggataagttctctcagatcactccccgactgttcatgccgcttgatgaaacaatccagaatcctcctatggagactctgtatatcatcgacttctttattgcattggctatttgtaatacggttgtcgtcagcgcccctaatcaaccccggcaaaagattcggcacccatcactgggaggcctccctatcaagtctttggaggagattaagagcctgtttcaacgatggtctgtcagaaggagctcaagtccctctctgaactctggtaaagagcccagcagcggggtacccaacgcatttgtgtctcgtctgcccctgtttagtaggatgaagccagctagccccgtggaggaagaggtgtcccaggtgtgcgagagcccccagtgctcctcttcatctgcctgctgcacagaaactgagaaacaacacggagatgccgggctgctcaatggcaaggccgagtccctccccgggcagcccctagcatgtaacctgtgctatgaggcggagagcccggatgaggccgcgctcgtgtatgccgcgagagcctaccagtgcactctgaggagcagaacgcccgagcaggtaatggtcgacttcgcggccctcggccctttgacatttcagctgctacacattctgcctttcgacagtgtccgaaaaagaatgtccgtggtggtcagacaccctctcagtaatcaggtggtcgtgtataccaaaggtgcagatagtgtcatcatggagcttctatccgtggcttcccccgacggtgcctctctagaaaagcagcagatgatagtcagggagaagacccagaaacacctggacgactacgctaaacagggcttgcgaaccctctgcattgccaaaaaggtaatgtccgatacagaatatgcggagtggctgaggaaccactttctggccgaaacaagcatagacaaccgggaggagctacttctggagtctgctatgcgcctggagaataagctgacactgttgggggctactggtatagaggaccggctgcaggaaggggtgccagaatcaatagaggccctgcacaaggccggaattaagatctggatgctgacgggagacaagcaagagactgctgttaatatcgcctatgcttgtaagctcttagaacccgacgataagttgtttatcctgaacacccagagtaaggatgcttgcgggatgttgatgtctaccatcttaaaggagctacaaaagaagacacaggcgctgcctgagcaggtttccctgagtgaagacctgttgcagccccctgttcccagggattccgggctgagggcgggcttgatcattacgggtaaaaccctggagttcgcgttgcaagaatccctgcagaagcagttcctagaattgacgagctggtgtcaggctgtggtctgctgcagggccacgcccctgcaaaagtccgaggtggttaaactggtccgctcacacttacaagtaatgacattggccatcggcgatggagccaacgatgtctccatgatccaggtcgcagatatcggtattggggtatccggacaggaggggatgcaggctgtgatggcatccgactttgctgttagccagttcaaacacctttctaagttgctactggtgcacggacattggtgctatacgcgcttgagtaatatgatcttgtatttcttttataaaaacgttgcatacgtgaatctgttgttttggtaccagtttttttgtggattctctgggactagcatgacagattactgggtcctgatattcttcaacctgttatttacgagtgctcctcccgttatttatggagtcctggagaaagacgtcagcgctgaaacgctcatgcaattaccggagctgtaccgctctgggcagaagtcagaagcataccttccgcacacattctggattaccctgctggacgccttctaccagagtctcgtgtgtttcttcgtaccatacttcacctatcaaggctcagacactgatattttcgcatttggaaatccacttaataccgctgcgctatttatcgtgttactgcatctcgtgattgagagcaagagtctcacgtggatccatcttctagttattatcggtagtatcttgtcatactttcttttcgcaatcgtgttcggggcaatgtgcgttacatgcaacccgcccagtaatccgtactggattatgcaggagcacatgctggatccagttttttacctcgtttgcatcctgaccacttcaatcgccttgctgccccggttcgtctacagagtcttacagggtagtctcttccccagccctattctgagagcaaaacacttcgacaggctgacccccgaagaacgcactaaggctctcaaaaaatggcgaggcgccggtaagatgaatcaggtgaccagcaaatatgcaaaccagtccgctggtaaaagtggaaggcgcccaatgcccggccctagtgccgtgtttgcaatgaagagcgcctcaagctgtgccatcgaacaggggaacctgtccctctgtgagacagccctggatcaaggctatagcgaaaccaaggcattcgaaatggcagggcctagcaagggcaaggagtcatag

SEQ ID NO: 24507 - DNA, 1608 bp, Artificial Sequence
  Description of Artificial Sequence: Synthetic coding sequence
atgactgaagccctccagtgggcgcggtatcactggaggcggctaattagaggagcaacacgtgacgatgactccggcccttataactactccagtctgttggcttgcggcaggaaatcgtctcagacaccgaagctctcaggtaggcaccggatcgtggttccacacattcagccgttcaaagatgaatatgagaagtttagcggggcttacgtcaacaatcgtattagaactacaaaatacacactgcttaatttcgtgccaaggaatctgttcgagcaattccatcgcgccgcaaacctctatttcttgtttttggttgtgcttaactgggtccctctggttgaggcttttcagaaggaaataaccatgctcccccttgttgtcgtgctgacaattatcgccatcaaggacggtctggaagattatcgcaagtacaaaatcgacaagcagatcaataacctcatcaccaaggtgtactctcggaaggagaaaaagtacattgatcggtgctggaaggatgtgacagtgggagattttatccgactgtcctgcaatgaggtcattcccgccgacatggttctgcttttttccaccgaccccgacgggatctgtcacatcgagacaagtgggctggatggcgaaagcaatctaaagcaaagacaagtcgtcagaggatatgccgaacaagatagtgaagtcgaccctgagaagttttcctcaaggatcgaatgcgagtccccaaataacgacttaagccgtttcaggggattcttggagcacagtaacaaagagagggtaggtctcagtaaggagaacctgctccttaggggatgcactataaggaataccgaggctgtggtgggcattgtggtgtacgccgggcatgagaccaaggccatgctaaacaactctgggccaaggtacaagcggtctaaactggagaggcgggctaacactgacgttttatggtgcgtgatgttgttagtaattatgtgcctgaccggcgcagttgggcacggaatttggctgtctcggtatgaaaaaatgcattttttcaacgtgcctgagcctgatggacatataatctctcctctgcttgccgggttctacatgttctggacaatgatcatcttactccagctgggtcagatatattttatacagtccgacgtggatttttataatgaaaagatggacagcattgtacagtgtcgggccctcaatattgcagaggaccttggccagattcaatacctgttctccgacaagactgggaccctgacagagaacaaaatggtgtttcgaaggtgtagcgtcgcgggatttgattactgtcatgaagaaaatgcaagaagactcgagtcctatcaggaggccgtgtctgaggacgaggacttcatagatacagtgagtggaagtttatccaatatggccaagccaagggctccctcatgcaggaccgtccacaacgggcctctggggaataaaccttctaatcacctggctggcagttcatttactctgggcagtggtgagggggcaagcgaggtgccacatagccgccaggctgccttttcatcccccatagtatccatgaacgcctag

SEQ ID NO: 24508 - DNA, 3399 bp, Artificial Sequence
  Description of Artificial Sequence: Synthetic coding sequence
atgcagatggttccttcattgccacccgcctccgaatgtgcaggagaagaaaagcgtgttggcacacgaaccgttttcgtcggaaaccatcctgtgtcagagactgaagcatacatagctcagaggttttgcgacaacaggattgtaagttccaagtacaccctctggaactttttgcctaagaacctatttgagcagtttagaaggatagcgaacttctatttccttattattttcctggtgcaggtcactgttgacacccccacaagccctgtgacgagcggactcccactgttcttcgttattacagtgacagctattaaacagggttatgaggattgcctccggcaccgcgcagacaacgaggtgaataaatcaaccgtgtacattatagagaatgcaaagagagtccgcaaggagtctgaaaagattaaggtcggggacgtcgtcgaggtgcaagccgacgagacctttccatgcgatcttattttgttgagctcatgcactacagacggcacctgttacgtgaccacagcaagcctggacggcgaaagtaactgcaaaacacattatgccgtcagagacaccatcgccctgtgtaccgcagaaagcatcgatactctaagggccgccatcgaatgcgagcaaccccaacccgacctctataagtttgtcggacgtatcaacatttacagcaactctttagaggctgttgcacggagtctgggtcccgagaatctgcttctcaagggagccacattgaaaaatacagagaagatctatggtgtagctgtttatacagggatggagacaaaaatggcactgaattaccagggtaaatctcagaaaagatcggctgtcgagaagtcaattaacgcgtttctgattgtctacctgtttattctgctcaccaaggccgccgtctgcactaccctgaagtacgtttggcagtccacaccctacaacgacgagccctggtacaaccagaagacacagaaagagagagagaccctgaaggtgctgaaaatgtttaccgatttcttgagctttatggttctttttaacttcattatcccagtttcgatgtatgtcaccgtcgaaatgcagaagttccttgggagcttttttattagctgggataaagacttctatgacgaagagatcaacgagggcgccctggtcaacacctccgacttgaacgaggagctcggccaggtggactacgtattcacagacaaaactggcacactgaccgagaacagcatggaattcattgaatgttgcatagatggccacaagtataagggagtaactcaagaggtggacggtctgagccagaccgacggtacgctgacctattttgacaaggtagacaagaaccgcgaggaattatttctgcgcgctctgtgcctgtgtcacactgttgaaataaagacgaatgacgcagtagacggcgccacagagtcggccgaactgacttacatctcatcaagtccagatgaaatcgccctagtcaagggcgccaaacggtacggcttcacgttcttggggaaccgaaacggatacatgcgcgtggagaatcaacgcaaggaaattgaggaatacgagctcctgcatacgttgaattttgacgctgtaaggcgacggatgagcgtgattgtgaaaactcaggagggagatatcttacttttctgcaagggagccgatagtgccgttttcccaagggttcagaaccatgaaatcgaactcaccaaggtacacgtggagagaaatgctatggacggctaccgtaccctatgcgtggcctttaaagagatcgcccctgacgattatgagcgcattaacagacaactgatcgaggccaagatggccctccaggatcgggaggaaaaaatggagaaggtgttcgacgacatagaaactaatatgaatttaattggtgccaccgccgtggaggacaagctccaagatcaggcagcggaaactattgaggcactccatgccgcaggcctcaaggtctgggtgctcactggggataagatggagaccgccaaatccacctgctatgcttgccgtctttttcaaacaaatacagagcttttggagctgactaccaagacaatcgaagagagcgaaagaaaggaggaccgcttgcatgaactcttaattgagtaccgcaagaagctactgcacgagtttcccaagtctacacgctcttttaaaaaagcctggactgaacatcaggagtatgggctcataattgatggatccaccctgagcctcatcctcaacagcagccaggactcctcgtcgaataattataaaagcatatttctgcagatctgcatgaaatgtacagccgtgctctgttgtagaatggcacctttgcagaaggctcagattgtgcgtatggtaaagaatcttaaaggcagtccaatcacactgtccatcggtgacggtgcaaacgacgtgagtatgatcctggaatctcacgtcggcatcggcatcaagggaaaagaggggcggcaggctgcacggaacagtgattacagtgtcccaaagtttaagcatctgaagaagttactgctagcacacggccatctctattatgtccgaattgcacatctcgtacagtactttttctataagaatttgtgcttcatcctcccacagtttctgtaccagtttttttgtgggttcagtcagcagcctctgtacgatgctgcctatctgacgatgtataatatttgcttcaccagtttgcccattctcgcctactcactgttagagcagcatattaatatcgatacacttacctccgatcctcgtctatacatgaaaatttcagggaatgcaatgctgcagcttggcccattcttatattggaccttcctggccgcttttgagggtactgtctttttctttggaacctacttccttttccagaccgcatccctggaggaaaatggaaaggtttacggcaactggacctttgggacaatagtgtttacagtgttggtctttaccgtgactctgaagctagctcttgacactcgcttctggacttggataaatcacttcgtcatctgggggtcgctggctttctatgtgttcttctcttttttctggggcggcattatctggccgtttttaaagcagcaacgaatgtactttgtgtttgcccagatgttgagttccgtttcaacttggcttgctatcatcctgctaatcttcatatccctgttcccggaaatcctgctgatagtgcttaagaatgtgcggcggcgtagcgcccgaagaaacctgagttgccgccgcgcgagtgacagtctgtctgctagacccagtgttagaccccttctgctgagaacattctcagatgagagtaacgtgctgtag

SEQ ID NO: 24509 - DNA, 3327 bp, Artificial Sequence
  Description of Artificial Sequence: Synthetic coding sequence
atgcagatggtaccttctttgcctcctgcctctgagtgcgcaggggaagaaaaaagggtgggaacccggacagttttcgtcggcaatcatccagtctctgaaacagaggcctacattgcccagaggttttgtgataaccgaattgtgtcaagcaagtataccctgtggaattttcttccaaaaaacctcttcgagcagtttagaaggattgctaatttttattttctgatcattttcttggtgcaggtgacagttgacacaccgacctctcccgtgacctccggattgccactattctttgtgattactgttactgccatcaaacaaggctacgaggactgtcttaggcatcgggctgataatgaggtgaataaatcaactgtgtatatcatcgagaatgcgaagagagtccgcaaggaatccgaaaaaattaaagtgggtgacgtggtcgaggtgcaggcggacgaaactttcccatgcgatctgatcctgcttagcagttgtaccacagacggaacctgttacgtgaccacagcaagtttggacggcgagtcaaattgcaaaactcactatgccgtccgcgatacgattgccctatgcaccgccgaatccattgacacattgagggcagcaatcgagtgcgagcagccacaacccgatctgtacaaattcgtgggaaggatcaacatatatagcaattccctggaggccgtggctcgatcacttggccctgagaacctcttactgaagggagccactctgaagaataccgaaaaaatctatggggtggcagtatacactggtatggagacaaaaatggctctgaattaccagggaaagtcccagaagaggtctgcagtggagaagtctataaatgcatttctcatagtgtacctgtttatcttactcacaaaagccgccgtgtgcaccacactgaaatacgtctggcagtcaactccatacaatgacgagccatggtacaatcagaagactcaaaaagagagagagacattgaaggtgttaaaaatgttcacagatttcttgtcctttatggttttgtttaatttcattatccctgtgagcatgtacgtgactgtggaaatgcaaaagttcctgggatctttcttcatcagttgggataaagatttctatgacgaggagatcaacgagggtgctctggttaacacgtccgatttaaacgaagagttaggccaggtggactatgtttttacagacaagaccggtactttaaccgaaaacagcatggagtttattgagtgttgcatagatggccacaagtacaaaggcgtcactcaagaagttgacggcctcagtcagaccgacggtacactgacctatttcgacaaagtcgataagaatagagaggaactgttcctgagagctctgtgcctctgtcataccgtcgagatcaaaaccaacgacgccgtcgacggtgccacggagtctgctgagttaacctacatcagctctagtccagacgagatagcattggttaagggggctaagcggtatggatttacatttctgggcaaccgtaacggctacatgcgtgtggagaaccagagaaaggaaatcgaagaatacgaattgctgcacacactgaacttcgacgcggtccgaaggcgcatgagtgtaattgtgaaaacccaggagggcgatatattactcttttgtaaaggcgccgactcagcagttttcccaagagtacaaaatcacgagatagagttaacaaaagtgcatgtggagcggaacgctatggatggatacagaactctttgcgtggcattcaaagagattgcaccagacgactatgagcgcattaacagacagcttattgaagcgaaaatggcactgcaagatcgtgaggagaaaatggaaaaagtattcgacgacattgaaactaacatgaacctgattggggcaactgcagtggaagacaaactccaagaccaggctgccgagacaatcgaggccctgcatgccgctggattgaaagtatgggtgctcactggggacaagatggaaactgccaagtccacctgctatgcatgtcgtctctttcagactaacacagaacttctcgagctgaccactaaaacaatcgaagaaagtgagcgcaaagaagatcggctacatgagctgctgatcgagtaccggaagaaactgctgcacgaatttccaaagagcaccaggtcattcaagaaagcctggaccgagcaccaggaatacggtctgattatagacggctcaaccctgtcacttattctcaactcctcacaggacagcagtagcaataactacaagagcattttccttcagatctgtatgaagtgcactgctgtgttgtgttgcagaatggctccattgcaaaaggcccagatcgtgcgcatggtgaagaacttgaaagggagtccgattacgctgtctatcggcgacggtgcgaacgatgtctctatgatcctggagtcccacgtaggcatcgggatcaagggaaaagaaggcaggcaggctgctagaaacagcgactactcggtgcccaaattcaaacacctgaagaaactgcttctggcgcacggacacctctactatgtaagaatcgcacacctcgtgcagtatttcttttacaaaaacctgtgtttcattctgcctcagtttctgtaccagttcttctgtggctttagccagcaacctttgtacgacgctgcatacctcacaatgtacaatatctgttttacctcactccccatcttggcctatagccttcttgaacagcatattaatatcgatacactaacaagcgacccccgattgtacatgaagatctcaggaaatgccatgcttcagctggggccgttcctgtattggacatttctcgccgcttttgaggggacagtgttttttttcgggacatatttcctctttcagaccgccagcctggaggaaaatgggaaggtttacggcaactggacttttggcaccatcgtatttaccgtgctggtgtttacagtgaccttgaagcttgcactggatacgcggttttggacctggattaatcattttgtcatctggggaagccttgccttttatgttttcttttcctttttctggggcggaattatctggccgtttttgaaacaacagaggatgtacttcgttttcgcgcaaatgcttagctccgtgtctacatggctcgccattatcctcctgatctttatctcgttgtttcctgaaatcctgctgatagttttgaaaaacgtgaggcggcgttctgcacgcgtccaccatttaatatccagcagcgcttag

SEQ ID NO: 24510 - DNA, 3360 bp, Artificial Sequence
  Description of Artificial Sequence: Synthetic coding sequence
atgcagatggtgccctctctgccccccgcgtctgagtgtgctggtgaagaaaagcgagtcggaaccaggacggtttttgtggggaaccacccagttagcgagactgaagcttacatagcacaaagattttgtgataaccggattgtgtcctctaagtatactctttggaactttctgcccaagaacctgtttgaacagttccggcgcatcgcgaacttctattttttaatcatcttcttggtacaggttacagtagataccccaacttcgcctgttactagcggtcttccactgttctttgtgattacggtcacagccatcaagcagggatacgaggactgtcttcggcaccgggcggataatgaagttaacaaatcaactgtctatatcatcgagaacgccaaacgagtgcgtaaggagtccgaaaaaatcaaggtgggcgacgtggtggaagtgcaagccgacgagacatttccgtgtgatctgatcctcttgtccagttgtactaccgacgggacttgttatgtcaccactgcctccctagacggcgagagcaactgcaagacccactacgcagtgcgggacaccatagctctgtgcaccgcggaaagcattgatacactcagagccgccattgagtgtgagcagccgcaacctgacctgtataagtttgtagggcggatcaatatttactccaactctcttgaagccgtggcccgcagcctcggccctgagaatctcctgttgaagggagccaccctgaaaaatactgagaagatctatggagtcgcagtgtacactggtatggaaacgaagatggctttgaactaccagggcaaaagtcagaaaaggtctgccgtggagaaatctatcaacgcattcctgatagtgtatctgttcattctgcttactaaggcggccgtgtgcacaactttaaagtacgtttggcagtcgacaccctacaacgatgagccttggtataatcagaagacccagaaagaaagagagacattgaaggtgctgaagatgttcacggacttcctttcctttatggtcttgtttaactttatcattccagtttcgatgtacgtgaccgtggagatgcaaaagttcttggggagtttcttcatttcctgggacaaagatttttatgacgaagagataaatgagggggctctcgtgaacaccagcgatctgaacgaggagttgggtcaggtagactatgtgtttaccgataagaccggaactctgacagaaaatagcatggagtttatagagtgttgtattgacggtcataagtataaaggtgtcacccaggaggttgacgggctcagtcaaacagatggaactctcacctacttcgataaggttgacaagaacagggaagaactcttcctgagagccttgtgtctttgccatacagtggaaatcaagactaatgacgccgtggacggtgccactgaatctgctgaactgacctatatctccagttcacccgacgaaatagccctggtgaagggggcaaaaaggtatggcttcacttttctgggaaataggaatgggtacatgagagttgagaaccagcgcaaagagatagaagagtatgagctgctgcataccttgaacttcgatgccgtcagaagaagaatgagtgtgatcgtcaagacccaagagggtgacattctgcttttctgtaaaggagccgacagtgcagtttttcccagggtgcaaaaccatgagatcgagcttaccaaggtccacgtggaaaggaacgcgatggacggctacaggactctgtgtgtggcatttaaggagattgccccagatgactacgagaggatcaaccggcagcttatcgaggccaaaatggcactgcaggatcgggaggaaaagatggaaaaagttttcgacgacatcgaaaccaacatgaatctgattggcgccacagcggttgaggacaagttgcaggaccaggctgccgagacaattgaggccttgcatgccgctggcttaaaagtctgggtcctgactggcgacaagatggagacagctaagtccacttgttacgcgtgccgcctctttcagaccaataccgagctgctggaactcactactaagacgatcgaggagagcgaacgcaaagaagaccgtctgcatgaattactgatcgaataccgcaagaagctgctgcatgaatttccaaaatcaacacggtcttttaaaaaggcttggacagaacaccaagaatatggactgatcattgacggtagcactcttagccttatattaaattctagtcaggactcttcctccaacaattataaaagcatcttcttacagatatgcatgaagtgtaccgctgttctctgctgccggatggcgcccttgcagaaagctcagatcgtcaggatggtgaagaacctgaagggaagcccgattacccttagcatcggtgacggcgccaatgatgttagtatgatcctggagtcacatgtaggcatcggcattaagggcaaggaagggagacaagctgcccgcaactcggattatagtgtgcctaaattcaagcatttgaagaaactactcctcgcacatggccacctctactacgtccgcatagcacacctggtgcagtactttttttataaaaacctgtgcttcatccttccacagtttctgtaccagtttttctgcggcttttcacagcagcctctatatgacgcagcttatttaaccatgtataatatctgtttcacatcactccctattctagcatactccttgttggaacaacacattaatattgacacgctcacttccgatcctaggctttatatgaagatctctggcaacgcgatgctccagctcggtccattcctttactggacattcctggctgcgtttgagggaactgtctttttcttcggcacatactttctcttccagaccgccagcttggaagagaatggaaaggtctatggcaactggactttcgggactattgtgtttactgtgctcgtctttaccgtgacgctgaagcttgcactcgacacccgtttttggacatggatcaaccatttcgttatttggggttcgctcgctttctatgtgtttttctccttcttttggggcgggatcatttggccctttttgaaacagcagcggatgtactttgtctttgcgcaaatgctgtctagcgtatccacatggctggcaatcatactcttgatctttatatctctcttcccggagattctcctgatcgtcttaaaaaatgtccggcggagatcagccaggaatccgaacctcgaactgccgatgctgctgtcatacaagcataccgattcggggtactcttag

SEQ ID NO: 24511 - DNA, 3387 bp, Artificial Sequence
  Description of Artificial Sequence: Synthetic coding sequence
atgcagatggtgccgagcctaccacccgcatcagagtgtgctggggaggaaaaacgggtgggcaccagaacagtattcgtgggcaaccatcctgtgagtgaaactgaagcctatatcgcacagaggttctgtgacaatcggatcgtaagtagcaagtacactctctggaacttcctgcctaaaaacctcttcgagcagtttcgccgcattgcaaacttttatttcctcattatcttcttagtacaagtgactgtcgatacgcctactagcccagtcacttcagggttacccttatttttcgttattacagtcacggccattaagcagggctacgaagactgcctgcggcaccgcgccgacaacgaggtgaataagtcaaccgtatacatcattgagaacgccaaacgggtgcggaaagagtccgagaagataaaggtcggggatgtcgttgaagtgcaggctgacgagaccttcccatgcgacctgattctcctttcttcttgtaccactgacgggacctgctatgtgacaaccgcttcgctggatggcgagtcaaattgtaagacccattatgcagtgcgcgacaccattgctctctgcaccgccgagagtatcgatacactccgcgctgcgatcgagtgcgaacagccccagcccgacctttataagttcgtaggcaggattaacatatactccaatagcttagaggcagtagcccggtccctgggcccagagaatctattactcaaaggggccactctgaagaatacagaaaagatctacggcgtggcagtttatactggaatggagacgaagatggccctaaactaccagggtaagagccagaagcgctctgcggtcgaaaagagcattaacgcttttttaatcgtttatctgttcattctcctgacaaaagcagccgtgtgcacaaccctcaaatacgtctggcaaagtaccccttataacgacgaaccatggtataatcagaaaactcagaaggagcgggaaacccttaaggtcttaaaaatgttcacggattttctcagcttcatggtcctgttcaacttcatcatccctgtttccatgtacgtgaccgtagaaatgcaaaagtttctggggagcttctttatctcttgggacaaggatttctatgacgaagagattaacgaaggggcccttgtcaacacaagtgatttgaacgaggagttgggccaggtggattacgtgtttactgataaaaccggaacactcactgagaattcaatggagttcatcgaatgctgtatcgatggccacaagtacaagggtgtcacccaggaagttgacggtttgagccaaacagacgggacactgacctatttcgataaagttgacaagaatcgagaggagctgttcctccgtgctctgtgtttgtgccacaccgtcgaaattaagacgaacgatgccgtcgacggtgctactgagtccgcagaactgacttacataagtagcagccccgatgagattgccctcgtgaagggggccaagagatatggctttacctttctaggaaacaggaacggctatatgcgggtggaaaaccagaggaaggaaatcgaggaatacgagctcctgcacaccctcaactttgacgcggtaagacggaggatgagcgtgattgtgaaaacacaggagggagacatcctgctcttttgcaaaggcgctgactccgccgttttccctagggtacagaaccacgagatcgagctcactaaggtacacgtggagcgcaatgccatggatggttatcgcaccctgtgtgtggcttttaaggagatagccccagatgactatgagaggatcaacagacagctaattgaagcaaaaatggccctgcaggatagagaggaaaagatggagaaggtgtttgacgacattgagaccaacatgaacctgatcggggccacagcagtggaagataagcttcaggaccaggctgctgagaccatcgaggccctccacgctgccggactcaaagtttgggttttaacaggcgataagatggaaaccgctaaatccacatgctacgcttgccgcctttttcagaccaataccgagctgctggagctcaccactaagacaattgaagagagcgagaggaaggaggaccgtttgcatgaactcctgatcgagtatagaaagaagctgctccatgagtttcctaagagcacccgctccttcaaaaaagcatggactgagcaccaggagtacggtctgatcatagacggatccaccctgtccctgattttgaactcctcccaggacagctcatccaataactataaatctattttcctgcagatctgcatgaagtgcactgccgtgctttgctgtcgcatggcgccactgcaaaaagctcagatagtgcggatggtgaagaacctgaagggtagtcctattaccctcagtatcggtgacggggccaacgacgtttccatgatattggagagtcacgtgggtatcggtattaaaggaaaggagggacgtcaggcagcaaggaattctgattactcggtacctaagtttaagcatctcaagaagctcctgcttgcgcatggacacttatattatgtccgcattgcccacctcgtccaatatttcttttacaaaaatctctgcttcatactcccacaatttctctatcaattcttctgcggattcagccagcaaccactgtacgacgctgcctatcttaccatgtacaacatctgctttacttcattacccatactggcctattctttgttagagcagcacattaatattgataccctaacgtccgatccacgcctttacatgaaaatttctggcaacgccatgctgcagcttgggccatttttgtactggaccttccttgccgcctttgaggggaccgtgtttttctttggcacctactttctttttcagactgcatctctcgaggaaaacggtaaggtgtatggtaattggactttcggaacaatcgtgtttaccgtgctggtgtttacggtgaccctaaaactggcgctggatactaggttctggacttggattaaccactttgtcatctggggatccctggcgttctacgtgttcttctcatttttctggggaggcatcatctggcctttcctgaagcaacagcggatgtactttgtgttcgctcagatgttgagttcggtcagcacgtggttggccattatcctgctgatcttcatctctctgttccccgagattctcttaatcgttcttaagaacgtgagaagacgaagcgcacgggttactaagcggttacccagttctggcactagcgccatcttcatgcttagtcagacaagttctaaccacagtttctcctggagcgaatag

SEQ ID NO: 24512 - DNA, 3342 bp, Artificial Sequence
  Description of Artificial Sequence: Synthetic coding sequence
atgtttaggaggagccttaatcgattctgtgccggagaggaaaagcgggtgggcaccagaactgtcttcgtaggaaaccatcctgtttcggagactgaagcctacattgcccaacggttctgcgacaacaggattgtttcttccaaatacacactctggaactttctacccaagaacctgtttgagcagtttcggagaatagccaatttctatttcctgattattttccttgtgcaggtaaccgtcgatacccccacaagccccgtgaccagcggattacccctcttctttgtgatcacagtcacggccattaaacaggggtacgaggattgtctgcgccacagagcggataatgaggtaaataagtccactgtctacattatcgaaaacgctaaaagggtccgcaaggaatctgaaaagatcaaagtgggagacgttgtggaggtgcaggccgacgagacctttccatgcgaccttatcctcctgtccagctgcaccacagacggcacatgttacgttactactgcatctttagacggggaaagcaattgtaagacccactacgccgtacgggacaccatcgctctgtgcacagcagagtccattgatacacttcgcgccgccattgaatgcgaacagccccagcctgacctgtataagtttgtcggacgcatcaacatttattcgaactccctcgaggccgtagcacgttccctgggccctgagaatctgttactgaagggagccactctcaagaacacagagaaaatttacggcgtggctgtgtacacagggatggagacaaaaatggccttaaattaccaaggtaaatcacagaaacgaagtgcagttgagaagtccataaacgctttcctgatcgtgtatctgtttatcctccttactaaggccgctgtctgtactaccctgaagtacgtgtggcagtctactccatataacgacgagccttggtacaaccagaagacccagaaagagcgggagacccttaaagtgctcaagatgttcaccgatttcctgagtttcatggttctgttcaacttcattattccagtctcaatgtacgttacagtagaaatgcaaaaattcctcggatcctttttcatctcctgggataaggatttctatgacgaggaaattaacgaaggagctctcgtcaacacatccgatctcaacgaagaactgggccaagtcgactatgtcttcacagacaaaacaggaactttgactgagaattcaatggaattcatcgagtgttgcatcgacggccataagtataaaggcgtaacccaagaagtcgacggcttaagccagactgatggtacactgacatatttcgacaaagtcgacaaaaaccgggaggagctgttcctcagagcactgtgtctgtgtcatactgtagagatcaagacaaacgatgcagtcgatggggcaacggagagcgctgagctgacatatatctcttcctccccagatgagatcgccctagtaaagggtgcaaaaaggtatggattcacctttctaggaaatcgtaacggttacatgcgtgtggagaaccagaggaaagagattgaggagtatgaactcctgcacacactgaactttgatgcagtgagacggcgcatgtcagtgatcgtgaagacacaagagggagacattctgttattctgcaagggggccgattctgccgtgttcccacgggtacagaatcatgagatcgaactgactaaggtgcacgtggagaggaacgcaatggacgggtatcgaacactgtgcgtggcatttaaagagattgcgcctgacgattacgagcggatcaataggcagttgattgaggcaaagatggctttgcaggacagggaggaaaaaatggaaaaagttttcgatgatattgaaacaaacatgaatttgatcggcgcaaccgccgtggaggacaaactgcaagatcaggcagccgagaccatagaagctctgcacgccgccggacttaaggtctgggtgcttaccggagataagatggagactgccaagagcacctgctacgcctgccggttattccagactaataccgagctcctggagctgactacaaagaccatcgaggaatctgagagaaaagaagacagactccacgaattgttaatcgagtaccgaaagaagctgcttcacgaattccctaaaagcacaagaagctttaaaaaggcttggacagagcatcaagagtacggactgattatcgatggctctacactctccctgatactgaattcttcacaggattcctcctccaacaactacaaaagtatatttttacagatttgtatgaaatgtaccgcggtgctgtgctgtcggatggctcctctgcagaaggcccaaatagtgcggatggttaagaatttaaaaggcagccccatcaccctgtccatcggtgacggcgccaacgacgtctctatgattctcgagtcccacgtcgggatcggcaaagagggacgccaggcagctcgcaacagtgattacagcgtcccgaaatttaaacatctgaaaaagctgctcctagcccatggtcatctgtattatgttcggatagctcaccttgtccagtactttttttacaagaacctgtgttttatcctgccacaatttctgtatcagtttttctgcggattctctcagcagcctctgtatgacgcagcttatctgactatgtacaatatctgcttcaccagtctgcctatcttggcttattccctcctcgaacagcacattaatatcgatacgctgactagcgatcctaggctttacatgaaaatatccgggaatgccatgctccaactggggccctttttatactggacatttctagctgccttcgaaggaaccgtcttcttctttggcacatactttttgtttcaaactgcctctctggaggagaatggcaaggtttacggcaactggacatttgggaccattgtctttactgtgttagtctttacagttacactgaaactcgccctggacacccgcttttggacttggataaaccactttgtgatctggggaagtctggccttttacgtcttcttttcatttttctggggcggcattatctggccatttcttaaacagcagcgcatgtattttgtttttgctcagatgctttcttcagtctcaacgtggttggctattatcctgctgatttttataagcctattccccgagattctgctaattgtgcttaaaaatgtccggcggcggtcagccagaaaccctaatttggaactccccatgctcctgtcatacaagcataccgacagtggttactcttag

SEQ ID NO: 24513 - DNA, 609 bp, Artificial Sequence
  Description of Artificial Sequence: Synthetic coding sequence
taggagtgctgcatagacggacacaaatacaagggcgtcacccaggaagtcgatgggctgagtcagacagacggtactctgacatattttgacaaagtggataagaatcgggaggagctcttcttacgggccttatgcctttgtcataccgtcgagatcaaaacaaatgacgccgtagatggtgccaccgagtccgccgagttgacctatatttcttcctctcctgacgagatcgccctcgtgaagggggccaaacgctatgaactgctccacacgctcaatttcgacgctgtgaggcggagaatgagtgtgattgttaagacccaggagggagacatcctgctgttttgtaaaggagcggactctgccgtgtttcctagagtgcagaaccacgaaattgaattgacaaaggttcatgtggagcggaatgctatggatgggtatcgtaccctctgcgtagccttcaaggaaatcgctccagacgactatgagaggataaacagacagctgatagaggctaaaatggcgctgcaggatcgtgaggagaaaatggagaaggtgtttgacgatatcgaaaccaatatgaacctaattggcgcgaccgcctag

SEQ ID NO: 24514 - DNA, 498 bp, Artificial Sequence
  Description of Artificial Sequence: Synthetic coding sequence
taagagggcaccgtcttcttttttggtacctatttcctgttccagacggctagtctcgaagaaaatggcaaggtttacggcaactggacgtttggcaccatcgtgtttaccgtgcttgtcttcacagttactctcaagttggctctggataccagattttggacatggattaaccattttgtgatatggggctcgctagccttctacgttttcttcagtttcttttggggaggaatcatttggccattcctcaagcagcaacggatgtatttcgtgtttgctcagatgcttagcagtgtctctacctggctggccatcatactgctgatttttatttctctgtttcctgagattctgctcatcgttctcaagaatgtgaggagacggtcggccaggagaaatctctcttgccgacgggcctctgattccctgtctgccaggccttccgtgcgaccactattacttcgcactttctcagatgagagtaatgtgctctag

SEQ ID NO: 24515 - DNA, 519 bp, Artificial Sequence
  Description of Artificial Sequence: Synthetic coding sequence
acattgaccagtgacccacgtctttacatgaagatctcaggcaatgccatgctgcagctgggacccttcttgtattggacctttttggcggccttcgaagggacagtcttttttttcggcacctattttcttttccagactgcttctctggaagaaaacgggaaggtgtacggtaattggaccttcggaactattgtgttcacagtattagtgtttactgttacactgaagctcgcactggacactcgcttttggacctggatcaatcactttgtcatttggggttccctggctttctacgtgttcttttcgttcttctggggcgggatcatatggccttttctgaaacagcagcggatgtacttcgtgttcgcgcagatgctgtcatcggtttccacatggcttgctataattctcctcatcttcatctccttgttccccgagattttgttgattgtgctgaaaaacgtgagacgacgctcagctcgggtgcatcacctgatttcttcaagcgcctag

SEQ ID NO: 24516 - DNA, 357 bp, Artificial Sequence
  Description of Artificial Sequence: Synthetic coding sequence
atgacaagccagagccagggaatacatcaattgcttcaagcagagaaaagagccaaggacaagctcgaagaggctaagaaacgcaagggaaagagactcaagcaagccaaagaggaggcaatggtggagatcgaccaatatcgaatgcagcgtgataaagaattcagacttaaacagtcaaaaattatgggctcacaaaataatttgtccgacgagattgaggagcagaccctaggaaagattcaggagttaaacggccactacaacaaatacatggagagcgtcatgaaccagctcctgagtatggtatgtgatatgaagcccgaaattcatgttaactaccgcgccacaaattag

SEQ ID NO: 24517 - DNA, 180 bp, Artificial Sequence
  Description of Artificial Sequence: Synthetic coding sequence
atgacctcacaatcacagggcattcatcagcttctgcaagcagagaagcgggcaaaagataagttggaggaggcaaagaagattttgcacctgttatttcttaagcggcgggactgggactgtttctggaagcgaaaggcgatcgaagccagtcagggaggttccaacggcaggaactag

SEQ ID NO: 24518 - DNA, 375 bp, Artificial Sequence
  Description of Artificial Sequence: Synthetic coding sequence
atgactagtcagagtcagggaattcaccagctcctccaggcggaaaaacgcgccaaagacaaactggaggaagctaagaagaagacgggcactgcttccggtaaaggcaaaagattgaagcaggctaaggaagaggccatggtagaaatcgaccagtatcgtatgcaacgtgataaggagtttcgattaaagcagtcaaagataatgggctctcagaataacttgagcgatgaaatcgaggaacagacccttggaaaaatccaagagctgaatggacactacaacaaatacatggaatctgttatgaatcagcttctgagcatggtgtgtgacatgaaaccagaaattcatgtcaattatcgagcaacaaactag

SEQ ID NO: 24519 - DNA, 357 bp, Artificial Sequence
  Description of Artificial Sequence: Synthetic coding sequence
atgacatctcagagccagggtattcaccagttattgcaagcagaaaaacgagccaaagacaaactggaagaagctaaaaagcgaaaaggaaaaagactcaagcaggcaaaggaggaagcgatggtggaaatcgatcagtatcgaatgcagagagacaaagagtttcgtttaaaacagagcaagataatgggaagccagaacaacttgtcagatgagatcgaggaacagactctcggtaaaatccaggagcttaatggccattacaataagtatatggagagcgtgatgaaccagttactttccatggtgtgtgacatgaaacccgaaatccatgtgaactaccgcgccacaaattag

SEQ ID NO: 24520 - DNA, 375 bp, Artificial Sequence
  Description of Artificial Sequence: Synthetic coding sequence
atgacttcacagagccaaggaatccatcaacttctccaggccgagaagagagccaaggacaagctcgaagaggctaagaagaagacaggtactgcttccggcaagggaaaaagactgaagcaagccaaggaggaagccatggtggagattgatcagtacagaatgcaaagggataaggagtttagacttaaacaatcaaaaataatgggaagccagaacaatcttagcgacgaaatcgaagagcaaacccttggaaaaatccaggagctcaatggacactacaacaaatacatggaatccgtcatgaaccagctcctgagtatggtctgcgacatgaagcctgagatccacgttaactacagggcaacaaactag

SEQ ID NO: 24521 - DNA, 360 bp, Artificial Sequence
  Description of Artificial Sequence: Synthetic coding sequence
atggccgggcgaggaaagctgatcgcagtgatcggcgacgaggacacagttactgggttcttattggggggtataggggagttgaataagaaccgtcatccgaactttctggtggttgaaaaggacactactatcaatgagatcgaagacacatttcggcagtttctgaatcgcgatgatattggtattatcctgattaaccaatacattgctgagatggtgcgccacgcactggacgctcaccagcagtctatcccggccgtgcttgagattccttctaaagagcatccatacgatgctgccaaggactcaattctgagaagagcgagaggaatgtttactgcagaagatcttagatag

SEQ ID NO: 24522 - DNA, 681 bp, Artificial Sequence
  Description of Artificial Sequence: Synthetic coding sequence
atggcgctctcagacgtggacgtcaagaagcagatcaagcacatgatggctttcatcgagcaggaagccaatgagaaagccgaggaaatcgacgcaaaggccgaggaggagtttaatattgagaaaggacggctggtccagacgcagagattgaagatcatggagtattacgagaagaaggaaaagcagatagagcaacagaaaaaaattttgatgtctaccatgcgtaaccaggcccggctgaaggtgctaagggcgaggaacgatctgatttctgacctgctgtcagaagcaaagttaaggctctctcgaattgtggaggacccggaggtttaccagggactcttggacaaactcgtattgcaaggtctactccgactgctggaacctgtcatgatcgtaaggtgtcgacctcaggatcttctgctcgtagaggctgctgtgcagaaggccatccccgagtacatgacaatctcacagaagcacgtggaagtgcaaatcgacaaggaagcctacctggcagtgaatgctgccggtggtgtcgaggtctacagtggtaatcaaaggattaaggtctcaaacacactggaatcccggcttgacctttctgccaaacagaaaatgcccgaaattcggatggctctatttggtgccaatacaaataggaaattctttatctag

SEQ ID NO: 24523 - DNA, 681 bp, Artificial Sequence
  Description of Artificial Sequence: Synthetic coding sequence
atggcgcttagcgacgtggatgtgaagaagcaaatcaagcatatgatggcttttattgagcaagaagctaacgagaaagctgaagagatcgacgcaaaagctgaggaggagtttaatatcgaaaagggccggctggttcagactcaaaggctcaaaatcatggaatattatgagaagaaagaaaagcagattgagcagcaaaaaaagatccttatgtcaactatgaggaaccaggcccgactaaaagtgctccgggctaggaatgacctgatctctgatttactcagcgaagccaagcttcggctgtcgaggatcgttgaagatcccgaggtttatcagggactcctggacaaactcgtcctgcaggggctcctacgcctgctggaacctgtcatgatcgtaagatgcaggccccaggacctgctcttggtagaagccgccgtgcaaaaggccatccccgaatatatgaccataagccagaaacacgtcgaggtccaaatcgataaagaggcgtatctcgccgtcaacgctgctgggggcgtcgaagtgtacagtggcaatcagcgaattaaggtaagtaacacactggagtcacgactggatctatccgccaaacagaaaatgccagagattcgcatggctctgttcggcgctaacacaaataggaagttctttatttag

SEQ ID NO: 24524 - DNA, 999 bp, Artificial Sequence
  Description of Artificial Sequence: Synthetic coding sequence
atggctgccgtgttcctggttaccctgtacgaatactcaccactgttttacatagccgtggttttcacttgctttattgtgacaacggggctggtcctgggctggttcggatgggatgttcctgttatcctgaggaacagcgaagaaacacagttttctacgcgggtattcaagaaacaaatgcgccaggtgaagaatcccttcggcctagagatcacaaacccgtctagcgcatcgataactaccggcattaccctcaccacagactgcctggaggacagtctcctgacctgttattggggatgcagtgtccagaagctgtatgaggccctacagaaacacgtctactgtttccgtatcagcactccccaggccttggaagacgcgctgtattccgaatacttgtaccaggaacagtactttatcaaaaaagatagcaaagaggaaatatactgtcagctgccccgggacacaaaaatcgaagattttggaactgttccccgttcacgttaccccctggtggccctactgactctggcggacgaggacgaccgagaaatctacgatataatctccatggtctctgtaattcatattccagaccggacctacaagttgagttgcagaatcctgtaccagtacttgctgctggcccagggccaatttcacgatttgaaacagctgttcatgagcgccaataacaacttcactccaagcaataactcatcgagtgaagaaaaaaataccgatagatccctgcttgagaaggtcggcctatccgaatcagaagtggagccaagcgaagagaattccaaggactgcgtggtgtgccagaacgggacagtgaactgggtcctcctgccatgtagacatacatgcttgtgtgatgggtgcgttaagtacttccaacagtgcccaatgtgtcgacaattcgtgcaggagtccttcgccctgtgcagtcagaaggagcaggacaaggacaaacctaaaacgttgtag

SEQ ID NO: 24525 - DNA, 744 bp, Artificial Sequence
  Description of Artificial Sequence: Synthetic coding sequence
atgtcgggcaaagaccgcattgaaatctttccatctagaatggcacaaaccatcatgaaagctcgccttaagggggcccaaacgggacgcaatctactgaaaaagaagtctgatgctcttactcttcggtttagacagattctgaagaagatcatcgaaacaaaaatgctcatgggcgaagtcatgagagaagctgctttctctctggccgaagccaaattcactgcgggcgactttagcactaccgtcattcagaacgtgaataaggctcaggtcaaaatacgcgcaaagaaggataacgtggcgggggttactctgccggtgtttgagcactaccacgagggaacagactcctacgaactgaccggtctggctcggggcggggaacaactcgccaaattgaaacgaaattacgcaaaagccgtcgagctcttagtggaacttgcaagtctgcagaccagttttgtgaccctcgatgaagctatcaaaatcactaaccggagagtcaatgctatcgagcacgtcattattccacgaatcgagcgtaccttagcatatattatcacagagttagacgagagggagcgcgaagagttctacagactgaagaaaatccaggagaaaaaaaagatcctcaaagaaaaatcagaaaaagatctggaacagcgacgagccgccggcgaggtcctggaacctgccaatcttcttgccgaagaaaaggacgaggacttgttattcgagtag

SEQ ID NO: 24526 - DNA, 219 bp, Artificial Sequence
  Description of Artificial Sequence: Synthetic coding sequence
atgagcggtaaggatcgtattgagatcttccctagcaggatggcccagactatcatgaaggcccgactgaaaggagcccaaaccgggcggaacctgctaaaaaagaagagtgacgctctgaccctgaggttcaggcagatcctcaagaagatcattgaaactaaaatgctaatgggcgaggtaatgagggaggcagccttttccctcgcggaggcctag

SEQ ID NO: 24527 - DNA, 1053 bp, Artificial Sequence
  Description of Artificial Sequence: Synthetic coding sequence
atgcttgaaggggccgaactctatttcaacgttgatcatgggtacttagagggtttagtgcgcggctgcaaggcctctctcctcacccagcaagactatatcaacctggtccagtgcgagactctcgaggatctgaagatccatctccaaacgacagactatggcaattttctggccaaccataccaacccattgaccgtgtcaaaaattgacactgagatgagaaagcggttatgcggagagttcgaatatttccgtaatcacagtctggagcccctcagcacatttctcacttatatgacgtgctcttatatgatcgacaacgtcatactcttaatgaatggtgcacttcagaagaagagcgtgaaggagatcctcgggaagtgtcatcccctgggccggttcaccgaaatggaggccgttaatattgctgaaaccccatcagacctattcaacgcaatcctgatcgagactccattggcgccatttttccaagactgcatgagtgagaacgccctagatgagctcaacatcgagctattgcgcaataagctgtacaaatcctacttagaggcattctacaagttttgtaagaaccatggcgatgtcactgctgaggtgatgtgccccatcctggaatttgaggcagataggcgcgcctttattatcaccctgaactctttcggtactgagttgagcaaggaggacagagagacgctctacccaactttcggcaagctgtatcctgagggcctgagactcttagctcaggcagaagacttcgaccaaatgaaaaacgttgcagaccactacggggtgtataaaccactctttgaggcagtcgggggtagtggaggcaagaccttagaagacgttttttacgagcgcgaggttcagatgaatgttctggcttttaatcggcaattccactatggcgtcttctatgcttacgtcaagcttaaggagcaggagattcggaacatagtttggatcgccgagtgtattagccagcggcatcggacaaaaatcaattcttacattccaatattatag

SEQ ID NO: 24528 - DNA, 111 bp, Artificial Sequence
  Description of Artificial Sequence: Synthetic coding sequence
atgctggagggagccgagttgtatttcaatgtggatcatggatatctcgaggggctggtaagaggatgtaaggcctccctcctcactcaacaggattatattaacttgtag

SEQ ID NO: 24529 - DNA, 132 bp, Artificial Sequence
  Description of Artificial Sequence: Synthetic coding sequence
atgctcgaaggcgcggagctctacttcaatgtcgatcacggctacctggagggcttagtccggggctgtaaagccagtttgctcacccagcaggattacattaatttggtgcagtgcgagacattggagtag

SEQ ID NO: 24530 - DNA, 1284 bp, Artificial Sequence
  Description of Artificial Sequence: Synthetic coding sequence
atgagcgaattctggctgatatctgcacccggcgacaaagaaaacctgcaggctctggaaaggatgaacaccgtgacctcaaagagtaatttgtcatacaatactaagtttgccatccccgacttcaaggtaggtacattggattctctcgtgggtctctccgatgagctgggtaaactcgacactttcgccgaatctctcatcagaagaatggcccagtctgtcgttgaagtcatggaggattccaagggcaaggtccaggagcatctgctcgcgaacggcgtggatcttacctccttcgtcacacatttcgagtgggatatggccaagtacccagtcaaacaaccactggtttcagttgtggatacaatagcgaagcagctggcacagatcgagatggatctcaaatctcggacagccgcatataatactttgaaaacaaacctggagaacctggaaaagaagtcgatgggcaatcttttcactcgcaccctgagtgacatagtgagcaaggaggacttcgtcctggattctgaatatcttgtcaccttgctggtgatagtgccaaagcctaattatagccagtggcagaagacctacgagagcctgagcgatatggtggtcccccgcagtaccaagctaattacagaggataaggagggagggctgttcacagttaccttgttcagaaaagtgattgaggacttcaagacgaaggccaaggagaataaatttacagttagggagttctactatgacgagaaagaaatcgaacgtgagcgggaagaaatggctaggctgctttcggacaaaaagcagcagtatcaaacctcctgtgtcgctctcaagaaaggttcttcgacctttcctgaccataaggttaaagtgactcccctgggaaaccccgacaggccagctgccggacagaccgaccgggagcgcgaatccgagggtgaaggggaaggaccactgctgcgctggctgaaggtgaattttagtgaggccttcatagcctggatccacatcaaagcgctgagagtctttgttgaatctgtccttcgatatggattgcctgttaacttccaggcagtgctgctgcagcctcacaaaaagtcctccactaagcgcctgcgggaggtgctcaactcagtctttaggcacctggacgaggtggccgcaactagtatactcgacgcctcagttgagatccctgggctacagctcaacaaccaagattattttccctacgtgtacttccatatcgacctgagcctgctggattag

SEQ ID NO: 24531 - DNA, 1146 bp, Artificial Sequence
  Description of Artificial Sequence: Synthetic coding sequence
atgagtgagttttggctgattagtgcccccggcgacaaggaaaatctgcaggccctggagcgaatgaatactgttactagcaaaagcaacttgtcctataacaccaagttcgctattcctgattttaaagtcggcactctagattctttggttggactctccgacgagctgggcaagttggatacatttgccgaatcactgatccgccgcatggcgcagagtgtggtcgaggttatggaggattcaaagggcaaggtgcaggaacatctgctggccaacggggtggacctgacatcctttgtgactcactttgagtgggatatggctaaatacccagttaagcagccccttgtgtcagtggttgatactattgcaaagcaattggcgcaaatagagatggacctgaagtcaaggacagcagcctataataccctgaagaccaatctggaaaatctggagaaaaagagcatgggcaatctcttcacccgtaccctttctgatatcgtgagtaaggaggactttgtgctagattccgagtatctagttaccctcctagtcatagtaccaaaacccaattactctcagtggcagaagacttacgaaagcctgtccgatatggtcgtacccaggtcgacgaaacttattacagaggataaggagggcgggctttttactgtgaccctgttccgtaaggttattgaggacttcaaaacgaaggcgaaagagaataaattcacagtgcgggaattctactatgacgaaaaagaaatcgagcgtgagcgggaggaaatggctagactgctgtcagacaagaaacaacagtatggtcctttactgaggtggctgaaggtgaacttctccgaggcttttatcgcgtggatacacattaaagccctgcgcgtttttgttgagtccgtgttacgttacgggctgcctgtcaattttcaagctgtgctactccagcctcacaaaaaaagctctaccaaaaggctgcgcgaggtcctgaacagtgtgtttcgccacctggacgaagttgccgccaccagtatactggatgcatctgttgagattcccggtctacaattgaataaccaggattactttccatacgtctactttcatatcgacctgagcttgctggactag

SEQ ID NO: 24532 - DNA, 1398 bp, Artificial Sequence
  Description of Artificial Sequence: Synthetic coding sequence
atgactaagatggacataaggggcgccgtggatgctgcagtccctactaatatcatcgctgccaaagctgcagaagtgcgggctaacaaggtgaattggcagtcgtatctgcaggggcagatgatctctgctgaggactgcgagtttattcagcgtttcgaaatgaagcgtagtcctgaagagaagcaggaaatgctccagacggaggggtcccagtgtgcgaaaacctttatcaatctgatgacacacatatgcaaggaacagaccgtacagtatattttaactatggtagacgacatgctccaagagaatcaccagagagtctcgatcttcttcgattacgcgcgctgctcaaagaacactgcctggccgtatttcctccccatgttgaaccgccaggacccatttacggtacacatggccgcccggattattgccaaattggccgcctgggggaaagagctgatggagggcagcgacctcaattattattttaactggattaaaacacagctgagttcgcagtcgagccagtatgttcagtgtgttgcgggatgtctgcagttgatgctgcgagtgaacgagtacagattcgcttgggtggaagctgatggtgtaaactgcataatgggtgtgctttcaaacaagtgcgggttccaactgcaatatcagatgatctttagtatatggctgctggctttctcgcctcagatgtgtgaacacttgcggagatacaatataatccctgtcctctccgatatcctgcaagagagcgtcaaagagaaggtcacgcgaattatcttagccgctttccgtaactttctggaaaaatcaacagagagagagacccgccaggaatatgcactggccatgattcaatgcaaggtcctgaagcagctcgaaaacctggagcagcagaaatatgacgacgaagatatttctgaggatattaagttcctgctggaaaagctgggtgaatctgtgcaagatctgagtagctttgatgagtattccagtgagttgaagtcaggcagactcgagtggtctcccgtccataagtctgaaaaattctggagagagaatgccgtccgtctgaatgagaaaaattacgagctgctgaaaattctgaccaagcttctggaagtcagtgatgatccccaggtactggctgttgccgcacacgacgtgggcgagtatgttagacactatccccgtggcaaaagagtgattgaacagttgggcggaaaacagttagtgatgaaccacatgcatcacgaggatcaacaggtcagatacaatgccttgcttgctgtgcaaaagctcatggtgcataattgggaatacctggggaagcagctacagtccgaacaacctcaaacagctgctgcccgtagctag

SEQ ID NO: 24533 - DNA, 1452 bp, Artificial Sequence
  Description of Artificial Sequence: Synthetic coding sequence
atgaccaagatggacatccgaggagcagtcgacgcggccgtgcctaccaacattatcgccgcaaaggctgccgaggtgcgcgcgaacaaggtaaactggcagagttacctccaggggcagatgatttctgccgaggactgcgagttcatccaacggtttgaaatgaaaagatctccggaggagaaacaggagatgcttcaaactgagggctcacaatgcgctaaaaccttcatcaacttaatgacgcatatatgcaaagaacagaccgtgcagtacatccttaccatggtggacgacatgctgcaggagaaccatcagcgagtgtctatatttttcgactatgcacgctgtagtaagaatactgcatggccctatttcctgcctatgctgaaccgtcaggacccattcaccgtgcacatggctgctaggataatagccaagctcgccgcctgggggaaggaacttatggagggcagcgatttgaattactactttaactggatcaagactcaactgtctagccaaaagctgagggggagcggggtggcggtagaaaccggcactgtttcatcctctgacagctcccaatatgtacagtgcgtcgcaggttgtttacagcttatgctgcgggtcaatgaataccggtttgcttgggtggaggctgacggcgtgaactgcataatgggagtgctatcgaataagtgcggcttccagttacagtatcagatgatttttagtatttggctcttagccttctcacctcaaatgtgcgagcacctgcgcaggtacaatattattcccgtcctatccgacatcctccaggagtcagtgaaggagaaggtaacccgcattattctcgctgcgtttagaaacttcctggagaagtcaaccgaaagagaaacgcggcaagaatacgccttagccatgatccagtgtaaggtcttgaagcagctcgagaatcttgagcagcagaaatatgacgacgaagacatttccgaagatatcaagttcttactcgagaaactgggggaatccgtccaggacctgagcagcttcgacgagtacagttctgagttaaaaagcgggagactggagtggtcaccggtccacaagtctgaaaagttttggagggagaatgccgtcaggctcaatgagaaaaactacgagctgctgaagattctgacgaagctgcttgaggtgagtgatgatccccaggtgctagctgtagctgcccatgatgtgggcgaatatgtgcgtcattacccccggggcaaacgggtcatcgagcagttgggaggcaaacagttggtgatgaaccacatgcatcacgaggatcagcaggtgagatacaatgcacttctggccgtgcagaagctcatggttcacaattgggaatatctcggcaagcagctgcagtccgaacagccacagacagctgccgcccgcagctag

SEQ ID NO: 24534 - DNA, 1452 bp, Artificial Sequence
  Description of Artificial Sequence: Synthetic coding sequence
atgaccaaaatggatatccgcggcgccgttgatgctgccgtacctacaaacattattgctgctaaggcggccgaagtccgtgcaaataaggtgaattggcagagttatctccagggacagatgattagtgctgaagattgtgagtttattcagagatttgaaatgaaacgttctcccgaagagaaacaggaaatgctccaaacagaggggtcccagtgtgccaagacattcatcaatctgatgacccatatctgcaaggaacagactgtccagtatatccttactatggtagacgatatgctgcaggaaaatcaccagcgggtcagcatctttttcgattacgctcgttgcagcaaaaataccgcatggccttacttcctgccaatgctgaaccggcaggaccccttcaccgtccatatggccgccaggatcatagctaagcttgccgcctggggcaaggagctgatggaaggatcagacctcaattattattttaactggattaagacccagctgtctagtcagaaactgcgcggttctggagtggccgtcgagacgggtaccgtctcatcctccgactcctcccagtatgttcaatgtgttgccggatgtctacagctgatgttgcgtgtcaatgaataccgttttgcttgggtcgaagctgatggcgtgaattgtattatgggtgtcctgtccaacaaatgcgggttccaacttcagtatcagatgatctttagcatttggctactggcatttagtccccaaatgtgtgaacacttaaggagatataacattatccctgtgctcagtgacatattacaggagtccgtgaaagaaaaagtcacccgcatcatactggcagccttcaggaatttcctcgagaagtcaacggagcgagagactcgtcaggaatatgccctggcgatgattcagtgtaaagttctcaagcaacttgagaatcttgagcaacagaaatacgacgacgaggacatttcagaagacataaaattcctcctggagaaactgggcgaatctgtgcaagacttgagctcattcgacgagtactccagcgagctgaaaagcggccgtttggagtggagtcccgttcataaatccgaaaagttctggagagagaatgctgtgagactgaatgagaagaactatgaactcctcaagatactgactaaattgctggaagtgtcagacgacccccaagtcttagcagtcgcggctcacgatgtgggggaatacgtgcgacattacccacgcgggaagagagtgattgagcagctcggtggaaaacagttagtgatgaatcacatgcatcatgaggatcaacaagtgcgctataacgcgctgctggcggtgcagaagcttatggtacataattgggagtatctggggaagcaattgcagtccgagcaaccacagaccgctgcggcaaggtcttag

SEQ ID NO: 24535 - DNA, 309 bp, Artificial Sequence
  Description of Artificial Sequence: Synthetic coding sequence
atgacaaagatggatatcagaggagctgtggacgctgctgttcccaccaacatcattgccgccaaggcggccgaagtacgtgccaataaggtcaactggcagtcttacctgcagggccagatgatatcagcagaggattgcgagtttatccagaggtttgagatgaagcgatccccagaagaaaagcaggagatgttgcaaactgaaggatctcagtgtgctaagacttttattaatctgatgacccatatctgtaaggagcagacagtgcagtacattcttaccatggtagacgatatgctacaatag

SEQ ID NO: 24536 - DNA, 306 bp, Artificial Sequence
  Description of Artificial Sequence: Synthetic coding sequence
atgacgaagatggatattagaggcgcagtggacgccgccgtcccaacaaacatcatcgccgccaaggccgccgaagtgagagcaaacaaagttaattggcagagttacctgcaaggccagatgataagtgccgaagactgtgaatttatccagcggtttgagatgaagcggtcacctgaagagaaacaggagatgttgcagacagaaggctcccaatgtgctaagacattcatcaacttgatgacacatatatgtaaggaacagaccgtccagtacatcctaactatggtggacgacatgctgtag

SEQ ID NO: 24537 - DNA, 873 bp, Artificial Sequence
  Description of Artificial Sequence: Synthetic coding sequence
atgggcgatgggggggcggagagagaccggggacccgcccgccgcgctgagagtgggggaggtggaggcagatgcggcgatcggagtggcgccggcgacttaagggcagacggaggtggtcactctccaacagaagtggctggaacctctgctagttcaccagctgggagtcgtgagagcggtgccgactctgacgggcagcccggacctggagaggctgatcactgccgaagaatcctcgtcagggacgccaaaggcacgattcgagagatcgttttgccaaaagggcttgatctcgaccggccgaaaagaactcgaacaagtttcaccgcagagcaactctaccgattggagatggagttccaaagatgtcaatacgtggtcgggagagagcgcactgaactggcaaggcagctcaatctcagcgagactcaagtaaaggtttggtttcagaataggcgcactaaacagaaaaaagaccagtccagggacttggagaaacgcgcaagcagctcggcctcagaagccttcgctaccagtaacatcttaaggttgctggaacaggggaggcttctgagcgttcctcgggccccctccttgctggccttgacgccctccctgcctggattgcccgcctcccaccgggggacctccctgggcgatcctagaaacagctcacctcgactgaaccctctctccagtgcgtccgcgagcccgccgctgcctccaccactcccggcggtgtgtttttcatctgcacctctgcttgacctgcccgccggatacgagctcggatcgagcgctttcgagccgtactcatggttagaaaggaaagtcggatccgccagttcttgcaaaaaggcaaatacatag

SEQ ID NO: 24538 - DNA, 1491 bp, Artificial Sequence
  Description of Artificial Sequence: Synthetic coding sequence
atggccatggagatcgactctcgaccaggaggattgcctgggtcatcttgtaatctgggggcagctagagagcatatgcaggctgtgacccggaactacatcacccatccgcgggttacttacaggacggtttgctccgtgaacgggcccttggtggtcctggatcgagttaagtttgctcagtatgcggagattgtgcatttcactctgcccgacggcacacagagatctggacaggtcttagaagtcgctggtaccaaggccatcgtgcaggtgttcgaggggacctctggtatcgacgctcggaaaacgacctgcgagtttacaggagacatcctgcgaactccagtctccgaggacatgctgggcagggtgtttaacgggtccggcaaacccattgacaaagggcccgtggtgatggccgaggatttcttggatattaatggccaacccataaacccacatagtagaatatatcctgaggaaatgatccagacaggcatttccccaattgatgtgatgaacagcattgcccgcggccagaaaatacccattttctcagctgcgggtctcccccacaatgagattgccgcccagatttgtcggcaggcagggctggtgaagaaatcaaaggctgtcctcgactatcacgacgacaacttcgccattgtgtttgccgcgatgggagtcaacatggagacagcacggttttttaagtctgatttcgagcagaatggtactatggggaacgtttgcttgttcctcaacttggcgaatgatccaactatcgagcggataatcaccccacgtctggccctgaccaccgccgagtttctggcataccagtgcgagaagcacgtgttggtaattcttaccgatatgagctcttatgccgaggccctgcgcgaggtctcagcggcccgagaggaggtgccaggccgacgcggatttccaggatacatgtatactgacctagcaaccatctacgaaagggcaggcagagtggaagatattacacatcccattcccgacttgacagggttcatcactgaaggacagatttacgtcgacagacagttgcacaatagacagatctacccaccaataaatgtactgcccagtctgagcagactgatgaaatcagcaatcggcgagggcatgacccgcaaggaccacggtgatgtgagcaatcaactctatgcttgttacgccatcggaaaggatgtccaggcaatgaaggctgtagtgggtgaggaggccttaacatcagaagaccttttatatctggagtttctgcagaaattcgaaaaaaactttataaaccaggggccctacgaaaaccggtccgtattcgagtccctagatctgggatggaaattactgcgtatattccctaaagagatgttaaagcgaattccacaggcggtgatcgacgagttctactcacgcgagggcgccctgcaggacctagcccctgatacagccttatag

SEQ ID NO: 24539 - DNA, 1467 bp, Artificial Sequence
  Description of Artificial Sequence: Synthetic coding sequence
atgcaggccgtgacaagaaattacatcactcatccacgagtgacctaccgcactgtttgttcagtcaacgggcctctggtcgtcttggatagggttaagttcgcccagtacgcagagattgtccacttcacactgcctgatggaacacagagatctgggcaagtccttgaagtggccggcaccaaggccattgtacaggtttttgagggaacgtccggaattgacgccaggaagactacatgtgagttcactggtgacatactgcgcacccccgtctcggaggatatgctggggagagttttcaatggctcaggcaagcccatcgataagggcccggtggtcatggccgaggatttcctggacatcaatggtcagccaatcaaccctcatagtaggatctaccctgaagagatgatacagactggaattagtccaatcgacgtgatgaattctattgctaggggacaaaagattcccatcttcagcgcagcagggctgccccataatgagatcgcggcccagatttgtaggcaagccggcctggtcaagaaatccaaggccgtgctcgactaccatgacgacaattttgccatagtctttgctgcgatgggcgtcaacatggaaacagcacgcttcttcaaatccgatttcgagcagaacggtacaatggggaatgtttgcctgttccttaatttagccaacgatccaactattgaaaggattataaccccgcgtctggctctgacaactgctgagttcctggcctatcagtgcgagaagcatgtgttggtgatcctgaccgatatgtcaagttacgcagaggctctaagggaagtgtcagcagctagggaagaggtccccggtcggcggggttttccaggctatatgtatacagacctagcaaccatatatgagcgggccggtagagtggagggccgaggtggctccatcactcaaatccctatacttacaatgcctaatgacgacattacccatcctattcccgacttgacaggcttcatcacagaaggtcagatctatgtggacagacaactgcacaacaggcagatctaccctcctatcaacgttctaccatccctgtctagactgatgaagagcgccatcggagagggcatgaccaggaaagatcacggcgacgtcagcaaccaactgtacgcttgctacgccattggcaaggatgtccaggcgatgaaagcggtcgtgggtgaggaggcactgacatctgaagatctgctgtacctcgagtttctgcagaagtttgagaagaacttcatcaatcaggggccgtatgagaaccgctctgtatttgagagcctggacctcggctggaagctcctgcgaatctttcccaaagaaatgctgaagcggataccacaagctgtgattgacgagttttattctagggaaggagctctgcaggacttggccccagatactgccttgtag

SEQ ID NO: 24540 - DNA, 1536 bp, Artificial Sequence
  Description of Artificial Sequence: Synthetic coding sequence
atggcactgcgggccatgcgcgggattgtgaacggtgcagctcccgaactgcctgtaccaaccggagggcccgccgttggagcacgtgagcaggcactggcggtcagccgcaattatctctcgcagccgcgccttacttataagacagtgagcggggtgaatggtccacttgtcattctggaccacgtaaaatttccaaggtatgccgagattgttcacctaaccttgccagacggcaccaagcggtcgggccaggtccttgaggtctcaggtagcaaggccgtggtgcaggtttttgaaggcacatccggcattgatgccaaaaaaaccagctgcgagttcacaggcgacattcttcggacgcccgtctccgaagacatgttgggaagggtgttcaacggtagcggcaagcccatcgaccgtgggcctgttgttctcgccgaggactttctggatataatggggcaaccaatcaatccccagtgccgcatctacccagaagagatgatccagacggggatctccgccattgatggaatgaatagcatcgcgcgtggccagaaaatccccattttctcagccgctgggctcccacacaatgaaattgccgctcagatctgccgtcaggcaggattggtgaaaaagagtaaggacgtagtggattattcggaagagaacttcgctattgttttcgccgccatgggcgtgaacatggagactgccaggttcttcaagtcagatttcgaggagaacgggagcatggataacgtgtgcttgttcctcaacctcgcaaacgaccctaccatcgagagaatcatcacaccacggctagcactgaccaccgccgaattcctcgcgtaccaatgtgagaaacatgttttagttattctgaccgacatgagctcatacgccgaagcactgcgcgaagttagcgccgctcgggaggaagtaccagggaggagagggttcccagggtacatgtacacagacctagcaaccatctacgaaagagctgggcgtgtggagggtcgaaacggttcgattactcagattccaattttgaccatgccaaacgacgacataacacacccaatccccgacctaaccggctatatcaccgagggccaaatttatgtggaccgccagttacataaccgtcagatatacccacctatcaatgttctacctagtttaagccggttgatgaaatccgcaattggggaaggcatgactagaaaagaccacgctgatgtgtcgaaccagctctatgcctgttacgcaatcggaaaggatgtgcaggccatgaaagccgttgtgggggaagaagccctaacctctgacgacctcttatacctggaattcctacagaagtttgaacgtaattttattgcccaaggcccttatgaaaaccggaccgtatttgagactctggacataggctggcagttgcttaggatttttccaaaagagatgttgaagcgcattccccagagcacgctgtctgagttttaccctcgtgattccgcgaaacactag

SEQ ID NO: 24541 - DNA, 1158 bp, Artificial Sequence
  Description of Artificial Sequence: Synthetic coding sequence
atgctgggacgcgtgttcaacggaagcgggaagccgattgatcgcggcccagttgtgctggcagaggactttttggatatcatgggtcagcccataaatccacagtgccgcatttacccggaggagatgatccaaacaggcataagtgccatagatggcatgaactcaattgccaggggccagaagatccccatattttcagccgccggactgccccataatgagatcgccgcccagatttgccgtcaggccgggctcgttaagaagtctaaggatgtcgtggactactccgaagaaaactttgccatcgtgttcgccgccatgggcgttaatatggaaactgcaaggttctttaaatctgacttcgaggaaaatggatccatggacaatgtgtgtctttttcttaatttagctaatgatcccacaatcgaaagaatcatcaccccaagactcgcccttaccacagccgagttcctcgcataccagtgcgagaaacatgtgctggttatactgacagacatgtcatcctacgcagaggcccttcgcgaggtgagcgccgcacgcgaggaggtcccaggtcgacgtggttttcccgggtacatgtacaccgacctggcaactatttacgagagagcaggaagagtggaaggccgaaatggcagtattacacagatcccgatccttacaatgcccaacgacgacatcactcaccccataccagacctgacgggttacattacagagggacaaatatacgttgaccggcagttacataaccgacaaatctaccctccaattaacgttttgccttctttatcccgcttgatgaagtccgcaatcggagaggggatgacacggaaagatcatgccgacgtttctaatcaactgtatgcctgttatgctatagggaaagacgttcaagccatgaaggcagttgttggcgaggaagcactgaccagtgatgatctgctttacctggagttcctccagaaatttgaacgcaactttattgcccagggaccatatgaaaataggactgtgttcgagaccttggacatcgggtggcagctgctgcgtatcttccccaaagagatgcttaagcggattccccagagcaccctttctgaattctaccccagggactcagccaaacactag

SEQ ID NO: 24542 - DNA, 1854 bp, Artificial Sequence
  Description of Artificial Sequence: Synthetic coding sequence
atggacttttctaagctccccaagatcctggacgaggataaagaaagcaccttcggatatgtgcatggagtctccggtccggtggtaacagcctgtgacatggccggtgctgcgatgtacgagcttgtgcgtgtgggacatagtgaactggtcggggagattatacgcctcgagggagatatggccacaatacaggtgtatgaagagacaagtggggtgtccgtgggagaccccgtgctcaggacaggaaagccactctctgtcgagctggggcctggtatcatgggggcaatcttcgatggcattcaaaggcctctgtcagacatctcttctcagactcaatccatctatatacccaggggcgtgaatgtgtcagccctgagcagagacatcaaatgggatttcacgccctgtaagaatctgagggttgggagccatatcacagggggagatatctacggaatagtgtcagagaactcgctgattaagcacaaaataatgctgcctccccggaatagggggactgttacttatatcgcaccaccaggtaattatgatacaagtgatgttgtactcgaactggaattcgaaggcgttaaggaaaagtttactatggttcaggtttggccagtcagacaggtaaggccagtaaccgaaaagctgcctgccaaccatccacttctaactggccaacgcgtccttgacgctctgttcccctgtgtacagggcggcaccactgcgattccaggcgccttcggctgcgggaagaccgtgatatcacagtcccttagtaagtacagcaatagcgatgtgataatatacgtgggttgcggagagagaggtaatgaaatgagcgaagtgctgcgcgattttccggagctcactatggaggtagatgggaaagttgagtcaattatgaaaagaactgccctggttgccaacacgtccaacatgcccgtggctgctagagaggctagtatatacacaggtataacgttgagtgagtactttagagatatgggataccacgttagcatgatggccgacagcactagtcggtgggcagaagcgctcagagagatcagcggtagactcgccgaaatgccagctgattctgggtatcctgcttatctgggcgcacgcctggcgtccttttatgagcgcgcaggacgtgtcaaatgcctcggcaacccagagagagaagggtcagtgtccattgtgggcgctgtttcgccacctggtggggatttctcagaccccgtgaccagcgctacactgggcattgtccaagtgttctggggccttgataaaaaacttgcccagcggaagcattttccatctgtcaactggcttatctcctacagcaaatacatgcgcgctctggatgagtactacgacaagcatttcaccgagttcgtgcctctgaggacaaaggccaaagaaatcctccaggaggaggaggacctcgctgaaattgtccagttggtgggcaaggccagcctcgccgagaccgataagatcacacttgaagtggctaaactgattaaggatgacttcctccagcaaaacggatatacaccttacgaccgcttttgcccattctataagacagtgggtatgctgagtaatatgatcgccttttatgatatggcaagacgagcagtggagactactgctcaaagcgataataagattacttggagcatcattcgagaacacatgggcgacattctgtacaaactatctagcatgaaatttaaggatcctctgaaagacggcgaggccaaaattaaaagtgattacgcgcagcttctggaggacatgcagaacgccttccgtagcctggaagattag

SEQ ID NO: 24543 - DNA, 666 bp, Artificial Sequence
  Description of Artificial Sequence: Synthetic coding sequence
atggacttttcaaagctccccaaaatcttggatgaggataaggagtccacatttggatatgtacacggggtctccgggcccgtcgttaccgcctgcgatatggccggagccgctatgtacgagctcgtgagggttgggcatagtgagctcgtgggcgaaataatcagactggaaggggacatggcaacgatccaggtgtacgaagaaacttccggagtcagcgttggagatccagtgctgcgcactggtaagccactcagcgtggaacttggaccaggcattatgggtgctattttcgatgggattcaaaggccccttagtgacatttcatctcagacacagtctatctacatcccacgaggcgtcaatgtgagcgctctgtcccgggacatcaaatgggattttactccctgtaaaaatcttagggtgggttcgcatatcaccggaggagatatttatggtattgtgtcggaaaatagcttaattaagcacaagattatgctcccgcctcggaatagaggcaccgttacctacattgcgccgcctggtaactatgatacatccgatgttgtcctggaacttgaatttgagggggttaaagaaaagttcacaatggtacaggtctggcccgtcagacaggtcagacccgtgactgaaaagctgtag

SEQ ID NO: 24544 - DNA, 1755 bp, Artificial Sequence
  Description of Artificial Sequence: Synthetic coding sequence
atggcgggcgccgcaatgtatgaactggttagggtgggccatagcgagctggtcggtgagatcatcagactcgagggtgatatggctacaatccaggtttacgaggagacttcaggtgtgagcgtcggagaccccgtgcttcgaaccggaaagcctttaagcgtcgagcttggcccagggataatgggcgccattttcgatgggattcagagacctctctccgatatttcttctcagactcagagcatctatattcccaggggagtaaacgtgagtgctctgtcacgggatattaaatgggatttcactccctgcaaaaatctaagagtgggttcacacatcacagggggcgacatttatggtatcgtttctgaaaattctctcatcaaacacaaaatcatgctgccgccccgaaatcggggcaccgttacttatatcgcacccccaggaaactatgatacatctgatgtagttctggagctggagtttgagggcgtgaaggagaagtttacaatggtccaggtgtggcctgttaggcaggtgaggccagtcaccgagaagctacccgctaaccatccactgttgacaggtcagcgggttttggacgcactttttccttgtgtacagggaggcacgacagcaattcctggagcatttggatgtggcaagactgtaatctctcagagcctatcgaagtattccaattccgacgtcataatctacgtgggatgcggagaaagaggcaacgagatgagtgaggtgctgagagactttcctgaactaacgatggaggttgatggaaaagttgagtctattatgaagagaaccgcgcttgttgcgaacacaagcaatatgcccgtagccgcccgggaggcatctatttacactggaatcaccctctctgaatattttcgcgatatggggtatcacgtatcaatgatggctgacagcactagcagatgggcggaagctttgcgggagatctcaggtcgactggctgagatgcccgccgatagcggctaccctgcttacctgggtgcccgactggcaagtttctatgaacgagcaggtagagtgaaatgcctggggaaccctgagcgtgaaggctctgtgtcaatagtgggcgcagtgagtccgccaggcggtgatttcagcgatcccgttacctcagcaacattagggatagtgcaggtgttctggggcctggacaagaagctggctcagcgcaaacacttcccctctgtaaattggctgattagttacagcaaatacatgagagccctggacgaatattatgataaacattttacggaatttgtcccactgaggacaaaagccaaggagattctccaagaagaggaggatctggccgagattgtgcagctggtcggaaaggcaagcctggccgaaaccgacaagattactctggaggtcgctaaactgatcaaagacgattttctgcaacagaacggatatactccctacgatagattctgtcccttctacaaaacagtcggaatgctcagtaacatgattgccttttacgacatggcccgccgtgctgtcgaaacaaccgcacagagcgataacaagataacgtggtctatcatccgagaacatatgggagatattctgtacaagttaagctcaatgaagttcaaggaccccctgaaggacggagaggccaagatcaagtctgattatgcacaactgttggaagacatgcagaacgccttcaggtcgcttgaggactag

SEQ ID NO: 24545 - DNA, 1005 bp, Artificial Sequence
  Description of Artificial Sequence: Synthetic coding sequence
atgtcagaagtgctccgcgacttccctgagctgacgatggaagtagatgggaaagtggagtccatcatgaagcggacagcccttgtggctaacactagcaacatgccggtcgctgctagagaagctagcatatataccggtattacactctctgaatatttcagagatatgggatatcacgtgagtatgatggcagattctacatcacgttgggccgaagctctccgagagatctccggccgactggcggaaatgccggcggacagtggttaccctgcctaccttggggcccggttggcctcattttacgagcgcgctgggcgcgtgaaatgcttaggtaaccccgagcgggagggcagtgtgtcaatagttggcgcagttagccctccagggggggacttttcggatcccgtcacttcagcaaccttgggtatcgtgcaggtcttctggggccttgataagaagctggctcagagaaaacactttccctctgtcaactggttgatctcttattcaaagtacatgcgcgcgctagacgaatactatgacaagcatttcacggaattcgtccccctgaggactaaagccaaggagatccttcaggaggaggaggacttagccgagattgtgcaactcgttggtaaggctagcctggccgaaaccgacaagattacactcgaagtcgccaagctgatcaaagatgacttcctgcagcaaaatggatatactccctacgatagattctgcccgttctacaagacagtgggaatgttgtctaacatgatcgctttttacgatatggcgagaagagctgttgaaaccaccgcccagagtgacaacaagatcacctggagcattatccgcgagcatatgggcgacatcctttacaaactgagctcaatgaagtttaaggatccattgaaagatggggaagccaagataaaaagcgactacgcacaactgctggaggatatgcagaacgccttcagatccctggaagactag

SEQ ID NO: 24546 - DNA, 246 bp, Artificial Sequence
  Description of Artificial Sequence: Synthetic coding sequence
atggcttatcacggactcactgtgccgctgatcgtcatgtcggtgttttggggtttcgtagggtttctggtaccatggtttattccaaaaggacctaatcgaggtgtcattatcacgatgctagttacttgcagcgtctgctgctatctgttctggctgattgccatattagcacagctcaaccctctctttggtcctcagctgaaaaatgagacgatctggtatttgaaatatcattggccatag

SEQ ID NO: 24547 - DNA, 246 bp, Artificial Sequence
  Description of Artificial Sequence: Synthetic coding sequence
atggcttatcacgggttgaccgtgccgctgatcgtcatgagtgtgttctggggctttgttggcttcctggtgccctggtttatccccaaaggaccaaaccgaggtgtgattataaccatgctcgtcacctgcagtgtgtgctgttacctgttctggctgattgccatcctggcccaactgaaccccttgttcgggccccagctgaagaatgagaccatatggtatctcaaatatcactggccttag

SEQ ID NO: 24548 - DNA, 1413 bp, Artificial Sequence
  Description of Artificial Sequence: Synthetic coding sequence
atgatggccgccatggcaaccgcacgtgtgcggatgggacctcgatgcgcccaggctctgtggcgaatgccatggctgcccgtctttttaagcttagctgccgccgcagctgctgcagccgcagagcagcaagtgccactcgtcctgtggtcctcggaccgcgacctctgggctcctgccgccgatacccatgagggacacatcacctctgatttgcagctgtccacttatctggaccccgccctggagctgggaccgcgaaacgtcctgttgttcctccaggataagctctccattgaggacttcacggcctacggaggagtctttgggaacaagcaggatagcgcattctctaaccttgagaacgcgctggatttggctccctcctctctcgtcctcccagctgtggattggtatgccgtcagtaccctgaccacttatctgcaggaaaagctaggcgcatcccccctgcacgtggacctggctaccctacgtgagctgaagctcaatgcgtctcttccggcactcttgcttataagacttccctacactgcaagcagcggactgatggcgccacgggaggtgctgacaggaaacgacgaagttatcggacaagtcctgagcacactgaagtctgaggatgttccctacacagctgccctgacagctgtacgcccttcccgtgtcgctcgagatgttgcggtcgtcgctggcgggctgggtaggcagctgctgcagaagcagccagtcagccccgtcatccaccctcctgtgtcgtacaatgataccgcccccagaatactgttctgggcccagaatttcagcgtagcttacaaagaccagtgggaagacctcaccccgctcacgtttggcgtgcaagagctcaatttgaccggatctttctggaatgatagttttgcccgcctctccctcacatacgagcgactcttcggcaccaccgtgacttttaaatttattctcgcaaaccgactctacccagtgtcagcccgacactggttcactatggaacgcctggaagtgcacagcaatggatccgtggcctactttaacgcaagccaagtgaccggacctagtatctactcctttcactgtgagtatgtgtcatcgttaagcaaaaaaggcagtctgctggtggcgagaacacaaccctctccttggcaaatgatgctacaagatttccaaattcaggctttcaatgtcatgggtgagcaattctcttatgcatctgactgcgcaagcttcttcagccccgggatatggatggggctgctgacctccttatttatgttatttatattcacgtatggcttgcacatgatcctttccctgaagacgatggaccgcttcgacgaccataaagggcctactatttctcttacacagatcgtatag

SEQ ID NO: 24549 - DNA, 822 bp, Artificial Sequence
  Description of Artificial Sequence: Synthetic coding sequence
atgatggccgctatggctacggccagggtacgtatgggtccaaggtgtgcccaggctctctggagaatgccttggttgcccgtcttcctctccctcgctgccgcagccgcagccgccgctgcagaacagcaagttccactggtgctgtggagctcagacagagatctatgggcacctgccgctgacactcacgagggccatattaccagcgaccttcagttgtctacatatttggaccctgccttggaactgggtccacggaacgttctactatttctccaagacaagcttagcatagaagactttaccgcatatggcggcgtgtttgggaataagcaggattcggccttttcgaacttggaaaacgccctggaccttgctccgtcaagtctggttctgccggcggttgattggtatgcagtgagcaccctgaccacatatttgcaggagaagttgggcgccagtcctctgcatgttgctagagatgtagccgtcgtggcaggtgggcttgggaggcagctcctccagaaacaacctgtgagtcctgtaattcacccccccgtgtcttacaacgacacggcaccgcgaattttattttgggcacagaatttctccgtcgcctacaaggatcaatgggaggacctgacccctcttacatttggggttcaggaactgaaccttaccggtagcttttggaacgattcattcgccagattcatattggccaacaggttgtaccctgtctcagctaggcattggttcacaatggaacgcctggaagttcactccaatggatccgtggcttactttaacgctagttag

SEQ ID NO: 24550 - DNA, 885 bp, Artificial Sequence
  Description of Artificial Sequence: Synthetic coding sequence
atgaaagccacatcacccgcaacctgttcgagcggactcatggcgcctagagaggtcctgacaggaaacgatgaggttattggacaagtgctctccacattaaagagcgaggacgttccatacacagccgccctgaccgctgttcggccttctcgcgttgcaagggacgttgctgttgtggctggaggtctggggaggcagctgttgcagaaacaaccagtgagcccagttattcacccacccgtcagctataacgatactgccccgagaatattattttgggcccagaatttttctgtggcgtacaaagatcagtgggaggacttgactccactcacattcggagtgcaagagctaaatttgaccggctccttctggaatgactccttcgcccgtctctcactgacctatgagcgcttgttcggcacaacagtaacatttaaattcatacttgccaaccggctttaccccgtctccgcccgccattggtttacaatggaaagactcgaggtgcattccaacgggtcagttgcatacttcaatgcaagccaggtgaccggcccctccatctactcttttcactgcgagtacgtatcgagcctttccaagaaaggatcactcttagttgccaggactcaaccatccccatggcagatgatgttacaggatttccagatccaggccttcaacgtcatgggagagcagttcagctacgcatccgactgcgcctctttcttctctcctgggatctggatgggcttgctgacaagcctatttatgctgttcatcttcacatacggccttcacatgatactgtccctcaaaacaatggatcggtttgacgatcataagggcccgactatatcactgacccagattgtctag

SEQ ID NO: 24551 - DNA, 693 bp, Artificial Sequence
  Description of Artificial Sequence: Synthetic coding sequence
atgatggcagcaatggcaacagcgagggtgcgcatgggccccaggtgcgcacaggccttgtggagaatgccttggctgccggtcttcctgtcccttgccgccgcagctgctgctgcagcggcagagcagcaggtgcctctggtcttgtggtcgtccgatcgcgacctctgggctcctgcagccgacacacacgaggggcacattacctcagatctgcaattgagtacctacctcgaccctgcccttgaacttggcccccgcaatgtcttgctgtttctgcaggacaaactttccattgaggactttactgcctacggcggcgttttcggcaataaacaggatagcgcattctcgaatcttgagaatgcgttagaccttgcaccatcctccctcgtgctgcccgcagtcgattggtacgccgtatcaaccctgaccacctatctacaggaaaaactgggagccagtccgctgcacgtggacctggcaaccctaagagagttgaagcttaacgccagcctgcctgcacttctgcttatccggctcccttacactgcgagcagcggtcttatggcaccacgagaggtgctcactgacgaagttatcggacaggttctgagtacactcaaaagcgaagacgttccctacaccgccgcactcacggccgtacgaccttctcgggttgctcgcgactag

SEQ ID NO: 24552 - DNA, 675 bp, Artificial Sequence
  Description of Artificial Sequence: Synthetic coding sequence
atgcggctctggaaagcccgggtgctaaagctggttcttaagaccgccaaagacagccgattgggattaaactcaaagtggctctcgctgaaattgggcgatgccggaaatccacggtcattagccataagattcatcctcacaaattacaacaaactgtcaattcagtcctggttcagcctccgacgggttgagatcatttctaacaattctattcaggcagtgtttaatcccacaggagtgtatgcaccttccgggtactcttaccggtgccagcgcgtgggctctctgcaacaagaccaggcccttttattgcctagcgatactgatgacggtagttctctgtgggaggttacttttattgactttcagatccaaggatttgcaatcaagggcgggaggtttaccaaggcccaggactgtgcctcatcattcagccctgcatttcttatcggacttgcgatgtccctcatcctgctgctggtcctggcttacgcactgcacatgcttatctacctccgctatctggaccaacaatacgatctgatcgcatccccagcacacttctcacagctgaaggctagggatacagctgaagaaaaagagctcctccggagccagggggccgagtgctataaattgaggtcccagcagatctcaaagatttacgtctag

SEQ ID NO: 24553 - DNA, 675 bp, Artificial Sequence
  Description of Artificial Sequence: Synthetic coding sequence
atgcggctgtggaaggcaagagtcctgaaattagtacttaaaaccgccaaggatagtcggctgggactcaactccaagtggctgagcctgaaactgggtgacgccgggaatccgagaagtctggccatccggttcattctgacaaattataataaactcagtatccagtcctggtttagtctgaggagggtggagatcatcagtaacaattcaatccaggctgtgttcaacccaacaggtgtttacgctcccagcggctacagctaccgctgtcagagggtcggctcactgcagcaagatcaggccctcttactaccctcagataccgatgacggcagcagcctctgggaggtaactttcattgacttccagattcagggcttcgccattaaagggggccgcttcaccaaggctcaggattgtgcctcctccttcagtcccgcttttttgattggtctggccatgagccttatcctgctcttggtgttggcgtacgctctacacatgcttatctacctgcgttatttggatcaacagtacgatctcatcgcatcacccgcccacttttcacagctcaaagccagggacacagctgaggagaaagagcttctacgttcccagggggccgagtgttacaagctgcggtcccaacagattagcaagatctatgtctag

SEQ ID NO: 24554 - DNA, 3327 bp, Artificial Sequence
  Description of Artificial Sequence: Synthetic coding sequence
atgtttttgggtctgggacgtttctcaagactcgtcctgtggttcgcagcttttagaaaactcttgggacaccacggactggcctccgcaaagtttttatggtgtctgtgcttgctgtcagtgatgtccctgcctcaacaggtctggaccctgccatataagataggcgtggttggcccttgggcatgcgattccctcttttccaaagctctacctgaagtggccgcccggctggcgatcgagcggataaaccgagatccctcctttgatctgtcctattcctttgagtatgtgatcctgaacgaggactgtcagaccagtagagcactgtcttcttttatctcccaccaccaaatggctagcgggttcatcggaccaaccaacccaggctattgtgaagctgcttctttgttgggcaacagctgggacaaggggatcttttcctgggcatgcgtgaactatgaattggataacaagatatcttatcccactttcagtagaacactgccgtcgcctattcgggttctagtgacggtgatgaaatactttcagtgggcccacgccggggttattagctcagacgaggacatctgggtccacactgccaatagggttgcttccgcgctccgtagccacggacttccagtcggcgtcgtactcaccaccggtcaggattcccagtccatgcgcaaagccctgcagagaatccatcaagctgacagaatcagaattataataatgtgcatgcattctgcccttataggcggcgagacacaaatgcacttgctcgagtgtgcccatgacctgaagatgaccgacggaacgtacgtcttcgttccttatgatgccctgctatactcgctgccttataaacatactccctaccgagtactccgcaataaccccaagctgcgtgaggcttatgacgctgtgctgacgataacagttgagtcccaggagaaaactttctaccaggccttcaccgaggcagccgccagaggggagatacccgagaaacttgaatttgaccaggtgtccccattgttcggtactatttacaactccatttattttatcgcccaagctatgaacaatgctatgaaagaaaacgggcaggccggagcggcctctctcgtgcagcactctaggaacatgcagtttcacggattcaatcagttgatgcgcacggattccaatggaaatgggatctctgagtacgtgatcctggatacaaatctaaaagagtgggagttgcactctacctacaccgttgacatggagatggaacttctgagattcggcggcactccaattcatttcccaggtggaaggccgcctcgggctgacgcgaaatgctggtttgccgaagggaagatttgccatggtggtattgatcctgcctttgccatgatggtgtgtcttacgcttctgatcgctctactgagcattaacggcttcgcatactttatccggaggagaataaacaagatccagctgatcaaaggacccaacaggattctgttgacattggaagacgtcacgtttatcaatcctcacttcggctctaaacgcggatccagagcctctgtctcctttcaaattacatcagaagtacagtctggtagatccccacggctctccttctcctccggaagcctgacacccgctacctacgaaaacagcaacatcgcgatctatgagggggattgggtgtggctgaaaaagtttagcctgggcgattttggggaccttaaatcaatcaagtctcgggcctcagatgtgttcgagatgatgaaggacctgcgtcatgaaaacattaacccactgctgggtttcttctacgattctggcatgttcgccatcgtgaccgagttttgtagccgtggatccctggaagacatactgacgaatcaagacgttaagttagactggatgtttaaatcatcattgcttttggatcttatcaagggaatgaagtatctgcaccatcgcgagtttgtgcacggcaggctgaagagtcggaactgtgtcgttgatggccggttcgttctgaaagtaacagactatggttttaatgacatcctggaaatgttgaggttgagtgaggaggaatcctcgatggaggaattgttgtggaccgcgcctgaactgctgagagcaccgagggggagtcggctgggctcgttcgcaggagacgtttacagtttcgccattatcatgcaggaggtgatggtgcgtggcaccccattttgtatgatggatctgcccgcacaggagatcataaaccggctaaagaaaccccccccggtttacagacccgtggtaccacccgagcacgccccgcctgaatgtctacagctcatgaaacagtgttgggctgaggccgctgagcaacgacctacatttgatgagatatttaaccagttcaagacattcaacaagggcaagaagaccaacataatagacagtatgctgcgcatgttagagcagtatagttccaatctcgaagatctgataagagagcgaacagaggagctggaaatcgaaaagcaaaagacagagaagctgctcacacaaatgctcccaccgtctgtcgctgaaagcctgaagaagggctgtacagttgaaccagaaggtttcgatctggtaaccttatacttcagtgacatagtcggctttaccaccatcagtgcgatgtctgagcctatcgaagttgtagatctgctaaatgacctgtatactcttttcgacgctataattgggtctcacgacgtttacaaggtcgagaccataggcgacgcttatatggttgcttctgggctaccgaagcgcaacgggtctagacacgccgctgaaattgctaatatgtcattggatatcctaagcagcgtgggcacattcaagatgcgtcacatgccagaagtgccagtaaggataagaatcggcctccacagcggacctgttgtggccggagtcgtcgggctcaccatgccgcgctactgtctctttggcgacaccgtcaatactgccagccgcatggaatcaactggcctaccatacagaatacacgtctccttgtctaccgtgacaattttgcagaatctgagcgaaggatatgaggtggagctccgaggccgaaccgaactgaaaggcaagggcaccgaggaaaccttttggctgattggtaaaaagggattcatgaaacctttgccagtgcctcctcccgtggataaggatggacaggtggggcatggccttcagcctgtggagatcgccgcctttcagcgccgaaaggccgagaggcaattggtaaggaacaaaccttag

SEQ ID NO: 24555 - DNA, 1062 bp, Artificial Sequence
  Description of Artificial Sequence: Synthetic coding sequence
atgagaaggcagctgaggagtcgccgtgccccgagctttccttactcctaccggtacaggctcgatgacccggatgaggctaaccagaattacctggccgatgaagaagaggaggcagaagaggaagcacgggttaccgtggtgcctaagtccgaggaagaggaggaggaagaggagaaagaagaggaggaggaggaggagaaagaagaagaggagggacaggggcaacctaccggtaacgcctggtggcagaagctccagattatgtccgaatatctctgggaccccgagcgcagaatgttcctggccaggacggggttgattttactgatctacttttttttttatgcgtctctcgccgccgtgataacactctgcatgtacacgcttttcctgaccatttccccatacatccctacattcacagaacgtgttaagccccccggagttatgataaggccatttgcacattcattgaactttaatttcaatgtatcagaaccagatacctggcagcactatgtgatcagtctcaacggctttctgcagggctacaacgactccctccaagaagagatgaatgtcgattgcccaccaggccagtatttcattcaggacggcaacgaggatgaggacaagaaagcctgccagtttaaaagaagctttctcaaaaactgtagcggtcttgaggaccctacttttgggtattccaccggacaaccttgtattctactaaaaatgaatcgtattgttggcttcaggccagaactgggcgaccccgttaaggtgagttgtaaggtacaacgaggagatgaaaacgacatccggtcaatcagctactaccccgagtctgcctctttcgatctccgctattacccctactatggcaaattgacccatgtgaattatacatccccgttagtggcgatgcacttcactgatgtggtgaagaatcaggccgtacctgtgcagtgccagctgaaaggcaagggagttatcaacgacgtcatcaacgaccggttcgtgggtcgggtcatcttcacgttaaacatcgagacctag

SEQ ID NO: 24556 - DNA, 945 bp, Artificial Sequence
  Description of Artificial Sequence: Synthetic coding sequence
atgcgcaggcagctccgcagccgacgtgctccctcctttccctatagttaccggtatcgactggatgatcctgatgaggctaaccagaactatttggctgacgaagaggaagaagcagaggaggaagcgcgtgtcacagtggtgccaaagagcgaggaggaggaagaggaggaggaaaaggaggaggaagaggaggaagagaaagaagaagaggaaggccagggacagccaacaggcaacgcttggtggcagaaactccagattatgagcgagtacctgtgggaccccgaacggagaatgttccttgcccgcacagggcagtcatggcgggtaatgattcgaccctttgctcatagcctgaactttaattttaacgtctctgagcctgatacatggcagcattatgtgatttcactgaatgggttcctccagggctacaatgactctctgcaggaggagatgaacgtggattgccctccaggccagtactttattcaagacggaaacgaggacgaagataagaaggcatgccagtttaaacggtccttcctgaaaaactgtagtggcctagaggatccaaccttcgggtatagcactggacagccttgcattctcctgaagatgaatagaatagtgggttttcgccctgagctcggcgatcccgtgaaggtatcctgcaaagttcagcggggggatgagaacgatattcgatcaatttcgtattaccctgagtccgcaagcttcgatctcaggtactacccgtactatgggaagctgactcacgtgaattataccagccctttagtggccatgcactttactgatgtagtcaaaaatcaggctgttccagtacaatgccagcttaaagggaaaggagttatcaacgacgtaatcaatgaccgcttcgtgggaagagtgatcttcaccctgaacatcgagacgtag

SEQ ID NO: 24557 - DNA, 381 bp, Artificial Sequence
  Description of Artificial Sequence: Synthetic coding sequence
atggtcgacgagaatgatattcgcgctttaaacgtgagacactaccgggatcacatcggcgtggtgtcccaggaacccgtcctatttggcacaacaatcagtaataatatcaaatacgggagggacgatgtgaccgatgaggagatggagcgcgctgctcgcgaagcaaatgcctacgactttataatggagtttccaaacaagttcaataccctggtcggcgaaaagggcgcccagatgagcggaggacaaaagcagcgaattgctattgcccgcgccctggtaaggaacccaaaaatcctgatcctcgacgaggccacttccgctcttgatagcgagtctaagagcgctgtccaagctgcattggaaaagaaaaagtag

SEQ ID NO: 24558 - DNA, 2439 bp, Artificial Sequence
  Description of Artificial Sequence: Synthetic coding sequence
atggtagatgaaaacgacattagggctctaaacgttagacactacagagaccacattggtgtggtaagtcaggagcccgttttgttcggaacaacaatcagcaataatatcaaatatgggcgggatgacgtaacagacgaagagatggagagagcagctcgagaggcaaatgcctatgattttatcatggagttcccaaacaaatttaacacccttgtgggggaaaagggcgcccagatgagcgggggtcaaaagcagcggattgccatcgccagggcactggtccgaaatcccaaaatcctcatcctggacgaggccaccagtgctttagattcggagagcaagagcgccgtgcaggctgctctggagaaggcaagcaagggtaggactaccattgtggtggctcaccgcctgtcgaccattaggagcgctgatctcattgtcactcttaaagatgggatgctagccgaaaagggtgcccacgctgaactgatggcaaagcgcgggttatactattccctggtgatgtcccaggatattaagaaagctgacgaacaaatggagagtatgacatactccactgagcgaaagacaaatagccttccgttacacagcgtgaaatccattaagtccgacttcatcgacaaagccgaagaaagcacccagtccaaagagattagccttcccgaagtgagccttctgaagattctgaagcttaataagcccgagtggccttttgtcgtgttgggcaccctggcctccgtgcttaacggtacagtgcatccagtgttcagcattattttcgctaaaatcataaccatgtttgggaataatgataaaaccaccctgaaacacgacgccgaaatctattctatgattttcgtgattctgggggttatctgttttgtgtcttactttatgcaaggacttttttatggcagagcaggtgagatcctgacgatgaggctcagacaccttgcgttcaaagcgatgctgtatcaggacatcgcttggttcgatgaaaaagaaaactcaaccggtggcctcacaacaatacttgcaattgacatcgctcaaattcagggcgccacggggtccaggatcggcgttttgactcaaaacgctactaacatgggcttgtccgtgataataagtttcatctatggatgggagatgactttcttaatcctgtcgattgctccagtgctggctgtgacaggcatgattgaaacagccgcaatgacaggcttcgcaaacaaggacaagcaggagctcaagcacgcgggcaagatcgccacggaagcgctggagaatattcgtacaattgtgtcactgactcgtgaaaaggcctttgagcaaatgtatgaggagatgctgcaaacccagcataggaacaccagtaagaaggcgcaaataattggtagctgttatgcctttagtcacgcctttatttactttgcttatgctgcgggcttcaggtttggggcatatctcatccaggctggccgaatgacccccgagggcatgttcatcgtattcacagctattgcctatggcgccatggcaataggtgagaccctggtccttgcccctgagtattcaaaagcgaagtccggggccgcacacttgtttgctctcctcgagaaaaaacctaacatagatagccgcagtcaggaagggaaaaagcctgacacgtgtgagggaaacctagagttccgtgaggtgagctttttttacccatgccggcctgacgtgtttatactgcgagggctttcactttctattgagagaggcaagactgtcgcctttgtagggtcgtctggctgcggtaagtctacctcagtccagcttttgcaaaggttgtatgaccccgtacagggccaggtgttatttgatggtgtcgatgctaaggagctaaacgtccaatggttgaggtctcagattgctatcgtgcctcaggaaccagtattatttaactgcagtatcgcggaaaatattgcttacggtgataattccagggttgtgccattggatgaaatcaaggaagccgcaaacgccgccaacattcatagtttcattgaggggctcccagaaaagtataacacccaggtcggattaaagggcgcccaactcagcgggggccaaaaacagagattggccattgcgagagcccttctgcagaaacctaagatcctgctgctcgatgaggccacatccgctctggacaacgacagcgagaaggtggtccaacatgcgctggacaaggcaaggacgggtaggacatgtctggtggttactcaccggctctctgctattcagaacgctgacctcatcgttgtgctacacaacgggaaaattaaagagcaaggaacccaccaggagttgctgcgcaacagggatatctatttcaagctggttaatgcacaatctgtgcagtag

SEQ ID NO: 24559 - DNA, 3774 bp, Artificial Sequence
  Description of Artificial Sequence: Synthetic coding sequence
atggagaactcagagcgcgctgaggaaatgcaggagaactaccagcgtaatggaaccgctgaggaacagccgaaactgagaaaagaagccgtcggaagcattgaaatcttccgttttgccgacggactggacattacactcatgattcttgggatcctagctagtctggtcaacggggcctgcttgcctctaatgccattagtgcttggcgaaatgagtgataacctgatatctggttgtctggttcaaacaaatactaccaattatcagaattgtacacagagtcaggagaagctgaatgaggacatgacactccttacactgtattacgtgggtatcggggtcgcggctctgatatttggctatatccagatcagcctgtggatcattacggccgcaagacagaccaagcggattcgcaagcagttttttcactcagtgctggcccaggacatcggttggttcgattcttgcgatatcggggagcttaatacgagaatgacagatgacatagacaaaattagtgacggaattggcgacaagatagctctgttatttcaaaatatgtccacttttagtataggactggctgtcggtctggtgaagggctggaaactgaccctcgtcacactaagtacctcaccacttataatggcttcagccgccgcctgcagccgtatggtcatctcgttgacatcaaaagaactgtccgcttattcaaaagccggagccgtggctgaggaggtcctgagctcgatccggacagtcatcgcctttcgggctcaggagaaagagctgcagcggtacacccagaacttaaaagatgccaaggattttggtatcaagagaactattgcatccaaggtttcccttggagctgtatactttttcatgaacgggacctacgggctggccttctggtacggaacctccctgatccttaacggtgaaccaggatataccatcgggactgttctggcggtttttttctcagtcatccactcttcgtactgcatcggggctgccgtaccgcacttcgaaacctttgctatagcaaggggtgccgctttccacatttttcaggtgatagataaaaagccctcaatcgacaatttctctaccgcaggatacaagccagaatcaattgagggaacagtcgaatttaagaacgtgagcttcaattacccttcccgcccatctattaagatcctgaagggcctgaatctgcggatcaagtctggagagacagtcgcgctggtgggcctgaacggaagcggtaaatcaaccgtggtgcagctgctgcagcgcctatacgatccagatgacggattcatcatggtggacgaaaacgacataagagcactgaacgtgagacattacagggaccatatcggagtggtttcgcaggagcctgtattgttcggaactactatctctaataatatcaagtacgggagagacgacgtcacggacgaagaaatggaacgcgcagccagggaggctaacgcgtacgacttcattatggaatttcccaataagttcaataccttggtgggcgagaaaggagcccagatgtcgggtggccagaaacagcggatcgccatcgccagggccttggtgcgaaacccaaagatcctgatcctggatgaagcgacgagcgcactagattctgaatccaagtccgccgttcaagccgccctggagaaggcatctaagggcaggaccaccattgtggttgcccaccggctgtctactattagatcagccgatctaatagtaacacttaaggatggcatgttagcagaaaagggcgcacacgccgagctgatggcaaaaagggggctatactactcactcgtgatgagtcaagacatcaagaaggcagatgaacagatggagagcatgacatacagcaccgaaaggaagaccaatagtcttccactccacagtgtgaagtctatcaagtctgatttcatagataaagccgaagaatctacacagtccaaagagatctctctgccggaagtgtccctgctcaagatcctcaagcttaataagcccgagtggccttttgtggtgctaggtaccctcgcatccgtcttgaacgggaccgtccacccagtgttttccattatcttcgcaaaaattattaccatgttcggcaacaatgacaaaaccactcttaagcatgacgctgagatatactctatgatctttgtgatcctgggcgtcatctgcttcgtttcatattttatgcagggcctcttctacgggcgcgccggggaaatcctaaccatgagattaagacatctcgctttcaaggcgatgctgtatcaagatatagcttggttcgacgagaaagaaaattcgacaggcggcctcacaacaatacttgcaattgatatagcccaaatccagggagcaactggatctaggatcggtgttctgacacagaacgcaaccaatatgggcttatctgtgatcatctcctttatatacggctgggagatgaccttccttattctcagcatcgctccagtcctggctgtgaccggcatgattgaaaccgctgcgatgactgggttcgccaacaaggacaagcaggagcttaaacacgccggaaagattgcaaccgaagcattggagaatattagaacaatcgtgagcttaaccagagagaaagcgttcgaacagatgtacgaagagatgctacaaacccagcacaggaataccagcaagaaggcccagatcatcggcagctgttacgctttctcccacgcttttatttactttgcgtatgctgctggcttcagatttggcgcctacttgattcaagcaggacggatgactcccgagggtatgttcattgtgttcactgctatcgcgtacggggccatggccattggtgaaacccttgtcctggccccagaatactctaaagccaaatccggagcagcacacctatttgctttgcttgaaaaaaaaccaaacatcgattcacggtctcaggaaggcaagaagcctgacacgtgtgaaggtaatctggagttcagggaagtgagcttcttttacccctgccgcccagatgtgtttatcctccgaggactgtcattgtctatcgaacgcggcaaaacggtagcattcgtcggatcttcagggtgcgggaagtccacatctgtgcaacttctccagcgcctgtatgaccctgtgcagggccaagttttatttgatggagttgacgctaaggaactgaacgtccagtggctgagatcccagattgcaatcgtccctcaggaacctgtactcttcaattgtagtatcgccgagaatatagcttatggcgacaattcacgggtcgttccattggatgagatcaaggaagcagcaaacgctgctaacatacactcttttatcgaaggactgcccgagaagtacaacacgcaagtgggtctaaagggagcccagctgtctggtggtcagaagcaacgcctagccatagcacgggctcttctgcagaaacccaagattttactcctcgacgaggccacatctgctttggacaacgactctgaaaaagtcgtgcagcatgcactggacaaggccagaactggtagaacgtgcctggtagtcactcaccgactcagcgcaattcagaacgcggacctaatcgtggttctgcacaacggtaaaatcaaagaacagggcacacatcaagaactgctgagaaatagggacatctactttaagctggtgaacgcccagagtgtccagtag

SEQ ID NO: 24560 - DNA, 396 bp, Artificial Sequence
  Description of Artificial Sequence: Synthetic coding sequence
atggtggatgaaaacgacattagagccctgaatgtgcggcactatcgggatcacattggggtcgtgtcccaagaaccagtgttgtttgggactactatcagtaataacataaagtacggacgggatgacgttacagatgaggaaatggagcgggccgcccgagaggccaatgcgtatgacttcattatggaattccctaataaattcaacactctggtgggggagaaaggtgcacaaatgtccggagggcagaagcaacgcatcgcgatagcccgggcgttggtacgcaatccaaaaattctaatccttgacgaagccacttctgccctggattccgagtccaagtccgccgtacaggccgccctcgaaaaggacactccaagatatagtttctag

SEQ ID NO: 24561 - DNA, 4749 bp, Artificial Sequence
  Description of Artificial Sequence: Synthetic coding sequence
atgcctcttgccttctgtggctctgagaatcactcggctgcctaccgcgtagaccagggcgtgctgaacaacgggtgtttcgtagacgcgctcaatgtagtgccacatgtgttcctgttgttcattacctttcctatactcttcatcgggtggggaagccagtcttctaaagtgcacatacatcacagtacctggctgcatttccccggtcataatctgcgctggattctgacatttatgctactgttcgtactcgtctgtgagatcgctgagggtatcctctccgatggcgtgacggagagtcaccacctgcatctctatatgcctgctggcatggcatttatggccgccgtaacatccgtagtgtattatcacaatatagaaacctcaaattttccgaaactcttgatcgcgttgctagtgtactggactctagccttcataaccaaaactattaaattcgtcaagttcctggaccatgcgataggctttagccaactgcgtttctgcctgactggcctacttgtcatcctgtacggaatgcttctgctggttgaagtgaacgtcatccgggtccgacgatatattttcttcaaaacaccacgggaggttaagcctccagaagacttacaggacctcggtgtccggtttctgcagcccttcgtgaacctattgtcaaaagggacctactggtggatgaacgccttcattaaaacagcgcacaaaaaaccgattgatctgcgcgcaattggaaagctgccaattgctatgagggctttgaccaattaccagaggctgtgcgaagcctttgatgcgcaggtgaggaaggacatccaagggacccagggcgccagggcgatctggcaggcgttgtctcacgcgtttggacgccgtctggtgctcagtagtacgtttcgaatcctggccgatcttctggggttcgcaggacccctgtgcatctttggaattgtggaccatctggggaaggagaatgatgtgttccaaccaaagacacagtttttaggcgtgtattttgtaagcagtcaagaattcctagctaacgcttatgttctggcggttctgctttttctcgccctgctgttgcaacgaacattcttacaggctagctattacgtggcgatcgaaaccggaatcaatctgcgcggcgccatccaaactaagatttacaataaaatcatgcacctctcaacatcaaacttgtcaatgggagagatgactgcggggcagatctgtaacctggtggctatcgataccaatcagctaatgtggttttttttcttatgtccaaacctttgggctatgcccgtccagataattgtgggggtgattctcctgtactatatcctgggtgtgagcgctttgatcggtgccgctgtgattatattgctggcccctgtgcagtacttcgtggccaccaagctgagtcaggcccaacgtagcaccttggagtatagcaacgaaaggctcaagcagacgaacgagatgctgcgcggtattaaacttctaaaactctacgcctgggagaacatcttcagaaccagagtagaaacaacccgcaggaaagagatgaccagcctcagggcattcgctatctacacaagcattagtatttttatgaacaccgcaatccccatcgccgctgtgctgatcacattcgtcggtcatgtctcatttttcaaagaggcagacttcagcccctccgtggctttcgcaagtctctccttgttccatatattggtcactcctctcttcctactatcctctgtagtcagatccaccgtgaaggcactggtgtcagtgcagaagctctctgagttcttatcctcggccgagattagagaagaacagtgtgctccacatgagcccaccccacaagggccagcatcaaagtatcaggctgtcccgctgagggtggtgaacagaaaaaggcccgctcgagaggattgccgtggactgaccggtccccttcagtctctggtgcctagtgctgatggcgacgctgataactgttgcgtgcaaatcatgggaggttattttacctggacccccgacggtataccgactttgagtaatataacaatccggatcccccgaggccagctgactatgatagtcgggcaagtcggctgtggaaagtcttccctattgctcgccgcactgggtgagatgcagaaggtttctggagctgttttttggtcctcaagtctcccagactccgaaataggcgaagatccctcgcccgagcgtgagacagcaacagacctcgatataaggaaaagaggcccggtagcttacgcgagccaaaagccctggctgctcaacgcaactgtggaggagaatatcatatttgagtctcccttcaataagcagcgatataagatggtgattgaggcttgctccctgcagccagacatcgacatcctgccccatggagaccagacacagatcggtgaaaggggcattaatttgagcggtggccagaggcaaaggatcagcgtggccagggctctgtatcagcacgcaaacgtggtcttcctcgatgaccccttcagcgccttagacattcatctgtctgatcacctgatgcaggcagggatcttagagctcctgagagatgacaaaagaaccgttgtgctggtgacgcacaaactgcagtacctgccccatgctgattggattattgccatgaaggatgggactatccagagagagggcacgctaaaagacttccaacgaagtgaatgtcagctgtttgagcactggaagactttaatgaatcggcaggatcaagaactcgagaaagagacagtgacagagagaaaggccaccgaacctccacagggtctttcccgcgcaatgagtagtcgcgacggcttactgcaggacgaggaagaggaggaggaggaagccgccgaatctgaggaagacgataacctttcctccatgctccaccagcgcgcggagataccatggcgagcttgtgctaagtacctgtcttctgcaggaatcctgttgctaagccttttagtcttttcgcagctcttgaaacatatggttttagtggccattgattattggctcgcaaaatggaccgactcagccttgacactcacccccgccgccaggaattgctcccttagtcaggagtgtacgctggaccagacggtgtatgctatggtattcaccgtgctatgcagcctcggtatagtcctgtgcctggttacgtcagtcacagtggagtggaccggattaaaggttgccaagcgcctacacagatcgttactgaacagaattatcctcgcccccatgcgctttttcgagaccaccccgttggggtcaattcttaaccgattctcttcagactgcaacactattgaccagcacatcccatcaacgcttgagtgcctatcaagatcaaccctgctgtgcgtgtccgcactggccgtgatctcctacgttactccggtgttcctggtggccctactcccactagccatcgtgtgctacttcatccagaagtattttcgtgtcgcgtcaagggacctccagcagctggatgataccacccaactgccactgctgtcccacttcgccgagaccgtggagggactcactacgataagggccttccgatacgaagctaggttccagcagaagcttttggagtacacagattccaataatatagcaagtctctttctgacagcggctaacaggtggctggaagttcgcatggagtatatcggagcttgcgtagttctgatagcggcagtcacgtcaatcagcaacagtttgcacagagagctgtctgctgggctggtcggcctaggcttgacctacgcactgatggtcagcaattatttaaattggatggttaggaacctggcagacatggaactgcagttgggcgctgtgaagcggatccatggactcctcaagactgaagcagagtcctacgagggtcttctcgctcccagcctcattcccaagaattggccagatcaggggaaaatccagatacagaatctgagcgtccgctacgattctagcttaaagcccgtcctgaagcacgttaatgccctaattgctcccggccagaagataggcatctgcggacgcaccggctctggcaaaagttcttttagccttgcctttttccggatggtcgacacttttgagggccacataattatcgacggcattgacatcgcaaaattgccactgcatacactgcgctcaaggctcagcattatcctccaggaccccgtcctgttttccgggactatcagatttaatttagatccagaaaggaagtgctctgattccaccctctgggaggcactcgaaattgcccaactgaagctcgtcgtcaaggctttacccggcggccttgatgctatcatcactgaaggaggggaaaatttttcccagggacagagacagctattttgtcttgccagggcattcgttcgcaaaacctcaatcttcatcatggacgaggccactgccagcatcgatatggccaccgaaaatatattgcagaaggtcgtgatgacagcttttgccgaccgaacagtggtaaccatagcccatcgcgtgcacactatcctgtctgccgacttagtcatagtgttaaagagaggcgctatcttggagttcgacaaaccggagaagcttctgtctcgaaaggatagcgtgtttgcaagtttcgtgagggccgacaagtag

SEQ ID NO: 24562 - DNA, 3036 bp, Artificial Sequence
  Description of Artificial Sequence: Synthetic coding sequence
agatctcagctgtcccccagcccagcaagagctagggctgctatgcccttggcattctgtggctcagaaaaccactcagccgcatatcgagtggatcagggggtcctgaataacggatgttttgtggacgccctgaacgtcgttcctcacgtctttctactctttatcactttccccatcctattcataggctggggctcacagtcctcaaaagtgcacattcaccatagcacctggcttcattttcctggtcacaacctgcggtggattctgacgttcatgctgctcttcgtgctggtgtgtgagatcgcagagggcatactgagcgatggagtcacagaatctcatcatctgcatctgtacatgcctgcaggaatggctttcatggctgcggtcacttcagtggtgtactaccacaacatcgagacttctaacttcccgaagttgctcatcgccctcttggtgtactggacacttgcttttatcactaaaaccatcaagtttgtgaagttcctcgaccacgcaatcggcttttctcagctgaggttctgtctgaccggcctcctggtgattctttacggaatgctgctgcttgtcgaggtcaatgtgattagggtccgccggtatatcttctttaagacacccagggaagtcaaaccgcccgaggacctccaagacctgggagtgcgatttctacagcctttcgtcaacctgcttagtaagggaacttattggtggatgaacgcatttatcaagaccgcccataagaagcctatagacctgcgagcaattgggaagttgcccattgccatgagagctttgacaaattatcagagactgtgtgaggcctttgacgctcaggtcaggaaagatatccagggaacacagggggctcgtgcaatctggcaagccctaagccacgcatttggaagacgacttgtgttaagtagtacattccgcatcctggccgacctgttggggtttgctggaccactgtgcatttttggcatcgttgaccacttgggaaaggaaaacgacgtgttccaaccgaaaacacagttccttggagtttacttcgtctcatctcaggagtttcttgccaatgcgtatgtgctggctgtgctgctatttctagctctgctgcttcagcgtacattcctgcaagcatcatattatgtcgccattgaaacaggcattaacctgcgcggcgctatccagactaagatttacaacaagatcatgcacttgtcaacatccaacctgtctatgggtgaaatgaccgccggccaaatctgcaatttagtggcgatcgatactaatcagcttatgtggttttttttcctatgccccaatctgtgggccatgcctgtgcagattatcgtcggcgtgatcctactttactacatcctcggagtttcagctctcattggagccgcggtcatcattttgctggcccccgtgcagtactttgtggccacgaaattatcccaagctcagagatccacactggagtactcgaacgaaagacttaagcagactaatgagatgctcagaggcataaaactgctgaagctctatgcttgggaaaatattttcaggactcgggtcgaaaccactagacggaaggagatgacgtccctgcgggccttcgctatctacacctctatctcaatctttatgaatacagccattcccatcgctgcggtgctcattacatttgtggggcatgtgtcctttttcaaggaagccgacttttctccaagtgtggccttcgcctccctgtcattattccatatccttgttactcccctgttcctgttgtcttccgttgtgcggtctactgtgaaggccctcgtgtcagccgagattcgtgaggaacagtgtgctcctcacgaaccgacgcctcaaggaccagcttcaaaatatcaggctgtaccattgagagtggttaatcggaaaaggcccgcaagggaggattgcaggggtctcacagggcctctgcagtccctggtccctagtgcggacggagacgctgacaactgttgcgtgcagattatggggggctatttcacctggacacctgatgggatccctacactcagtaatatcaccatccgaattccacgaggtcagttgaccatgatagtcggacaggtaggctgcgggaagtcctctctcctcctggctgcactcggtgaaatgcagaaggtgtctggcgcagtcttttggtctagtttgccagactctgagattggggaggacccctcaccagaaagagagactgctacagacttagatattagaaagagaggcccagttgcgtatgcttcccagaaaccttggctcctgaatgcaacagtcgaggaaaatattatatttgagagcccatttaataaacagcgctataagatggtgatagaggcctgctctcttcagccggacattgacattctgccccatggagaccagacacagatcggggagagaggcataaacctctccggcggccaacgccagaggatatcagtagccagagctctctaccagcatgccaacgtcgtctttttagatgaccctttttctgccctagacatccacctttccgaccatctgatgcaagctgggatactggagttgctacgcgacgataagcgcaccgtggtgcttgtgacccacaagttacagtacctcccgcacgccgactggatcattgctatgaaagacggcaccatccagcgggaaggaacgttgaaagacttccagcggtccgagtgccagctgttcgaacattggaagaccctcatgaaccgtcaggatcaggagttggaaaaacgccgacagttaagggccagacgaatgactacctgtcgaccttgttgtacctcagtcctccgctctcacggtgaacccgctccctctacttgccctcccccagcctcctgctcttgtagatgctggtctagccactcatgctcatccacgtggtcctggtggccaagtacaacagggtggcctagtggcccaactgctccatag

SEQ ID NO: 24563 - DNA, 4746 bp, Artificial Sequence
  Description of Artificial Sequence: Synthetic coding sequence
atgccgcttgccttttgcggcagtgaaaatcattccgctgcataccgggttgaccagggtgtgttgaacaacggctgctttgtcgacgcactcaatgtggtcccccatgtattcctcctgttcattacctttccgatcctttttatcggttggggcagtcaaagtagcaaagtgcacattcaccatagtacctggctgcattttcctggacacaacctgcgctggattcttacgtttatgcttttgttcgtcctcgtgtgcgaaatcgctgaaggcatcttgtccgatggcgtgactgagtcacaccatctccacctttacatgccggccggtatggctttcatggccgctgtgacttccgttgtgtattatcataatatagagacttctaatttccctaagctactgatcgctttacttgtctactggacgctggcatttataaccaaaactatcaagtttgtaaagtttcttgatcacgcaattgggttttcccagcttcgcttctgtctcactggactcctagtgatcctctatggcatgctgctgctggttgaggtcaatgtgattcgggtgcgcagatacatcttctttaagacgcccagggaggtgaagccacctgaggatctccaggatttgggggttcgatttctgcagccctttgtgaatctgttgtccaagggtacttactggtggatgaacgcattcatcaaaaccgcccacaaaaaaccaatcgacttgcgggccatcgggaagctccctatcgccatgcgagctctcactaattatcagagactctgcgaggcttttgacgcccaggtgcgaaaggacattcaagggacccagggcgcacgcgccatctggcaggctcttagccatgcgtttggacggcgtctcgtgctgagcagtacattcagaattctggcggatctgctcggattcgctgggccgctgtgtatctttggaatcgttgatcatttgggcaaagaaaacgacgtgttccagcccaagacgcagtttctgggcgtgtacttcgtctcctctcaagaattcctggcaaacgcatacgttctagctgtcctgttattcctggctctgttgcttcagagaacctttctacaggcctcctattacgtcgccatcgaaactggcatcaacctccggggggccatccagaccaagatttacaacaagatcatgcacctgagcacttccaacctatctatgggtgagatgacagcggggcagatctgtaacttggttgccattgacacaaaccagttgatgtggttttttttcctgtgtcctaatctatgggccatgcctgtgcaaattattgtaggcgtcatcctgctgtactacattctgggtgtgtcggccctgataggagcagctgtaattattctgttggctcctgtccagtactttgtggctacaaaactaagccaggcccagcgttcaacactggagtactctaatgagaggctgaagcagacaaatgagatgctaagagggattaagctgttaaaactctatgcttgggaaaatattttcagaacccgagtggagactacccgcagaaaagagatgaccagtttgcgtgcttttgccatatacacaagcatctcaattttcatgaacactgccatccctattgctgctgtgttgatcaccttcgtgggccacgtgagcttctttaaagaggccgacttctcccccagcgtggcttttgcttcactctccctcttccatatcttggttacgccactgttcctactgtcttctgtcgtgcggtccactgtgaaggcactggtgtcagtccagaagcttagcgagtttctgagttccgctgaaattagagaagagcagtgcgccccccatgaacctaccccacagggccccgccagcaaatatcaagctgtacccctgcgtgtggtcaataggaagcgtcctgcacgggaggattgtagaggcttgaccggacctttacaaagtctggtgccaagcgctgatggtgacgctgacaactgttgcgtgcagatcatgggggggtattttacttggacccctgatgggatccccacactgagcaacatcaccattcgtatccctcggggtcagctgactatgatcgtgggccaagtgggatgtggcaaatcttccctgctgctggctgccctgggagaaatgcagaaggtcagcggtgctgtcttttggtcatctctcccggattccgaaatcggcgaagatccgtcacctgagcgggagactgccacggatcttgacattaggaaacggggccctgtcgcttacgcctcccagaagccctggcttcttaacgctacagtcgaagagaacataatatttgagtccccattcaataaacagcgttataagatggtgattgaagcttgtagtttgcagccagatatcgatatcttgccacacggcgaccaaacgcagatcggtgaacgcggcattaaccttagcgggggccagagacaaaggatctcagtagcaagagctctttaccagcatgccaatgtggtatttttagatgatccgttcagcgccctggatatccatctgagcgatcacctcatgcaggccggcatcctggagctactcagggatgacaagcggacagtcgtgctcgtgacacataaactccaatacctccctcacgctgattggattattgccatgaaggatgggacaattcagcgggaagggactttgaaggattttcaaaggagtgaatgccaattgtttgagcactggaaaaccctgatgaacaggcaggatcaggagttagagaaggagaccgtcaccgaacgcaaggcaaccgaacctcctcagggactcagccgggcaatgtcaagtagagacgggctcctgcaagatgaggaagaagaagaagaagaagctgctgagagcgaggaggacgataacttatctagcatgctgcaccagagagccgagatcccctggagagcatgcgccaagtatttgagttctgcaggaatactcctgctgtcacttttggtgtttagccagctgctcaagcatatggttcttgtggccatcgattattggctggctaagtggactgactcggccctaaccctgactcctgccgcaagaaactgtagcctgagccaggaatgcactctggatcaaaccgtatatgcgatggtgtttacagtattgtgtagtttgggcatcgtcctgtgcctcgttaccagcgtgaccgtcgaatggacgggacttaaggtggcgaagaggctgcaccgttcactactgaacagaattatcctcgcccccatgcgcttctttgaaaccacccccctcggcagcatactgaacagattctctagcgactgcaacacaatcgatcagcatattccgtccactttggagtgcctgtctagatctacactgctgtgcgtgagcgctcttgctgtcatatcatatgtgacacctgtattcttggtcgctctcctgcctctggcaatcgtctgttattttatccaaaagtactttagggtagcttctcgcgatcttcagcagctggatgatacgacacagcttccacttcttagtcactttgctgagactgtggaagggctgaccactatcagggcttttagatatgaagctcggttccagcagaagttgctggagtacactgattctaacaacatcgcaagcctgttcctgacggcggctaaccgctggttggaggtacgaatggagtatattggggcttgtgtcgtcttaatagccgccgtcacgtcaatctctaatagtcttcaccgtgagctcagcgccggattggtcggactgggcctgacgtacgcactgatggtctcaaactaccttaactggatggtgagaaatcttgccgatatggagttgcaactcggagcagtgaaacggattcacggattactgaaaaccgaggcagagtcatatgagggcctactcgctcctagcctgattcctaaaaattggcctgaccaagggaagattcagatccagaacctgtccgtacggtatgattctagcttaaaacctgttttgaaacacgtaaatgccctcattgccccaggccaaaaaatcgggatatgtggtcggacaggctccggtaagtcaagcttttcactcgctttcttcagaatggtcgacactttcgaaggtcatattatcatcgatggcattgacattgctaagctgcctttgcatacgctgagatctcggctttctatcattttacaagatccggtacttttctctggaacgatcaggttcaatcttgaccccgaacggaagtgttccgattctactctttgggaggcgctcgaaattgctcaactcaaactcgttgtgaaagctctacctggcggccttgatgcaatcattacggaagggggcgagaacttctctcagggccagcggcagctgttctgtctggcaagagcgttcgttcggaagacaagtatcttcatcatggacgaggcgaccgcttccatcgacatggccactgaaaatattttgcaaaaggtggtcatgacagctttcgcagatcgaactgtggtgacaatcgcacatcgggttcataccatactgagtgctgacttagttatcgtcctgaagcgtggtgccatactcgaattcgacaagccggaaaagctgctgtccagaaaagactccgtttttgctagctttgtcagggcagacaagtag

SEQ ID NO: 24564 - DNA, 2994 bp, Artificial Sequence
  Description of Artificial Sequence: Synthetic coding sequence
atgccattggccttctgtggcagcgagaaccactccgccgcttatagggtggatcagggcgtcctgaataacgggtgtttcgttgacgccctgaatgtcgtgccacacgtcttcctgcttttcataactttccccattttatttatcggctggggttcgcagtcatcaaaggtgcacattcatcattctacgtggcttcacttcccaggccacaatttgcgctggattctgacatttatgttactgttcgtgttggtctgcgagatcgctgagggaatcctgtccgatggtgtgactgagagccatcatctgcatctgtatatgcccgccggcatggccttcatggccgccgttacctctgtggtttattatcacaatatagaaacctccaacttccccaagctccttatcgcattgctggtgtactggaccttggccttcatcacaaaaaccatcaaatttgtgaagttcttagaccatgccataggattctcccaactgcgcttctgcctgaccgggctcctggtgatcctgtatggtatgctcctcttggttgaggtcaatgtaatccgggtccgtagatatatcttcttcaaaacacctcgggaagttaaaccacctgaggacttgcaggacctgggcgtgagatttttgcagccctttgtgaacttgctgtcgaagggcacttactggtggatgaatgcttttatcaagacggcccataaaaagccaattgatctcagggctattggcaagctacccatcgccatgcgcgcgctgactaattaccagcggctatgtgaggcctttgacgctcaagtgagaaaagacatccaaggtactcagggagctagagccatctggcaggctttaagccatgcattcggtcgccgattggttctcagctccacctttcggatcctcgctgaccttctcggctttgccgggccactctgtatcttcggaatcgtggaccacttaggtaaggaaaacgatgttttccaaccaaagactcagttcctgggggtgtatttcgtatctagtcaagagttcttggcgaatgcatatgtactggccgtattgctgtttctggcccttttactgcagcgtacttttctccaggcatcctattacgtggccatcgaaacaggaatcaacttgcgaggcgctatccaaaccaagatttataacaaaataatgcacctgagcacttccaaccttagcatgggagaaatgacagctggccagatctgcaatctcgtggccatcgacaccaaccagctgatgtggtttttcttcctgtgtcccaatctgtgggcaatgcccgtacagatcatcgttggggtcattctgctgtactatattttgggagttagtgcactcatcggggcagctgtaattattctgctggcccctgtgcagtacttcgtggccactaagttgtctcaggctcagaggtcaacacttgaatatagtaatgagcggttgaagcaaacaaacgaaatgcttcgaggaatcaagctcctaaaactgtatgcgtgggagaacatttttcgcacccgagtggagacaacacgcagaaaggagatgaccagcctgcgggcattcgcgatatatacctcaatctccatattcatgaataccgcaatcccgatcgctgcagtactcatcacctttgtgggacatgtgtcttttttcaaagaggctgatttcagcccctcggtggcttttgcttccttaagtctttttcacatcctggtcacacctttattcctcctgtctagcgtggtgcgatccactgtgaaggctttggtgagcgcagaaatccgggaagagcagtgcgccccacacgaaccaacaccccagggcccggccagcaaataccaggctgtaccactccgggtggtgaaccgaaaaagaccagcgcgggaggattgccggggattgacgggacctctgcaatcactggttccttcagcagacggcgacgccgataattgttgtgtccagatcatggggggctattttacttggacaccggatgggatcccaacactgtctaatatcaccatccgcatccctagaggccaactgacaatgatcgtgggccaggtgggatgcggcaaatcatccctcttactggccgcacttggagagatgcagaaagttagcggcgcagttttctggagcagcctgcctgacagcgagataggggaagatcccagcccagagagggagacagcaacagacttagatattagaaagaggggcccagtcgcatacgcctcacagaagccatggctgctgaacgcaacggtggaggagaatataattttcgagtcgcctttcaacaagcagcgatataaaatggtgatagaggcctgttccctgcagcccgacattgatatcctgcctcacggggaccagactcagatcggcgagcggggcatcaaccttagtggcgggcaacggcagcgcatttctgtagcacgagcactgtatcagcacgcgaatgtggtgtttcttgacgaccccttctctgccctcgacatacacctatcagaccacctgatgcaggccggaattctcgagttactgagggatgataaacggactgttgttctggttacccataaactacaatatctgccccacgcagactggattattgctatgaaggatggcactatccagcgtgaaggtactttgaaagattttcagcgcagcgaatgtcaactgtttgagcactggaagacactgatgaaccgccaagatcaggaactagaaaagaggcggcagcttagggcgcgccgcatgactacatgccgcccttgttgcacttctgtgctcagatcacacggagagccagctcctagcacttgccccccccctgcgagctgcagttgccgctgctggagcagccacagctgctcttctacctggtcctggtggcccagcactacgggctggcccagcggacccacagcaccttag

SEQ ID NO: 24565 - DNA, 792 bp, Artificial Sequence
  Description of Artificial Sequence: Synthetic coding sequence
atgtccttcgccgtgttcctgatccataccaagagaaagaagggcgttcagagttccggcgtgctgtttgggtactggcttctttgttttgttttacctgctacaaatgcagctcaacaagcatctggagctggatttcagagcgacccagtccggcaccttagcacatacttgtgtctgtcactggtagtggcccagttcgtcctgtcttgtttggccgaccagccaccattcttcccagaggatccccagcagagcaacccctgcccagaaaccggagcagcttttccgagcaaggctactttctggtgggtgtctggcctggtgtggcgaggatacagaagaccacttagacccaaggacttatggagtctgggacgcgagaactcttctgaagagttagtttcccggctggaaaaggaatggatgaggaaccgcagtgctgctagaggacacaataaggctatcgctttcaagcggaagggcgggagcggaatggaggcacctgaaacggagccttttctcaggcaggaaggtagccagtggaggccactgcttaaggctatttggcaagtgtttcactccacctttctcctgggcaccctctcattggtgatctccgatgtatttcggttcactgtgcccaagctgctttctttatttttggaattcatcggagacccaaagccacctgcctggaaaggctatctgctggctgtgcttatgttcctttcagcttgcctccagaccctgtttgaacagcagaacatgtataggctaaaagtcttgtag

SEQ ID NO: 24566 - DNA, 600 bp, Artificial Sequence
  Description of Artificial Sequence: Synthetic coding sequence
atgctcctgggccgtttgacaagtcagctgctgcgggccgttccctgggccggagggcgccccccttggcctgtctcaggggttctcggatctcgcgtttgtgggcccctctacagcacttcaccagccggtcctggtcgagccgccagcctgccacggaagggcgcacaactggaacttgaggagatgttagtaccgcggaagatgagtgtctcccccttggaatcgtggttgacagctagatgtttccttccacggctggatacaggcactgcaggcacagtggcccccccccaatcctaccagtgtcctccaagccagattggggagggagctgaacaaggcgacgaaggcgtggctgatgctcctcagatccagtgcaagaatgtattgaagattcgcaggcgaaagatgaatcaccacaaatacagaaaactggtcaaaaagacgcgcttcttgagaagaaaagtccaggagggacgtctccgacggaagcaaataaagttcgagaaggacctcagaaggatatggctgaaggctggtttgaaggaagcacccgagggatggcaaacccctaaaatctatttaagggggaagtag

SEQ ID NO: 24567 - DNA, 600 bp, Artificial Sequence
  Description of Artificial Sequence: Synthetic coding sequence
atgctcctgggtcgcctgaccagtcagcttctccgtgccgttccttgggcaggggggcgacctccatggccagtttccggcgtacttggcagccgcgtgtgcggtcctctgtactctacgagcccagccggcccgggccgcgccgcatccttgccacgaaagggagcccaactcgaactggaggagatgctggtgccccggaagatgtccgtgtcaccactagaaagttggctaacggccagatgtttccttcccagactggacaccggtacagccgggaccgtcgccccaccacaatcatatcagtgccccccttcacagatcggtgagggcgccgaacagggagacgaaggcgtagctgatgccccgcagattcagtgcaagaatgttctaaagattcgaagaagaaaaatgaatcaccacaaataccggaaattggtgaaaaagacacgttttctcagaagaaaggtccaagagggccgcctacgcagaaagcagattaaattcgaaaaagatctcaggcggatttggctcaaagccgggttaaaggaagccccggaagggtggcagactccaaaaatttatctaagggggaagtag

SEQ ID NO: 24568 - DNA, 600 bp, Artificial Sequence
  Description of Artificial Sequence: Synthetic coding sequence
atgcttctggggcgtctcacgtctcagttgttgcgagccgtgccgtgggctggtggtaggcctccctggcctgttagcggtgtgttgggatctagagtgtgcggacccttgtatagcacctctcctgccggtccagggagagcggcaagtcttccaaggaagggcgcacagcttgagctggaagaaatgcttgtgcccaggaaaatgtccgtgtctcctctggaaagttggctgactgcacgttgttttctgcctcgcctggacaccggcacagctgggaccgtggcccctcctcaaagctatcagtgcccaccatcccaaataggagagggggccgagcagggggatgaaggcgtcgcagatgcaccgcagatccagtgcaaaaacgttctgaagatcagacgaagaaagatgaatcatcacaagtacagaaagctggtgaagaagacaaggttcctgagacggaaagtgcaggaaggcagacttcgccgcaaacagattaaattcgagaaagatctgcggcggatctggttgaaggctgggctcaaggaggcgcctgagggatggcagacccccaagatatatctgcgcggtaagtag

SEQ ID NO: 24569 - DNA, 600 bp, Artificial Sequence
  Description of Artificial Sequence: Synthetic coding sequence
atgttgcttgggcgcctcacctcacagctactcagggctgtgccctgggcaggcggccgtcccccctggcccgtaagcggtgtgctgggatctagagtgtgcggaccgctttacagcacatcaccagccggcccgggacgcgccgcctcgctccctcggaaaggggcccaactagagctggaggagatgctggtgcctaggaaaatgtccgtgtcaccactcgaaagctggctaactgccaggtgcttcctgcctaggttagacacaggcacggccggtacagtggctcctccccaatcctaccagtgcccacccagccagatcggggagggtgctgagcagggagacgagggcgtagccgacgcaccccagatccagtgtaaaaatgtattgaaaattcggaggaggaagatgaatcatcacaagtatagaaaattggtgaagaagactaggttccttcgtaggaaagtacaggaggggagactacgacggaaacagatcaaatttgagaaggatctgaggaggatttggctgaaagcaggcctgaaagaggcacccgagggctggcagacgcccaaaatttatctgaggggaaaatag

SEQ ID NO: 24570 - DNA, 870 bp, Artificial Sequence
  Description of Artificial Sequence: Synthetic coding sequence
atgaagactttacccgccatgctgggaactggcaagctgttctgggtgtttttccttatcccttatcttgatatctggaacatccacggtaaggaatcgtgcgacgttcagctctacatcaagcgccagtctgagcacagtattcttgcaggcgacccgtttgagctggagtgccccgttaaatactgcgctaacaggcctcatgtgacttggtgcaagttgaatggaaccacctgcgttaagctcgaggacaggcaaacatcttggaaggaggagaagaatatcagcttctttattctgcactttgagcctgtgttgcccaacgacaacggaagttacaggtgctccgcaaatttccagtcaaacctgatcgagagccactcgaccacactgtatgtgaccgacgtgaaaagcgcttccgagagacccagcaaggatgagatggccagcaggccctggcttctttatcgactgctccccctgggcggtctgcccttactaatcaccacctgtttttgcctgttttgctgtctacgacgacatcaggggaaacaaaacgagttatcagacactgccggtcgagaaatcaaccttgtcgacgcccacctcaagagtgagcaaacagaagcaagtactcggcagaattctcaggtacttctctcagagacagggatctatgataacgatcctgacctgtgttttcgtatgcaggaggggtcagaggtttatagcaacccttgcttagaagaaaacaagcctgggatcgtctatgccagcctgaatcactctgtgatcgggccaaatagccggctggcccggaacgtaaaagaggcacccacagaatatgcatccatatgcgttaggtcctag

SEQ ID NO: 24571 - DNA, 726 bp, Artificial Sequence
  Description of Artificial Sequence: Synthetic coding sequence
atgaaaacattacccgctatgctgggcacaggcaagctgttctgggtgttcttcttgatcccttacctggacatttggaatatacacggcaaggagtcctgtgacgtgcagttgtacatcaagcggcagagcgaacacagcattctggccggagacccattcgaactcgaatgcccagtcaagtactgtgctaaccgtcctcacgtgacatggtgtaaactcaatggaactacatgtgtgaaactggaagatcggcaaacgagctggaaagaggagaaaaacattagtttttttattctgcacttcgaaccagtgcttcccaatgacaacggcagctacaggtgttcagcaaacttccagtccaatctgattgaatcccactcaacgaccctgtatgtaaccggaaagcagaacgaactgagcgataccgcagggcgagagatcaacctggtggacgcccacctgaaaagcgaacaaaccgaggcttctacacgccagaatagccaggtactactgagcgagaccggtatttacgataatgatccagacctgtgctttcggatgcaggaaggtagcgaggtgtactccaacccctgtctcgaagaaaataaacctgggatcgtgtatgctagtctcaaccattctgtcattggacctaacagcagattagcccggaatgtgaaggaagcacccacagaatacgctagtatctgcgtccgttcctag

SEQ ID NO: 24572 - DNA, 1365 bp, Artificial Sequence
  Description of Artificial Sequence: Synthetic coding sequence
atgacatggagggcagccgcctcgacgtgtgcagctctgttgatcctgctttgggcactgaccacagagggagacctgaaggtggaaatgatggcaggcggcacacaaatcaccccccttaacgataacgtgaccattttctgtaatatcttctattcccagcctcttaatatcaccagcatggggattacttggttttggaaaagtttgacctttgataaggaagtgaaggtatttgagttctttggcgaccatcaggaagcctttcgacctggcgcaatagtgtccccgtggaggttgaaatcaggcgatgcctctctaagattaccgggcattcagttggaagaggctggggaataccggtgtgaggtggtggtaactcctctcaaggcacagggaaccgtccagcttgaggtcgtagcatctcctgcctctcggctcctgctggatcaggtgggaatgaaagagaacgaagataagtacatgtgtgaatcatctggattttatccagaagcaatcaatatcacttgggaaaaacaaactcaaaagtttccccaccctatagaaatctccgaggatgtgatcaccggcccaacgattaagaatatggacggtacattcaacgtgacatcatgcctgaaactgaacagctcccaggaagacccaggaacggtgtaccaatgcgtcgtgaggcacgcctccttgcacacccctctccgatcaaattttacgctcacggcagctcggcatagcctgtcagaaacagaaaagaccgacaacttttcaatacactggtggcctattagcttcatcggcgtgggcctggttctcctgatcgtgctgattccctggaaaaaaatctgcaacaagtcaagctctgcttacacaccattaaagtgcattttgaagcactggaacagctttgatacacagacacttaaaaaggaacacctgatatttttctgcacgagggcttggccatcatatcagctgcaagatggagaggcttggccacctgagggtagcgtgaacatcaacaccattcagcagctggatgtcttctgtcgacaggaaggaaaatggtccgaggtgccatatgtacaggccttctttgcactcagagataacccggacttgtgtcagtgctgtaggatagatcccgctctgctgaccgttacaagtgggaaatccatagatgataattccaccaaaagcgagaagcagacgcccagggaacacagcgacgcggtacccgatgcccctatcctgcctgtctctccaatttgggagcctcccccagcaacaacttctacaaccccagtgctgtcttcacagccccctacactcctgctgcccttacagtag

SEQ ID NO: 24573 - DNA, 1365 bp, Artificial Sequence
  Description of Artificial Sequence: Synthetic coding sequence
atgacctggcgagctgcggcttccacttgtgctgctcttttgatcttgctgtgggccttgacaaccgaaggcgatttgaaagtagagatgatggctggtggcactcaaattacgccgctcaacgataatgtgacaattttttgcaacatcttctactcccagcctctcaacattacatcaatgggcatcacatggttctggaagtctctcaccttcgataaagaggttaaggtgtttgaatttttcggcgaccaccaggaggccttccggccaggtgcaatcgtcagtccttggcggctgaaatccggagacgcgagccttcgcctgcctggaattcagctcgaagaggcgggcgagtatcggtgcgaggttgttgtgacccccctcaaggcacagggaaccgtgcagctcgaagtggtggcctcaccggcctcccggttattactcgaccaagtggggatgaaggaaaacgaggataaatacatgtgtgagagcagcggcttctatcccgaagccattaacatcacatgggaaaagcagacacagaagtttccacacccaatagagatctccgaagatgtcatcaccgggcctaccattaagaatatggacgggacctttaatgtgacttcctgtttaaaactcaattcatcccaggaagaccccggcacggtgtaccagtgtgtagtgcggcatgcttcgctgcatacacccttgagaagcaatttcaccctgacagccgcacggcactccctatcagagacagaaaagacggataacttctccattcattggtggccgatttctttcatcggggttggcctggtcctgttgatagtgttgatcccctggaaaaagatctgcaacaagagctcatccgcatacacccccttaaaatgcattttaaagcattggaattccttcgacacccagacactcaaaaaagagcatcttatcttcttttgcactagagcttggccctcctaccaactgcaggatggggaggcctggccacctgagggttcggtgaatattaacacaatccagcagctcgatgtcttctgccgccaagaaggtaaatggtcagaagtgccctatgttcaggcctttttcgccttgcgagataacccagacctgtgtcagtgctgtcgaatcgacccagctctgcttacagtgacctccggaaaatccatcgatgataactcaaccaaatccgagaagcagacccctagagagcactcagacgccgtgccagacgcccccatactacctgtgtcacctatctgggagccgcctcctgccacgacatcaaccacacctgtactgtcctctcaaccaccaacccttctactacccctacaatag

SEQ ID NO: 24574 - DNA, 660 bp, Artificial Sequence
  Description of Artificial Sequence: Synthetic coding sequence
atggctccggagatggaccaattttacagaagtactatggccatttataagtccatcatggaacagttcaatccagcgcttgaaaatctggtgtacctggggaataactacttgagagcatttcatgcactttcagaggccgccgaggtgtacttttccgcaattcagaagataggtgaacgggcattgcagtctcctacgagccagatcctgggagaaatactggttcagatgagcgacacacagcgtcatttaaacagcgacttggaggttgttgtccagaccttccacggtgggctgctgcaacacatggagaaaaataccaaactggatatgcagtttatcaaggattctcggcagcattatgagctagagtatcggcaccgggctgccaaccttgagaaatgcatgtcggagttatggcggatggaaagaaaaagggacaaaaatgtgagggagatgaaggagtcggtgaacagactgcatgcacaaatgcaggcatttgtgagcgagtcgcagcgcgccgctgagttggaggaaaaacgccggtacaggttcttggcagaaaaacatctgttgctgagcaacacattcttgcagttcttcggacggatgctagcagacgggagactggttgtgagtacactgtggctgtcttag

SEQ ID NO: 24575 - DNA, 1590 bp, Artificial Sequence
  Description of Artificial Sequence: Synthetic coding sequence
atggcaccagaaatggatcagttttataggtcgacaatggctatttataaatcaataatggagcaattcaatcccgccttggagaacctggtttatcttggcaataactaccttcgcgctttccacgccctctcagaagcggccgaggtctacttcagtgccatccagaagattggggaaagagctctccaatcccccacttctcaaattctgggagaaatcctggttcagatgagcgatacccaacgacatctgaactccgatctcgaggtggtggtgcaaacctttcatggtggtcttctgcagcacatggagaagaacaccaaactagatatgcaattcattaaggactcacggcaacactatgaactggaatatcgacacagggccgcgaatctcgagaaatgcatgtcggaactgtggcggatggaaagaaaacgggataaaaatgttagggagatgaaggaatctgttaaccgtttacacgctcagatgcaggctttcgtgagcgaatcacagcgtgccgccgagcttgaggagaagcgaagatatagattcttggccgagaaacacttgttactgtcaaacacttttctgcagttttttggtagggctcggggcatgttgcagaatcgggttctgctctggaaagagcagagtgaggcatcccgatcacctagccgagcacactctcctggtttgctgggacccgctttgggacctccctaccccagcggccgactgactccgacatgtctggatatgcctcccagacctctgggcgaattctcctctccaaggtcccggcacggctccggaagttatggcacagaaccggacgccagacccgcaagccagttagagccagacaggcgatcactgcctagaacaccttccgccagctctctgtattcaggctcagctcaaagctctaggtcaaatagcttcggagagaggcctgggggtggcggaggggcaaggcgagtgcgcgctcttgtttctcacagcgaaggcgctaatcacacacttctgcgttttagcgccggcgatgtggtggaggtgctggtgcccgaagctcaaaacggatggttatatggtaaactggagggctccagtgcctcaggctggttcccagaggcttacgtaaaggcactggaagaggggcctgtgaatcctatgacacctgtcactcccatgacgagtatgaccagcatgtctccaatgactcctatgaatcctggtaacgagctgccctcccgctcgtaccccctaaggggctcccacagcctagacgacctgctggataggccagggaacagcatcgctccaagcgagtactgggatggccagagcaggtcacgcactcccagtcgtgttccaagccgggccccctctccggctccaccaccccttccctcctcacgcaggagctccatgggatcaaccgcagtggctacagatgtaaagaagcttatgagctccgaacagtatccaccccaggaactctttccccgcggcacgaatcccttcgctaccgtgaagctgcggcctactattacaaatgatcgctcagccccattgattagatag

SEQ ID NO: 24576 - DNA, 1548 bp, Artificial Sequence
  Description of Artificial Sequence: Synthetic coding sequence
atggcacccgagatggaccaattctatcgatccaccatggccatttataaaagcatcatggaacagtttaacccggccctcgagaacctggtgtatctgggcaacaactacctccgggcctttcatgcactctctgaagccgctgaagtatacttcagcgccatacagaagattggggagcgggcattacagtcgccaacttcccagattcttggcgagatactagtgcagatgtcagatactcagaggcacctcaatagcgacctggaagtcgttgtgcaaacctttcacggaggtttgcttcaacacatggaaaaaaacactaaactggatatgcagttcatcaaggattcccggcagcattacgaactggaatatcgtcaccgagcagccaatctcgagaagtgtatgtctgagctttggcgaatggaaagaaaacgcgacaagaacgtgcgagagatgaaagagtcagtgaacaggctccatgcacagatgcaggcttttgtgtccgagagtcaaagggccgcagaactagaggagaagcgaaggtatagatttcttgccgaaaaacacttacttctgtctaacactttcctgcagtttttcggacgggccagaggcatgctgcagaacagggtcttgctgtggaaggagcagtccgaggcaagtaggagcccaagccgggcccactcccctggactacttgggcccgcgctggggcccccctaccccagtgggcgcctgacccctacatgcctcgatatgccacctcgcccacttggagagttttctagtcctaggagccgacacggatccggatcatatgggacggagcctgacgctagacccgcctctcaacttgagcccgaccgccggtcactgccccggacaccctcagctagctctctttacagcggatctgcccagagttctcgctctaacagctttggcgagaggcccggcgggggagggggagctcgcagagttcgtgcattggtaagtcattcagaaggagccaaccacaccctgctcaggttctctgcaggtgacgtggtggaagtgctcgtgcctgaggcccagaatggctggctttacgggaaattggaggggagctcagcctccggctggttcccagaggcatacgtcaaagctttggaggaaggccccgtgaatcccatgacccccgtgacccctatgacttccatgacatcaatgtctccgatgacacctatgaaccccggtaatgaactgccctcacggagctacccactaagggggtcccatagccttgatgacttactcgacagacccggcaacagtaccccctctagagtcccgtcccgggcccctagccctgctcctcctccactgccttcctccaggaggtcaagcatgggctccactgcagtagccactgacgtgaagaaactcatgagttctgagcaatacccgcctcaagagctctttccaaggggaacaaatccgttcgccactgtcaaactcaggccaactattaccaacgatcggtcagctccactgattaggtag

SEQ ID NO: 24577 - DNA, 726 bp, Artificial Sequence
  Description of Artificial Sequence: Synthetic coding sequence
atgaccttgcaatgggccgcagtcgctacctttttgtacgcagaaataggcctgatccttatattctgtctcccctttattccaccacaaagatggcagaaaatattctcatttaatgtttggggcaagatcgcgacgttctggaataaagccttcctgaccatcatcattctgctcatcgtgttgttccttgacgctgttagggaagttcgtaagtactcaagtgtccacacaatcgagaagagttccacctcccggccagatgcgtatgaacatactcagatgaagttgttccggagtcagcgcaatctgtacatttctgggttttccttgttcttctggctcgtcctaagaaggttggttaccctgatcacgcaactggcaaaagagctaagcaataaaggcgtcctaaagacccaggccgagaacaccaacaaagccgccaagaagtttatggaggagaacgaaaagctaaagcgtattctgaagagtcacggaaaggacgaagaatgtgtgcttgaggccgagaataagaagctcgtggaggatcaagagaagctgaaaacagaactgaggaagacgagcgatgccctgtccaaggcacagaatgatgtgatggaaatgaaaatgcaatcggaacgcctatcaaaggagtacgatcaactactgaaggaacattccgagctgcaggacagactggaacgcggcaacaaaaaacgtttgtag

SEQ ID NO: 24578 - DNA, 726 bp, Artificial Sequence
  Description of Artificial Sequence: Synthetic coding sequence
atgaccctgcagtgggccgcagtcgcaacgttcttatatgctgagattgggctgattctgatcttctgcctgccgtttatccctccccagcgatggcagaaaatcttctcgtttaatgtgtggggaaagatcgcgaccttctggaataaagcattcctcacaatcatcatcctgttgattgtccttttcttggacgccgtaagagaagtgaggaaatactcttctgtacacacaattgagaagagctcaactagccgacctgatgcctacgaacatacgcagatgaagttgttccggtcccaaagaaatttgtacatttcaggcttcagcctgttcttctggctggtcttgcgccggctggtgaccctgattacacaactcgccaaggagctgagcaataagggggtcctgaagactcaggctgaaaataccaataaagctgccaagaaattcatggaggagaatgagaaacttaaacggatcctcaaaagtcacggcaaagacgaagagtgtgtcctggaggccgaaaataagaaactggtggaggatcaggaaaaactgaaaactgaactgcggaaaacttccgacgctctatccaaggcacagaatgatgtaatggagatgaaaatgcagtctgaaagattaagtaaagagtacgatcagttgctgaaggagcacagcgaactgcaggatcgactcgaacgggggaataaaaagaggctgtag

SEQ ID NO: 24579 - DNA, 1047 bp, Artificial Sequence
  Description of Artificial Sequence: Synthetic coding sequence
atgacgcttcagtgggccgctgtggctactttcctctatgcagagatcggactgatcttgatcttttgtctgccgtttatcccaccacaacgctggcagaaaattttctcctttaatgtctgggggaagattgctacattctggaataaggcttttctgactatcatcatccttttgattgtcctctttctggacgcagtgcgcgaggtgaggaaatattcttccgtgcatactattgagaagagcagcacctctcgccctgacgcatacgagcacacacaaatgaaattgttccgttcacaacggaatctttacatatcagggttcagcctgtttttctggctggtcttgagaaggctcgtgacactgattacacaacttgccaaggagctgtcaaataaaggggttctcaaaacgcaggccgaaaacactaacaaagctgctaagaagtttatggaagaaaacgagaaactgaaaaggatccttaagtctcacgggaaagatgaagaatgtgtcttagaggcagagaacaaaaagctcgtggaagatcaggagaaactcaagaccgaactgagaaagacaagcgacgccctgtccaaagcccaaaacgacgtcatggagatgaaaatgcagtcggaacggctctctaaagaatatgaccagcttctgaaggagcattccgagctacagcatagctcctttggtgaatttttgtctaagcgatcccacaagaacgggtccattggtaaacagaccggtagtcggaaggggagcttccgcaagcgacagcaggagaaaactgtaaatttcatcaaagacacatgcaacatcctctgccaaaacgataatttcgtaatgctggcctcaaggaaatttaagtttagaaagatgcattacgaccggtttgttatttttctgatgcctcatatcggatgtatcgtcatggcactatccaagtatctaatgatgttccagatctactgtaaagtttgtatccccgctctgaaaaaaaatatcagcatgttaaacacaatctttacttattag

SEQ ID NO: 24580 - DNA, 468 bp, Artificial Sequence
  Description of Artificial Sequence: Synthetic coding sequence
atgaaactattccggtcacagcgaaacctatacatttcgggattttcattgttcttttggctcgttttgcgcagactagtgacattaattactcaactcgctaaagagttatcgaacaaaggtgttctaaagacacaagcagaaaatacaaacaaagcggctaagaagtttatggaagagaatgagaaactcaaaagaatacttaagagtcacggcaaagatgaggagtgtgtattggaggctgaaaataagaagttggttgaagaccaagaaaaactgaaaaccgagctccgtaagacctccgatgccctctccaaggcccaaaatgacgtgatggagatgaaaatgcagtccgagcgactgtcaaaagaatacgaccagcttttgaaggagcatagtgagctccaaaagagccactcacagcccggtgccgcggccttcctggtaaaagaagtcgaaagcttttag

SEQ ID NO: 24581 - DNA, 402 bp, Artificial Sequence
  Description of Artificial Sequence: Synthetic coding sequence
atgaccttacaatgggctgccgtcgcaacctttctctatgccgaaatcggcttgatcctgattttttgtctacctttcatccctccacagaggtggcagaagattttctcttttaatgtttggggcaagatcgcgactttctggaacaaggctttcctgaccattatcatccttctgattgttctgtttctcgacgccgtccgtgaggtgcggaaatatagtagtgtgcatacaattgagaagagctccacctcacgtcctgatgcttacgagcacacacagatgaagttgtttcgcagccagcggaatctctacatctcagggttttccttgttcttctggctggtacttaggaggctggtcaccctgataacacaactggctaaggaacttagcaactag

SEQ ID NO: 24582 - DNA, 492 bp, Artificial Sequence
  Description of Artificial Sequence: Synthetic coding sequence
tgagacgcctatgagcacacccagatgaagctgtttcggtcccagcgcaatttatatatcagtggcttctcgctgttcttttggttggtgctcagacgcctggtgaccttgatcacccagttagccaaagaactgtccaataagggagtgctcaagacacaagccgaaaacaccaacaaagccgctaaaaaattcatggaggaaaacgagaagctgaagcgcatacttaaatcacacgggaaggacgaggaatgtgtcctggaagctgagaacaagaaactggtggaggatcaggagaaacttaaaacagaactcaggaagacgtctgacgcactgtcgaaggcccaaaatgatgtcatggagatgaaaatgcagagcgagaggctttctaaagagtatgatcagctgctcaaagagcactcggaattgcaaaaatcacattcccagcctggtgccgccgcattcctcgtcaaagaagttgagagcttctag

SEQ ID NO: 24583 - DNA, 1047 bp, Artificial Sequence
  Description of Artificial Sequence: Synthetic coding sequence
atgacgctccagtgggctgcagtagccacattcttgtatgccgaaattggcttgatcctgattttttgtctcccatttataccgcctcaaagatggcagaagatctttagcttcaacgtatgggggaaaatagcaaccttttggaataaagcgtttctgaccataatcatactccttatcgtgctgtttttagatgccgtgcgcgaagtgaggaaatattcgtctgtgcacaccatcgagaagagctccaccagtaggccggatgcctacgagcacacacagatgaaactgttcaggtctcagcgaaatctgtatatctcgggcttttccctgtttttctggctcgttctgcggcgcttagttacacttatcacgcagctggctaaagaactgagtaataaaggggtgttgaagacccaggccgagaatactaacaaagctgctaaaaagtttatggaagaaaatgagaaacttaaaaggattcttaagtcacacggcaaagatgaagagtgtgtactagaggccgaaaataaaaagcttgtggaggatcaggagaagttgaagaccgagctcagaaaaactagtgacgccctgtcgaaggctcagaacgatgtgatggagatgaaaatgcaaagtgagaggttgtccaaggaatatgaccaattattgaaagagcatagcgagctgcagcattcatcattcggcgaatttctgtctaaacggtctcataagaatggaagtatcggcaaacagactggttcaagaaaggggtcatttagaaaacggcaacaggaaaaaacagttaacttcataaaggatacctgcaatattctgtgtcaaaacgacaattttgtcatgctcgctagtcgaaaatttaagttccgcaagatgcactacgaccggttcgtgatttttctgatgccacacattgggtgcattgtaatggccttatcaaagtacctgatgatgttccagatatattgcaaagtttgtattcctgcactaaaaaagaatatttcgatgctgaacaccattttcacatattag

SEQ ID NO: 24584 - DNA, 693 bp, Artificial Sequence
  Description of Artificial Sequence: Synthetic coding sequence
atgactctgcagtgggcagcggtcgccacattcctgtatgccgaaattggcctgatactgatcttttgcctgccctttatcccacctcagaggtggcagaagatattttcgttcaacgtgtggggtaaaatcgccacgttctggaataaagccttcctgactatcataattctgcttatcgttttgtttctggatgccgttagagaggtccgcaagtatagcagcgtgcacactattgagaagtcttccacttctagaccagatgcttacgaacacacacaaatgaaactgttccggtcccagagaaatctctatatctctggcttttctctgttcttttggttggtcctacgcaggttggtgactctgatcacacagctcgccaaagagctgtcaaataaaggtgtcctcaagacgcaggccgagaacactaataaagcagcaaaaaagtttatggaggaaaacgagaaactgaagcgcatcctaaagagccatggcaaagatgaagaatgcgtgttggaggctgagaataagaagctggtggaggatcaggagaagctgaagacagagctcagaaaaacaagtgacgctctgagtaaagctcagaatgacgtcatggagatgaaaatgcagtctgagagactgtccaaggagtatgatcagctccttaaagaacattcagaactgcagtag

SEQ ID NO: 24585 - DNA, 444 bp, Artificial Sequence
  Description of Artificial Sequence: Synthetic coding sequence
atgaagctctttcgctcacagagaaacctgtatatatcaggatttagcctgttcttctggttggttctccggcgactggtaaccctcatcacccagcttgctaaagagctaagcaataaaggtgtgctgaagacccaggcagaaaacaccaataaggccgcgaaaaagtttatggaggagaatgagaagcttaagcgtatcctgaagtctcacggaaaagacgaagaatgtgttcttgaggccgagaataagaaattagtggaggaccaggagaagttgaaaactgaattgcgcaagacctccgacgccctcagcaaggcacagaacgacgttatggaaatgaaaatgcagtcggagcgcttgagtaaagaatacgaccagttactcaaggaacattccgagttgcaggataggctggagcgcggtaacaagaaaaggctgtag

SEQ ID NO: 24586 - DNA, 195 bp, Artificial Sequence
  Description of Artificial Sequence: Synthetic coding sequence
atgacactgcagtgggctgctgtggcaacatttctctacgccgagattgggctcatcctgatcttttgcctacctttcatacccccacagcggtggcaaaagatcttcagctttaatgtatgggggaagattgctaccttctggaataaagcattcctgacaatcattattctcctcattgtcctgtttctgtag

SEQ ID NO: 24587 - DNA, 591 bp, Artificial Sequence
  Description of Artificial Sequence: Synthetic coding sequence
atgaccctccaatgggccgcagtggcaacttttctctatgccgagattggccttatcctcatattttgcctacccttcatccctccccagcgctggcagaagattttttcattcaacgtctggggtaagatagctacattctggaataaagcatttctgaccattatcatcctccttatcgttttgttcctggacgcagttagagaagttagaaagtacagctccgtgcacacaatcgagaagagctcgacatcccggcctgacgcctatgagcacactcagatgaagctgttccgcagccagcgtaatctctacattagtggattcagtctatttttctggctggtgctgagacgactggtcacacttattacccaactggctaaagaattgtcaaataagggcgtgctgaagactcaagctgagaacacgaataaggcagcgaagaagttcatggaggaaaacgaaaaactgaagaggatcttaaagagccacggaaaagacgaggaatgcgtactggaagcagagaacaagaaattggtagaggaccaggagaagcttaaaactgaactccggaagacctctgattag

SEQ ID NO: 24588 - DNA, 741 bp, Artificial Sequence
  Description of Artificial Sequence: Synthetic coding sequence
atgtctttgcaatggaccgccgttgctacattcctgtatgctgaggtctttgttgtcctcttgctctgcatcccattcatatccccaaaaaggtggcagaaaatcttcaaaagtaggctcgtagagctgcttgtctcgtatggtaacacatttttcgttgtcctgattgtaattttggtcctgctggtgatcgatgcagtgagagagatcaggaagtacgacgacgtgactgaaaaagtgaatctccagaataaccccggcgccatggagcacttccacatgaagttattcagagcacaacgaaacctctacattgcagggttctctttgctgctgtccttcttactgaggagactggttaccctcatctcccagcaggctacattactggctagtaacgaagcttttaaaaagcaggccgagtcagcctctgaggctgccaaaaaatatatggaggagaacgaccaattaaagaagggagccgcagtcgatggagggaaactggatgtgggcaatgccgaagttaagctggaagaggaaaatcgatccctgaaggctgacttgcagaagttaaaggatgaactggccagtaccaagcagaaactggagaaggccgagaaccaggtgctggcgatgcgcaagcagtctgaggggcttaccaaggagtacgataggctgctggaggagcacgccaagctgcaagccgccgtagacggacctatggataagaaggaggagtag

SEQ ID NO: 24589 - DNA, 549 bp, Artificial Sequence
  Description of Artificial Sequence: Synthetic coding sequence
atgagcctccagtggacagccgtagcaaccttcctttacgccgaggtattcgtggtcttgctgctatgtatacctttcatcagccccaagcgctggcaaaagatcttcaagagccggctggttgagcttctggtgagctacggaaacacatttttcgttgttcttatagttattctcgtgcttctcgtcatcgatgccgttcgtgaaattagaaagtatgacgatgtgaccgagaaggtgaaccttcagaataaccccggggccatggaacattttcacatgaaactctttcgcgcgcagagaaacctttatatagccgggttctcactactcctttcgtttctgctgcgccggttggttaccttgatatcccaacaggccacacttttggcctctaatgaggcctttaaaaagcaggcagagtcagcgtcagaagcagctaaaaagtatatggaggagaatgaccagctgaagaagggcgctgcagtggatggcggtaaactggacgtcggcaatgctgaggtcaagctggaggaggagaatcgctag

SEQ ID NO: 24590 - DNA, 537 bp, Artificial Sequence
  Description of Artificial Sequence: Synthetic coding sequence
atgagcctgcagtggacagctgttgccaccttcctgtacgccgaggttttcgtagtgcttttgctttgcatcccgtttatcagcccaaagcggtggcagaagatcttcaagtcccggctggtggaactcctggtatcttacggcaataccttcttcgtggtgttgatcgtaatcctcgtgttgctggttattgatgccgtcagggagatcagaaaatatgacgacgtgactgagaaagtgaatctccagaacaaccctggcgctatggaacactttcacatgaaactgttccgagcacagagaaatttatacattgccgggtttagtttgctgcttagctttctgcttcgcaggctggtgaccctgatctcccagcaggccaccctcttagcctctaatgaggctttcaaaaagcaggctgaatctgcctcagaagcagccaagaaatatatggaggaaaatgaccagttgaaaaaaggggccgctgtcgatggtggaaaactggatgtgggcaacgccgaggtgaaattagagtag

SEQ ID NO: 24591 - DNA, 942 bp, Artificial Sequence
  Description of Artificial Sequence: Synthetic coding sequence
atgggggcagaagcatcatcatcctggtgtcctggaacggccctccccgaggaaagacttagcgtgaaacgggcttccgagattagcgggtttcttggccaggggtcttccggagaagctgcattggacgtgctgacccatgtgctggaaggggcaggcaacaaattaacttcctcctgtgggaaacccagtagcaacagaatgagcctgcagtggactgcagtcgccacttttctgtatgccgaggtgtttgttgtgctgctgctgtgcatccctttcatttcaccaaaacggtggcaaaaaatcttcaagtcccggcttgtggagctcctggtgtcctatgggaacaccttctttgtggtgctaatagtgatcctcgtactactggttatcgatgcagttcgagaaatccgcaagtacgacgacgtcaccgaaaaggtcaacttgcagaataatccaggagccatggaacactttcatatgaagcttttcagagcgcagcgtaacctctacatagcaggattttctttacttctgtcctttttgctcaggaggttagtaacactaatttcacagcaagccacgctgctggccagcaacgaggcctttaagaagcaggccgagtctgcaagcgaggctgcgaaaaagtacatggaggaaaacgatcagctcaagaagggtgctgcagtggatggtggtaagttggatgttggaaacgccgaagtgaaactcgaagaagaaaaccggtcccttaaggcagacctacagaagttgaaagacgaactggcttcgactaagcagaaactcgagaaggcagagaatcaagtgctggctatgcgtaagcagtccgaaggcctcacaaaagagtacgacaggttgttggaagagcatgcgaagttacaggcagccgtggacgggcctatggacaaaaaggaagaatag

SEQ ID NO: 24592 - DNA, 564 bp, Artificial Sequence
  Description of Artificial Sequence: Synthetic coding sequence
atgagtctgcaatggacagccgtggctacctttctctacgctgaagtctttgtggtgctcctgctatgcattccctttatctctccaaaacggtggcagaagatctttaaaagccgactggtcgagctgctcgtaagctacggcaacacttttttcgtggtgctgatcgttatacttgtactgctcgtgattgacgcagtacgagagattcgtaagtatgacgacgttacagagaaagtcaacctgcagaacaacccaggtgccatggagcactttcatatgaagctctttcgagcccagcgcaacttgtacatcgctggatttagcctgttgctgtcctttctcctgaggagactcgtgacactgatttcacagcaggccacgctgctagcaagcaacgaggcgttcaagaaacaggctgaaagtgcatcagaggctgctaaaaagtacatggaagaaaacgaccagcttaaaaaaggcgcagcagtggacggaggtaagctggatgtaggaaacgcagaggttaaattggaggaagagaaccgaagccttaaggcagactag

SEQ ID NO: 24593 - DNA, 417 bp, Artificial Sequence
  Description of Artificial Sequence: Synthetic coding sequence
atgtctctccagtggactgcggttgcaacatttctatacgccgaggtgttcgtggtcttgcttctctgcattccgtttatatcgccaaagcgctggcagaaaatattcaagtcccggctagttgagttgctggtgtcatacggcaacactttcttcgtagtgctgatcgtgatcctggtgctgctggtgatcgatgctgtccgcgaaattcggaagtacgatgatgtaactgaaaaggttaacttgcagaacaaccccggcgccatggaacatttccatatgaagttattccgcgctcagcgcaatctgtatatcgctgggtttagcctcttgctgagctttttgttgcgtcgcctggtcactctaatttcgcagcaagctactctgctggctagtaatgaagcttttaaaaagtag

SEQ ID NO: 24594 - DNA, 741 bp, Artificial Sequence
  Description of Artificial Sequence: Synthetic coding sequence
atgtctcttcagtggaccgcagttgcaaccttcctctacgccgaagtgtttgttgtgttattgctctgcataccttttatcagtcccaaacgctggcagaagattttcaaatcacgcctggtggagctgctggtttcctacggcaacacttttttcgtggtgctgatagtgatcttggtgctgctggtgatcgatgctgtacgcgagattcggaaatacgatgatgtgaccgagaaggtcaatctacagaacaatccaggggcaatggagcacttccacatgaaactgttccgagctcagcgaaatctgtacatcgccggattttctttactgctctcatttttattgagaagactcgtcacactgatatcgcaacaagctactctccttgcctctaacgaggccttcaaaaagcaggccgagtccgcttctgaggcagccaaaaaatatatggaggaaaatgaccaacttaagaaaggtgctgccgtggacgggggcaagttggatgtggggaacgctgaggtgaaactggaagaagaaaaccgctcccttaaagcggatttgcaaaaattgaaggacgaactggcgtctacaaaacaaaaactggaaaaagccgagaaccaggtcctggctatgaggaagcagtccgagggcctgacaaaagagtacgaccgactcctcgaggaacacgccaaacttcaggcagctgttgacgggcccatggacaagaaagaggagtag

SEQ ID NO: 24595 - DNA, 567 bp, Artificial Sequence
  Description of Artificial Sequence: Synthetic coding sequence
atgtcactgcaatggaccgctgtcgctacatttctatacgcagaagtatttgttgtgctcctgctctgtattccgtttatatcacccaagcgttggcagaagatttttaagagtagactggtggaactcttggtgtcttatggcaataccttcttcgtggtcctgatcgttatcctggtcttactggtaatcgatgctgtgagagagatacggaagtatgatgacgttacagagaaagtgaacctgcagaacaacccgggcgctatggaacatttccacatgaagctctttcgagcgcagcgaaacctttacatcgctggcttctctctgcttctgtcatttttactgcgcagactagtcaccttgattagccagcaggcgacactgctggcttccaatgaagcattcaagaagcaggctgaatctgcatctgaggccgcaaaaaagtatatggaggagaatgaccagcttaagaaaggagccgcggtcgacggggggaagttagacgtcggtaacgcggaggtgaagctggaggaggagaatcggtcactaaaggccgacctgtag

SEQ ID NO: 24596 - DNA, 942 bp, Artificial Sequence
  Description of Artificial Sequence: Synthetic coding sequence
atgggtgcagaagcatcctcatcatggtgtccaggaaccgcgctcccagaagagaggctgtccgtcaagagagccagcgaaatttccgggttcctgggtcaagggtcctcaggcgaggcagcactggatgtgctcactcacgtactggagggagctgggaacaagctgaccagttcatgcggcaagccctctagcaaccgaatgtccctgcagtggaccgccgtcgctaccttcctgtacgccgaggtgtttgtggtgctgctgctctgcattccatttatcagcccaaagcgatggcagaaaatctttaaaagtcgcctcgtggagctactcgtaagttacggcaacactttttttgtggtgttgatagtcattctggtcctgctggtgatagatgccgtaagagaaataaggaaatacgacgacgttacagagaaggtaaacttacaaaacaaccctggggcaatggagcatttccacatgaagctcttccgggcacagcggaatctttatattgccggattcagtctcctgcttagtttccttctacgccggctggtgactttaatttcccagcaggcaacactgttggcctcgaacgaggccttcaagaaacaagctgagtccgcctccgaagcagccaagaaatacatggaggaaaacgaccagttgaaaaaaggtgccgctgtcgatgggggcaaactggacgtggggaatgccgaggtgaagctagaggaggagaacagatcccttaaggcagatctgcagaagctgaaggacgagctggcctccaccaaacagaagctggagaaagcagagaaccaggtcttagctatgaggaagcagagcgaagggctaaccaaagaatacgatagactcctggaggagcacgccaagcttcaggccgccgtcgatggtccgatggacaaaaaggaagaatag

SEQ ID NO: 24597 - DNA, 798 bp, Artificial Sequence
  Description of Artificial Sequence: Synthetic coding sequence
atgtatgtgggatacgtcctggataaggattccccggtgtacccagggccggcccgcccagcaagtcttggactgggtcctcaggcatacggcccgcccgctccaccccccgccccaccccagtatcctgacttttcatcctactctcatgtggaaccagctcctgccccacccaccgcctggggcgcccccttccctgcccccaaagacgactgggccgccgcctacgggccaggtccggcggccccagctgcgtccccggccagtttagccttcggtcccccacccgactttagcccagtgccagcacctccaggccccgggccgggcctgctggcacagcccctgggggggcccggaacccctagcagtcccggagcccagagacccactccatatgagtggatgagacgttccgttgcagccggcggaggcgggggtagcggtaaaacccgcactaaggataaatatagggtggtttacaccgaccaccagcgactggagttggaaaaggagtttcattatagtaggtacattaccataagacgcaaatcagagctggcggctaacctgggtttgacggagagacaggtgaagatctggtttcagaacagacgagctaaggaacggaaggtgaataaaaagaagcagcagcagcagcagcccccacagccaccaatggctcacgacatcaccgctacgcccgcaggcccaagtttgggtgggctgtgcccatctaatacgtcccttcttgcgacgtcctcccccatgcctgtgaaagaggagtttctcccttag

SEQ ID NO: 24598 - DNA, 687 bp, Artificial Sequence
  Description of Artificial Sequence: Synthetic coding sequence
atggcggctccgcaggatgtgcatgtccgaatctgtaatcaggagatcgtcaaattcgatctggaggttaaagcccttatccaggacattcgtgactgttctggccccctgtccgctctcacagagttaaacacaaaggtgaaagagaagtttcaacaacttagacataggattcaggaccttgaacagctcgccaaagaacaggataaggagtcggagaaacagctccttctgcaagaggttgaaaaccataagaagcagatgctgtctaatcaggcctcctggagaaaggccaatctcacatgcaagatagctattgacaatttggagaaggcggagctgctgcaaggtggagatctcctgcgccagcgcaaaacaacaaaggaaagcctggctcagaccagctccaccataactgaatccctcatgggtatctcacgcatgatggcccaacaggtccagcaatctgaggaagctatgcaatcgttggtcacatcttcgaggacaattctggacgccaacgaggagtttaagtccatgtccggtactatacagctgggtcggaaactaataactaagtataaccggcgcgagctcacagacaaactgctgatctttttggcattggcactctttctcgctaccgtgctgtacatcgtgaagaagcgcctgttcccttttctctag

SEQ ID NO: 24599 - DNA, 714 bp, Artificial Sequence
  Description of Artificial Sequence: Synthetic coding sequence
atggccgctcctcaagacgttcacgtgaggatttgtaatcaggaaattgttaaattcgatctggaagtcaaggctcttatccaggacattcgcgactgcagcggacctttaagcgctctcactgaactgaataccaaagtcaaagagaaatttcagcaattgcgccaccggattcagccagtgctttatcaacgtgcatttatctggactgcgagcaccttcttttttaagctcacatatagcttgactgatttctcatctacccagcacgattttaactcccctaccacaccagtgacttttagtgatctggagcagcttgcaaaagagcaggacaaggaaagcgagaaacaactgctgcttcaggaggttgaaaaccataagaagcagatgctgcggaagacaacaaaagagagtctggcacagacgagctccaccattacggagagcctaatgggtatcagccgcatgatggcccagcaggtgcaacagagcgaagaggctatgcaaagcttagtcacctctagccgcacaatactggatgccaatgaggagtttaagtccatgagcgggaccattcagctggggcggaagttgataacgaaatacaatcgccgcgagctgacagataaacttctcatctttctggcattagcactttttctggccacagtcctctatatcgttaagaagagactttttccttttctctag

SEQ ID NO: 24600 - DNA, 585 bp, Artificial Sequence
  Description of Artificial Sequence: Synthetic coding sequence
atggctgcgccccaagatgtccatgtgagaatttgcaatcaggagatagtgaaattcgacctggaggtgaaagccctaattcaagatataagggactgctccggccctctgtcagcactcaccgaactaaacacaaaggtcaaggagaagttccagcagttgcgccacaggatccaagatctggaacagctggctaaagaacaagataaagagagtgaaaagcaactgctgctccaggaggtcgaaaaccacaagaagcaaatgctgcgtaaaacaaccaaagagtccctcgcgcagacctccagtaccataaccgaatccctgatggggataagcagaatgatggcacaacaggtgcagcaatcagaagaggccatgcagtccctagtgacatccagtaggactatcctagacgctaatgaggagtttaagtccatgagcgggaccatccagcttggccggaagctcattaccaaatataataggcgcgaactcacagataagctgctgatcttcctagccctcgctttgtttctcgccacagtcctgtatattgtaaagaagcgcttgttcccttttctttag

SEQ ID NO: 24601 - DNA, 1458 bp, Artificial Sequence
  Description of Artificial Sequence: Synthetic coding sequence
atggcctcctcatcgactgtcccactggggtttcactatgaaaccaagtacgtggtgttgtcatatctgggcctcctatcacaagaaaagttgcaggagcaacacttatcctccccacaaggcgttcagctcgacattgcctctcagagcttagaccaggaaattctcctcaaagtgaagacggaaatcgaggaagagttaaagtcattggataaagaaatttcggaggcatttaccagcactgggttcgaccgccacacatccccagtgttcagccccgccaacccagaaagctccatggaagattgtctcgcccacctcggcgagaaggtcagccaggaactgaaggagccattgcacaaggctctgcaaatgctactgtctcagcctgtgacataccaggcgttccgtgaatgcacgctggaaacgactgtgcatgcaagcggttggaacaagatcctggtccctctagtcctccttcgccaaatgctgttagagctcacccggcgtggccaagagccactctccgctcttctccaattcggcgtaacttatctggaggactactcggctgaatacatcatccagcaaggaggttgggggaccgtctttagcctcgaaagcgaagaagaagagtaccccggcatcactgccgaggatagcaacgatatctacatcctcccctccgacaattctgggcaagtgtctcctcccgaatctcctacagttaccacgtcgtggcagtccgagtctctccccgtcagccttagcgccagtcaaagttggcatacagagagcctgcccgtatctctcgggccagagtcttggcagcaaatagccatggaccccgaggaagtcaagagcctcgattctaatggcgctggtgagaaaagtgaaaataactcttcaaattccgacatcgtccatgtagagaaggaggaggtcccagaaggcatggaggaagctgccgttgcatcggtggtacttcctgcccgggagcttcaagaggcactccctgaggccccagccccactgctgccgcatatcaccgcgacgtccctgctgggaactcgcgaaccagacaccgaagtgatcaccgtggaaaaatcatcacccgccacaagtctattcgttgaattggatgaggaggaggtgaaggcggccactacggaacccacagaagtcgaggaagtagttcctgctctggaacctaccgagacactgctgagcgagaaagaaataaacgccagagaagagtcactcgtggaggaactgtcacccgcgtccgagaaaaaacccgtgcccccctcagagggcaagtccaggctgagtcctgccggggaaatgaaacctatgccgttatctgagggcaagagtattcttttgttcggaggtgccgctgcagtagctatacttgcagtggctataggggtggcactcgccctgcggaaaaagtag

SEQ ID NO: 24602 - DNA, 972 bp, Artificial Sequence
  Description of Artificial Sequence: Synthetic coding sequence
atgctgctcgagctaactcgcaggggacaggagcccctttccgccctgcttcagtttggcgtcacatacctggaagactacagcgccgaatatataattcagcaggggggctggggcaccgtgttctctctggagtccgaggaggaggaataccccggtataaccgccgaagactccaatgacatttacatcctcccctccgacaactctgggcaggttagccccccagagtcgccaactgtaactacctcttggcagtccgagagtctacccgtttctttatcggccagtcagtcctggcacacagagtcacttccggtgagcctgggaccagagtcttggcagcagatagccatggaccctgaagaagtgaagtctctagacagtaacggggccggcgaaaaatcagagaacaactcttccaatagcgatatcgtccatgtcgaaaaagaggaggttcctgaagggatggaggaagcagccgtggcatccgtcgtgctccccgccagagaactccaggaagcacttcctgaggcccctgcgcccctcctgccccacatcacagcaacctctttgctgggtacccgcgagcccgatacggaagtgattactgttgagaagagctctccggcgactagcctattcgttgaattggatgaagaagaggttaaagctgcaaccacagaaccgacagaggtcgaggaagttgtccctgccctggagccgacagagactctgctgagtgagaaagagatcaatgctcgggaggaaagcctagtggaggagctctctcccgctagtgagaagaagcccgtgcctcctagcgaaggtaaaagccggttgagccccgcaggggaaatgaagcctatgcctttaagcgaaggcaagtcaattctcctatttgggggcgccgcagcagtagctatcttggctgttgcgataggcgtggcactagccctgcggaaaaaatag

SEQ ID NO: 24603 - DNA, 606 bp, Artificial Sequence
  Description of Artificial Sequence: Synthetic coding sequence
atggctagcagctcaaccgtcccactgggctttcattacgagactaaatacgtggtcctgtcctatttaggcctgctctcgcaggaaaaactccaggagcagcatctaagctccccccagggtgtgcagcttgacatcgcgtcgcagagcttggaccaggagatcctcttaaaggtaaaaaccgagatcgaagaagaactgaagagccttgataaagaaatatctgaggccttcacttccactggcttcgatagacatacctctccagttttttcacccgccaatcccgagtcttccatggaggattgcctagcccacttgggagagaaggtgagtcaagaactcaaggaacctttgcataaagcactccagatgctgctatcacaacctgtcacataccaggcatttagggagtgtacccttgaaacaactgttcatgccagcggctggaacaagatcttagttcccctcgtgctactgaggcagatgctgttggagctgacgagaagaggccaggagcccctatcagccctgttacagttcggcgtcacatatctcgaggactactctgccgaatatattatccagcaaggtgggtgggtctag

SEQ ID NO: 24604 - DNA, 315 bp, Artificial Sequence
  Description of Artificial Sequence: Synthetic coding sequence
atggcatcatcgtccacagttcctctgggattccattatgaaaccaagtacgtcgtgttgagttacctgggcctgctgtcccaggagaaactgcaagagcagcatcttagcagccctcagggcgtgcaactcgacattgctagccagtccttagaccaggaaatacttctcaaagttaaaacagaaattgaagaggaacttaaatctctcgataaggagattagtgaggggtggtccgctgtggctcccagcaggcctacaacgacatccatcagccaggtacagatgatcctcctcagtcagcctccagagtag

SEQ ID NO: 24605 - DNA, 606 bp, Artificial Sequence
  Description of Artificial Sequence: Synthetic coding sequence
atggcgagctcctcgacggtccccttggggtttcattatgaaactaagtacgtggtcctgtcctacctcggcctgctgagtcaggagaagctgcaggaacagcatctgagcagtcctcagggcgtacagctggacatcgcctcacagtccttggatcaagagatcctgctgaaggttaaaacagaaattgaggaggagttgaagtctctggataaggagatttccgaggcctttacatcaacgggctttgacaggcataccagccccgtcttttctcccgccaatccagaaagttctatggaagattgtctcgcccacttaggcgagaaagtgtcccaagagttgaaggagccactccacaaagcactccagatgctgttaagtcaacctgttacgtaccaggcgtttcgagagtgtaccctagaaaccacggtccacgcgtccggttggaacaagattctggtgccacttgtactcctccgacagatgttgttggagctcactcgaagagggcaggaaccattatccgcgctcctgcagtttggcgtgacatatctggaagattatagcgctgagtacattatccagcagggcgggtgggtgtag

SEQ ID NO: 24606 - DNA, 1086 bp, Artificial Sequence
  Description of Artificial Sequence: Synthetic coding sequence
atgaaacagtcgatgttgttctccgccacatgggattcatctctcaagagatcctgcaagtcaaatatatttcctcacccaaagatccttgtgcccttggttctgctcaggcagatgctgttggaattaacacgtcgaggacaggagccgctttctgcactcctgcaattcggcgtgacatatctggaagactactctgccgagtatattatccaacagggtggctggggtacagtttttagtctggaatcagaggaagaagaatacccaggtatcacagccgaggactcaaatgacatctacatactgccctccgacaatagcggacaggtctccccaccagaaagtccgacagtgacaacatcatggcaaagtgagtcactgcccgtttccctgtcagcctcccagagctggcatacagaatccctgccggtttctctgggccccgagtcctggcagcagattgccatggatcccgaggaggtgaagtccctagacagcaatggggccggggaaaagtcagaaaataactccagtaactcagatatagtgcacgtggagaaggaagaggtccccgaggggatggaagaggcggctgtggctagtgttgtcttacccgcaagggaacttcaggaggcattacccgaggcccctgccccactgttgccccatataaccgctacctcgcttctgggtacacgagagcccgacaccgaggtcattacagtcgaaaagagctcaccagcaacaagtctgttcgtcgagttggacgaggaagaagttaaggccgcaacaacagaacctacagaggtagaagaagtcgtccccgcactggagccaacggaaactttgctgtcggagaaggaaatcaacgcccgcgaggagtccttggtcgaggagctatcacctgcaagcgagaagaagccagtgcccccaagtgaagggaaaagccgcctctctccagccggggagatgaagcctatgcctctatctgaaggtaagtcaattctgctttttggcggcgcagccgctgtggctatcctggccgtggccattggggtcgcactggccctgcgcaagaaatag

SEQ ID NO: 24607 - DNA, 972 bp, Artificial Sequence
  Description of Artificial Sequence: Synthetic coding sequence
atgctcctggagctcactcggcgcggacaggagccattatctgccctcttacagtttggagtgacttatctggaggattacagcgccgaatatatcattcagcagggggggtggggaacagtattcagcttggagagcgaggaagaagaataccctggcattacagccgaagactcgaacgatatctatatacttcctagcgacaattctggccaagtaagtccacccgaaagccctaccgttacaacaagttggcagagcgagtctctgcctgtgtctctgagcgcatctcagtcatggcacacagagtccctgccagtttcattgggcccggagagctggcaacaaatcgccatggaccccgaagaggtgaaatcactagactctaatggagccggcgaaaaaagcgagaataactccagcaattctgacattgtacatgttgaaaaagaggaagtgcccgaaggaatggaggaggctgccgtggccagtgtagtactgcctgcacgcgagctgcaggaggcgcttcccgaggcaccagcccctctgctgccacacattacagctacgagcctgctgggcaccagggaaccggataccgaggtaatcaccgttgagaaatcatcgccagctacaagtttattcgtggaactcgatgaggaggaagtgaaggccgccactaccgagccaaccgaagtcgaagaggtggtgcctgcactcgagcctaccgagacactgctatcggagaaggaaattaatgcaagagaggagtcactggtggaggaattgtcaccggcgagcgaaaagaaacccgttcccccctcagaaggaaaatctcgactgtcccctgcgggggaaatgaagcctatgccactgtccgagggtaagtccatactgttatttggcggggccgccgccgtggccatcttggccgtggcaatcggcgttgcattggctctgcggaaaaagtag

SEQ ID NO: 24608 - DNA, 516 bp, Artificial Sequence
  Description of Artificial Sequence: Synthetic coding sequence
atggcaagcagctctacggtgcccttagggttccattatgagaccaaatatgtggtcctcagctaccttgggctcctgtcccaagagaaactccaagagcagcacctctcttcaccacagggagtgcagttagatattgcaagccaaagcctggatcaggagattctgctcaaggtgaagaccgagattgaagaggagctcaaaagcttggataaggaaatctccgaagcttttacatctaccgggttcgaccggcacacttcgcctgtgttctctccagcaaatccagagtcttctatggaggattgtttagcccacctgggggagaaggtgagtcaggaactgaaggagccgcttcacaaagctttgcaaatgctgctttctcaggccctttgtctcgtgctgagtcagcggcgcagaaatacgttggagtccttacaaaagattgccatgacctttactagctgtcctgctacgacactggacaaatccgttcctcagtccctgcaactgtag

SEQ ID NO: 24609 - DNA, 402 bp, Artificial Sequence
  Description of Artificial Sequence: Synthetic coding sequence
atggataagtacatccttgataatggaaaggtccatctcgggtctggcatatgggttgatgaggagaagtggcatcaattgcaggttacccaaggggactctaaatataccaaaaatctggccgttatgatatggggaaccgatgtcctcaaaaaccgctccgtgacaggtgtggccacgaagaagaagaaggatgctgtgcctaaaccacctctgagccctcataaactgtctatagtaagagagtgcctctatgaccggattgcccaggagaccgttgacgaaaccgagatcgcgcagagactgtctaaggtcaataagtacatctgcgaaaaaattatggacattaataaaagctgtaagaatgaagaaagacgcgaagcgaagtacaaccttcaatag

SEQ ID NO: 24610 - DNA, 1266 bp, Artificial Sequence
  Description of Artificial Sequence: Synthetic coding sequence
atgtacgcttttgtgagatttctggaagacaacgtgtgctacgccctcccagttagctgtgttagagactttagccctcgaagtagattagattttgacaaccagaaggtgtatgctgtatataggggcccggaggagctgggagccggccctgagtctccacctcgtgccccacgcgactggggcgccctgttgcttcacaaagcccagatactggccttagctgaggacaaatcagatcttgaaaacagcgtgatgcagaaaaaaattaagattcctaagctgagtcttaaccacgtagaggaggacggagaagtcaaagattatggtgaggaagacctgcagttgcgccatatcaaacgtcctgagggtcgtaaaccatcagaggttgcgcataagtccatcgaagccgtcgttgcccgactggaaaagcagaacgggctaagcctgggccactccacttgtccggaagaggtgttcgtcgaggcgtcacctggaacagaagacatggacagcctggaagatgccgtggtgccaagagccctgtacgaagaattgttgcggaactaccagcaacaacaggaggagatgagacacttacagcaggagctggagcgtacccggcggcagctagtccaacaggccaagaagctgaaggagtacggggccctggtgagtgagatgaaagagctgagggacctgaatcggaggctgcaggacgttcttttattgagactgggctccggccccgccatagacctagaaaaagtgaagagcgagtgcctggaacctgagcctgagttgagatctacgtttagtgaagaggctaacacctcctcttactatcctgcacctgcacccgttatggataaatatattctggataatggaaaggtgcatcttgggtcggggatctgggtggatgaggagaagtggcaccaattgcaagttacgcagggggatagcaaatatactaaaaacctagcggttatgatatggggaacagacgttcttaagaataggtcagtcactggggttgcaaccaagaagaagaaggacgccgtgccgaagcccccactgagcccccacaaactgtcaatcgtgcgcgaatgtctctacgaccggatcgcccaggaaactgtcgatgaaaccgaaatagctcagagactttccaaagtgaataagtacatatgcgagaagattatggacattaacaaatcatgcaaaaacgaagagcgaagagaggctaagtataatttgcagtag

SEQ ID NO: 24611 - DNA, 399 bp, Artificial Sequence
  Description of Artificial Sequence: Synthetic coding sequence
atggcagaagaaggcattgctgctggtggcgttatggatgtgaacactgcacttcaggaagtgctcaagacagccctgatccacgatggattagcccgaggcatccgtgaagccgccaaggccctcgataagcggcaggcccatctatgtgtgttggcctccaattgcgatgaacctatgtacgttaagctggtggaggccctgtgtgcggagcaccagatcaacctgatcaaggtcgacgacaacaagaagctgggagagtgggtcggcctgtgcaagattgatcgggaaggaaaaccacgcaaggtagttggctgcagttgtgtagtagtgaaagattacgggaaggagtcccaagccaaggatgtgatcgaggagtatttcaagtgcaagaagtag

SEQ ID NO: 24612 - DNA, 996 bp, Artificial Sequence
  Description of Artificial Sequence: Synthetic coding sequence
atggcctctgcgttatggactgtacttccatccaggatgtctctgaggtccctcaaatggagtctgctgctgttgtccctgctgtcattttttgtcatgtggtaccttagtctcccccactacaatgtgattgaacgggtcaactggatgtacttttatgaatatgaaccaatctaccgtcaggattttcatttcacgctgcgcgaacattccaattgcagtcatcagaatcccttcctcgtgatattagtgacgagccacccttccgacgtaaaagcacggcaggccattagagtcacgtggggagagaaaaaatcatggtggggctacgaagtgttaacttttttcttgttgggacaggaagccgaaaaggaagacaagatgctcgctctcagcctcgaggatgagcaccttctctatggggatattattagacaggattttttagacacctataacaacctaacccttaagacaatcatggcctttcggtgggtcactgaattttgtccaaacgcaaagtacgttatgaagaccgatacagatgttttcatcaacacaggtaacttggtcaagtatttactgaatctcaatcacagcgaaaagttttttaccgggtatccactaattgacaactactcatacagaggcttctaccagaaaacacatatctcttatcaggagtaccctttcaaggtcttccccccatattgttccggactcggctatattatgtcgcgagacctcgtgcctaggatctacgaaatgatgggccacgtcaagccaattaagtttgaagatgtatacgtcggaatctgcctgaacttgctgaaggtgaacatccacatccccgaagacacaaacctcttctttctgtacaggattcacctcgatgtatgccagctgcgccgggtgattgcagcccacggattcagcagcaaggagatcataacattttggcaggtgatgctgagaaacacaacttgccactactag

SEQ ID NO: 24613 - DNA, 996 bp, Artificial Sequence
  Description of Artificial Sequence: Synthetic coding sequence
atggcatcggcactgtggaccgtactgcctagccggatgagcttgagaagcctcaagtggagcctgcttctgctttcccttctgtctttcttcgtgatgtggtatctttccttgcctcactacaatgtgatcgagagggtgaactggatgtatttttacgagtatgagcccatctataggcaggattttcactttacactacgcgagcatagcaattgttctcaccagaatcctttcctggtgattctggtgacctcccacccaagtgacgtgaaggcacgccaggctatcagggtgacatggggcgaaaaaaagagttggtggggctacgaagttcttacatttttccttcttggtcaggaagccgaaaaggaagacaaaatgttggccctgtcattagaagacgagcacttactgtacggagacatcattcggcaggacttcctggatacttacaacaatctgactctgaagactattatggcatttagatgggtcactgaattttgtcccaatgcaaaatacgtaatgaaaacagatactgacgtctttattaatacgggcaatctggtgaagtatctgttgaatcttaaccacagcgaaaaattctttacgggctatcctttgattgataattattcctacagggggttctaccagaagacccacatttcttaccaggagtacccattcaaagtgtttcccccctactgctcgggcctagggtacattatgtccagagacctggtgcctcggatctatgagatgatggggcatgtgaaacctatcaagttcgaagacgtgtacgtagggatctgtcttaatttattgaaggtcaacatccacattccagaagatacgaacctctttttcctgtatcgcatccatctggatgtgtgccagctccgtagagttatagccgcacacgggtttagctccaaggagatcattaccttctggcaggttatgctgcggaatacaacgtgtcactattag

SEQ ID NO: 24614 - DNA, 996 bp, Artificial Sequence
  Description of Artificial Sequence: Synthetic coding sequence
atggccagcgcactgtggactgtactaccttcccgaatgtcactcagatctctcaaatggagcctcctgctgctgtccttgctctcattcttcgtgatgtggtatctgtcgctcccgcattataacgtgattgagcgcgtgaactggatgtatttttatgagtatgagcctatctatcggcaagacttccacttcactctacgggaacatagtaactgcagccaccaaaaccccttcctcgtgattttagtgacctcccatccttctgatgtgaaggcaagacaggcaattagggttacctggggggagaaaaaatcttggtggggttacgaggtcctgaccttcttcttactgggccaagaggctgagaaagaggataaaatgttggcactttctctggaagatgagcatttgctctacggggatattattagacaggatttcttggatacctataacaatttgacacttaagactattatggcatttcggtgggtcaccgaattttgccctaatgctaagtatgtcatgaagacagacactgatgtgttcatcaatacagggaacctggtgaaatatttactgaatctaaaccactcagagaagttttttaccggttaccctctcatcgacaattacagctacagaggtttttatcagaagacccacatatcttaccaggaatatccattcaaagttttcccaccctactgctctgggctagggtatattatgagccgcgacctagtgccccggatttatgagatgatggggcatgtcaaacccataaaatttgaagatgtgtacgtcggtatctgcctgaatctgctaaaagtgaatattcacattcctgaggataccaatttgttttttctttatcgtatccacctggatgtttgccagctcagacgggtgatcgcggctcatgggttctcgtctaaagaaatcattaccttttggcaggtgatgctgagaaacactacctgtcattactag

SEQ ID NO: 24615 - DNA, 996 bp, Artificial Sequence
  Description of Artificial Sequence: Synthetic coding sequence
atggcatctgccctgtggactgtgctcccaagtaggatgtcccttagatccctgaaatggtctctgctcctgctcagcctgctgtccttttttgttatgtggtatctctcccttccgcattacaatgtaatcgagagagtgaattggatgtatttctatgagtacgaacccatctatcggcaggacttccattttacgctgcgcgaacacagcaattgttctcaccagaaccccttcttggtcatactggtgacaagccacccaagtgacgtgaaagctcgtcaggcgatcagggtgacctggggggagaagaagagttggtgggggtacgaggtgctcacctttttcctactcggccaggaggcagagaaggaggacaaaatgttggctctttccttggaagacgagcacctgttatatggagatattattcgtcaggatttcctcgacacctacaacaatctcaccctgaaaacaatcatggccttccggtgggtcacagaattctgtcccaacgcaaagtatgtcatgaaaaccgacaccgatgtgttcattaataccggcaacttagttaaatatttgctgaatctgaatcactcagaaaaatttttcactggatacccattgattgataactactcataccgtggtttctaccagaaaacacatatatcataccaggaatacccctttaaagtgtttccgccgtactgcagtggcttaggttacataatgtctcgcgacctcgtgccccggatttatgagatgatggggcacgtaaaacccattaaattcgaggacgtgtacgtgggaatttgtctaaacttactaaaggttaacatacatattccagaggacacaaatctcttcttcttatacagaattcacctagacgtttgccagttacggagagtgatcgcagcccacgggttttcttcaaaagaaatcataacattttggcaagttatgctgcgtaataccacctgccactactag

SEQ ID NO: 24616 - DNA, 276 bp, Artificial Sequence
  Description of Artificial Sequence: Synthetic coding sequence
atggcgtctgccttatggaccgttctgccatcacgaatgtctctcagaagtctcaaatggtccctccttctgcttagcttgctctcattcttcgttatgtggtatctgtcactgccccactacaacgtgatagagcgcgtcaattggatgtacttttacgagatccacctggacgtctgccagcttaggagagtgatcgcggctcacgggttctcctcgaaggaaattattactttctggcaggtaatgcttagaaatacgacttgtcactactag

SEQ ID NO: 24617 - DNA, 336 bp, Artificial Sequence
  Description of Artificial Sequence: Synthetic coding sequence
atggcgagcgccctatggaccgttctgccgtctcggatgtcactgaggagtctgaaatggtccctgctcctcctgtccttgctctcttttttcgtgatgtggtacctgagtctgccacactacaatgtaattgaacgcgttaattggatgtacttttacgaatatgagccgatctacaggcaggattttcactttactctccgcgagcactccaactgttcccaccagaatcctttcctggtgattctggtcacgtctcatccttcagatgtgaaagctcgtcaggctatcagagtgacctggggtgaaaaaaagtcatggtggggttatgaatag

SEQ ID NO: 24618 - DNA, 177 bp, Artificial Sequence
  Description of Artificial Sequence: Synthetic coding sequence
atggcttctgccttatggacagtactcccatcccggatgagcctgcgatccttaaaatggtctctgttgctgctgtcattgctgtcgttcttcgtaatgtggtacctctccctccctcattacaatgtcattgagcgggttaattggatgtacttctatgagtacgagccaatctag

SEQ ID NO: 24619 - DNA, 996 bp, Artificial Sequence
  Description of Artificial Sequence: Synthetic coding sequence
atggcgtccgccctgtggacggttttaccaagtaggatgtccctgcgctcactgaagtggagcctgcttctactttctctgttgagtttcttcgtcatgtggtacctcagtctgccccattacaacgtgatagaacgagtgaactggatgtatttctacgagtacgaacccatctatagacaggacttccacttcacattgagggaacactctaactgttcgcaccagaatccatttctggtgattctagtcacatcacatcctagtgacgttaaagctcggcaagctatccgcgttacatggggcgagaagaaaagttggtggggctacgaggtcctgaccttcttcctgctaggtcaggaggccgaaaaagaagataaaatgctggccttgagtttggaagacgagcacttgctttacggcgacattataaggcaggactttctggatacgtacaacaatctgacgctcaaaaccattatggctttccggtgggtgaccgagttttgtccaaacgccaagtacgtgatgaaaaccgacactgacgtgtttataaataccggcaaccttgtaaaatacttgttgaatctcaaccattcagagaaattcttcaccggttaccccttaattgataactattcctacagaggattctaccagaagacccacatatcctatcaggagtatccctttaaagtttttcctccatactgttctgggctggggtacataatgagccgggacttagtgcctcgaatttatgaaatgatgggccatgtgaagccaatcaaattcgaggatgtctacgtgggcatttgcctgaacctcctaaaagtcaatatccacattcccgaggacactaatctttttttcctgtatcggatacatctcgatgtgtgtcagctacgcagagtaatagccgctcatggattctccagcaaggagataatcaccttttggcaggtgatgttgagaaacactacttgtcactactag

SEQ ID NO: 24620 - DNA, 126 bp, Artificial Sequence
  Description of Artificial Sequence: Synthetic coding sequence
atggcatcagcgctgtggacagtgttgccttcgcggatgtcccttcgatctctgaaatggagtcttcttttactctctctgctgtctttttttgtcatgtggtatctatctctcccccactattag

SEQ ID NO: 24621 - DNA, 996 bp, Artificial Sequence
  Description of Artificial Sequence: Synthetic coding sequence
atggcatcagctctctggaccgtcctgccaagtcgcatgagcctccggtccctgaaatggtccctacttttgctttctcttctgtccttttttgtcatgtggtatctctcactgccccattataacgttattgagagagtgaattggatgtacttttacgaatatgagcctatctatcgacaggattttcacttcactcttcgcgagcactctaattgcagccatcagaacccattcctagtcatattggtaaccagccacccatccgacgtgaaagccaggcaggccatcagggtgacctggggggaaaaaaagagttggtggggttatgaagtactcactttctttttgctgggacaagaggcagaaaaagaggataagatgctggcgttaagcctagaagacgaacatctcctttacggtgatattatcaggcaggattttctggacacatataacaacttgacacttaagactatcatggcgttcagatgggtaaccgagttttgccctaatgccaaatatgtcatgaagaccgatactgatgtgtttataaacaccggcaacctggttaagtaccttctcaatttaaaccactctgaaaaattctttacgggataccccttaatcgacaattacagctatcgcggtttttaccaaaaaacccatatttcctaccaagaatatcctttcaaggtctttccaccctactgcagcggtctgggctacatcatgtcacgagacttggtcccgaggatttacgagatgatgggccacgtgaaacctattaagttcgaggatgtatacgtgggaatttgccttaacctgctaaaagtaaacatccacattcccgaggataccaacctgttttttctctatcgaattcacctggatgtatgtcagctgcgcagagtgatcgctgcacacggtttttcttccaaggaaataatcactttctggcaggttatgctgagaaacactacctgtcattactag

SEQ ID NO: 24622 - DNA, 198 bp, Artificial Sequence
  Description of Artificial Sequence: Synthetic coding sequence
atggcaagcgccttgtggacagttctgccttctaggatgagcctgagatctttaaagtggtctctactgcttctatctttactgtccttctttgttatgtggtacttatccctgccccattacaatgtcatagagagagtgaattggatgtatttttacgagtacgagccaatatatagacaggatttccatttctag

SEQ ID NO: 24623 - DNA, 90 bp, Artificial Sequence
  Description of Artificial Sequence: Synthetic coding sequence
atggcctccgccttatggactgtgctgccttcccggatgagccttaggtccctgaagtggagcctgctcctgctctcattgctctcttag

SEQ ID NO: 24624 - DNA, 165 bp, Artificial Sequence
  Description of Artificial Sequence: Synthetic coding sequence
atggcctcggccctctggacagtcctgcctagcaggatgtccctgcgatctctcaaatggtccctgcttctcctttcactgctgagtttcttcgtgatgtggtacctctctttgcctcactataatgtgattgaaagggtgaactggatgtatttttatgagtag

SEQ ID NO: 24625 - DNA, 981 bp, Artificial Sequence
  Description of Artificial Sequence: Synthetic coding sequence
atgcgcaactggcttgtcttgctgtgtccgtgtgtgttaggcgctgccttgcacctatggcttaggctacgctccccacccccggcatgtgcctctggcgccggtcctgccggcggggtttccttgctcctgccacggttggagtgcaacggcgcagtcagtgcccatccaaatctgcacctgcctggttctagggattcgcccgcctcagcctcacaggttgccggtattacagaccaattggcactgtttccgcaatggaagtcaactcactatgacgtcgtggtgggggttctaagtgcacgcaacaatcatgaattgaggaatgtcattcgatcaacatggatgagacacttactgcaacaccccacactgtcacaaagggtgctcgtaaagttcatcatcggtgcccacggatgtgaagtgccggtcgaagatagagaggacccatattcttgtaagctcctcaacatcaccaaccctgtcctgaatcaggagatcgaggcattcagcctttccgaggatactagcagtgggctgccagaagacagagtggtttctgttagcttcagggtgctctacccaatcgtgattacttccctgggggtgttttatgacgccaacgatgtgggcttccagagaaatataacagtcaagctctaccaagccgagcaggaggaagcgttattcatcgccagattctcccctccttcttgtggcgtgcaagtgaataaactgtggtacaagcctgtggagcaattcatattacctgagagcttcgagggcaccattgtgtgggaatctcaagatctgcacggactggtaagtaggaacctgcataaagtgactgtgaacgacggcggaggagtgctccgcgtcatcactgctggagagggcgccctgccccatgagttcttggaaggcgtggagggcgttgcagggggattcatatacaccatacaaggaaaattcgcttcatag

SEQ ID NO: 24626 - DNA, 966 bp, Artificial Sequence
  Description of Artificial Sequence: Synthetic coding sequence
atgcggaattggctcgtgttactttgtccttgtgtgctgggcgccgcgctgcatctttggctcagactgagatccccccctcctgcatgcgccagcggagccgggcctgcagggggagtgagcctcctcctgccaagattggagtgtaacggggccgttagcgctcatcctaatttgcatctcccgggcagccgcgacagccctgcgtccgcaagtcaagttgctggcataaccgaccaattggcgttgtttcctcagtggaaatccacacactacgacgtggtcgttggagtgctttctgcgaggaacaaccacgagctaaggaatgtgataagaagcacttggatgagacacctcctacaacaccctacactgtcacagagagtgctagtgaagttcattatcggcgctcatggctgtgaagtacctgtggaagatagagaggacccgtacagctgcaaactactgaacattaccaacccggtgttaaaccaggagattgaggcttttagtttatctgaagacacctcttctggcctgcctgaagacagggttgtttctgtctctttccgcgttctatatccgatagtaatcacaagtctcggagtcttctatgacgcaaatgacgtgggttttcagcgaaacattaccgtaaaactgtatcaggcagaacaggaggaagccctgttcattgcacggttttccccacccagctgcggggtgcaggtgaataagttatggtataagcctgtggagcagtttatcctgccagaatcctttgaaggcactatagtgtgggagtcgcaagacctgcacgggcttgtgtccaggaacctgcacaaggtcaccgtgaatgacggaggcggcgtgctcagggttattaccgcaggggagggcgcactgccccacgagttcctcgaaggtgtggagggtgttgccggcggcttcatatacacaatccagtag

SEQ ID NO: 24627 - DNA, 1503 bp, Artificial Sequence
  Description of Artificial Sequence: Synthetic coding sequence
atgagaaactggctcgtcctcctgtgtccttgtgttctgggcgccgctcttcacctctggctgcgcctgcgctctccacctcctgcatgcgcttctggagccgggccggccgatcagctcgccctgttcccgcaatggaagtctactcattacgatgttgtggtgggcgtcttgagtgcacggaacaatcacgaactgaggaatgtcatacggagtacctggatgcgacacctgctccagcacccaaccctttcgcaaagagttctagttaaattcataattggcgcccatggatgcgaagtgcctgtggaggatcgtgaggatccttacagttgtaaactcttgaacatcaccaatccagttctcaatcaggagattgaggctttcagtctgagtgaagacacaagttctggactgcctgaggatcgggtcgtatctgtatcctttagggtcctataccctattgtaatcactagtctgggggttttttacgacgccaatgatgttgggttccaacggaacatcacagtcaaattgtatcaggccgagcaagaggaagccctgtttatagcccggttttccccgccgtcttgtggggtgcaggtcaacaaactgtggtacaaaccagttgagcagttcatcctgcctgaaagtttcgagggcaccattgtttgggagagccaggacttgcacggactcgtctcgagaaacctccataaagtcaccgtgaacgacggggggggcgttctgcgagtcatcaccgccggggaaggagcccttccgcacgagttcctggagggcgtggaaggagttgccgggggttttatttataccatacaggagggcgacgcactgttgcacaacttacactcccgcccacaacgtttgattgaccatataaggaatctgcacgaggaggatgccctgctgaaggaagagtctagtatttacgatgacatcgtctttgtcgatgttgttgacacgtaccgcaacgtgccagctaaattacttaatttctatcgatggactgtggaaaccacctcatttaatcttcttctgaaaacggatgacgactgctatattgatctagaggctgtcttcaaccggatcgtccaaaaaaacctggacggcccgaacttttggtggggaaactttagactcaattgggctgtagataggaccggtaaatggcaagaactggagtaccccagccccgcctaccccgcttttgcctgtggaagtggatacgtgattagcaaggatatcgttaagtggttagcttctaacagcgggcgccttaagacctaccagggggaggacgtgtctatgggaatatggatggccgccattggcccaaaaagatatcaggactcgctgtggctttgtgagaaaacttgtgaaacaggaatgctttcctccccccagtatagtccatgggaactgacagagctctggaagttaaaagagcggtgtggcgacccgtgcaggtgccaagcacggtag

SEQ ID NO: 24628 - DNA, 1602 bp, Artificial Sequence
  Description of Artificial Sequence: Synthetic coding sequence
atgtggctgggcaggcgagccctgtgtgctctcgtcctgctgcttgcctgtgcctcccttggactcctatacgcctcgactcgagatgcccccggcctgaggctgcctctagctccatgggcaccaccacaaagtcctagacggccggaactcccagacctggctccagaaccaaggtacgcacacatccccgtgcgaattaaggagcaggttgtgggccttctagcctggaacaactgcagttgcgagtcatcaggtggaggcctgccgttacccttccaaaaacaggtcagagcaatcgacctgactaaggcgtttgatcctgcggagttgagggccgcctcagccaccagggaacaggagttccaggcctttctaagcaggagtcagagtccagcagaccagctgctgatcgcccctgcaaactcgcccctgcagtacccactgcagggcgtggaggttcagccccttcgatccattctcgtgccgggtttgagtctccaggctgctagcggacaagaggtgtaccaggtgaacctaacggcctctctgggaacctgggatgtggcaggcgaggtcaccggtgtaaccctcaccggcgaaggccaggctgatctcactttggtgagccccgggttagaccaactaaacagacagctgcaactggtgacatattcctctcggagttatcagacaaatacagcagatacagttcggttctctacggagggtcatgaagctgcttttacaatcaggatacgacacccacccaacccgcgcttatacccccccggctctctgcctcagggcgcacagtacaatatttcagcgctggtaacgattgctacaaagactttcctccggtatgatcggctacgggccctgattacttccatccgcagattctaccctaccgtgaccgttgtgatcgccgacgactccgataaacccgagagagtctccggaccctacgtggagcactatctcatgccctttggaaagggttggttcgctggcaggaatctggctgtgtcacaggttaccaccaagtacgtcctctgggtagacgatgattttgtgtttaccgctaggactagactggagagactcgtggacgttctcgaacgaacgcctcttgacctggtcgggggggctgtccgggagataagcggatttgctaccacctatagacagctgctgtcagtcgagcccggcgccccagggctgggaaattgtctgcgccagcggcgtggattccaccacgaactcgtcgggttcccaggatgcgtcgttacggacggagtagtgaattttttcctcgcccgcactgacaaagtgcgcgaggttggattcgaccccaggttgtctagagttgcccacctggagttctttctggatggccttggctcattgagagttggcagttgtagtgatgtcgtggttgaccacgccagcaagctgaaattgccatggacatccagagacgccggcgctgagacttatgccagatatcgatacccaggtagccttgatgagtcccagatggccaagcataggttgctgttcttcaaacacagactgcaatgcatgacgtcacagtag

SEQ ID NO: 24629 - DNA, 714 bp, Artificial Sequence
  Description of Artificial Sequence: Synthetic coding sequence
atgtggctcgggcggagagctctgtgcgcgctagtactgctgctcgcctgtgcttcgctgggtctgctgtacgcaagcacaagggatgcccctgggctgcgactgcctctagccccctgggctccacctcagagcccacggaggcccgaattgccggacctagctcccgagcccaggtacgcacatatcccagtcagaattaaagaacaggtggtcggcctgcttgcatggaacaactgctcctgcgaatccagtggaggaggacttccactgccctttcagaagcaggttagagcgatagacttaacaaaggctttcgatcctgcagaactgcgagcggcatctgcaacacgcgagcaggagtttcaggcttttctttctagatctcaatcccccgctgatcaactgctgatagcacccgcaaactctccgctacagtacccactgcagggcgtcgaagtgcagcccctccgttccatactcgtccctgggctgagcctccaggccgcctccgggcaggaagtgtaccaggtaaacctgaccgcttccctcgggacctgggacgtggcaggtgaggtgaccggcgtgactctgaccggtgagggacaggctgacctgaccctcgtttctcctgggctggaccagctcaatagacagctgcaattagtcacttattcatcccggtcttatcagaccaatacagcggacacctag

SEQ ID NO: 24630 - DNA, 363 bp, Artificial Sequence
  Description of Artificial Sequence: Synthetic coding sequence
atgtggctgggcaggagagctctgtgcgccctggtgttgttactggcatgtgcatccctgggcctactctatgcgagtacgcgtgacgcaccaggccttcgtctgccattggccccgtgggcacctcctcagagccctcgaaggccagagcttccagatctggcccctgaaccaaggtatgcccacataccggtgagaatcaaagaacaggtcgtaggccttttggcctggaataattgttcatgcgaaagttctggaggggggctgcccttgccttttcaaaaacaggtgcgtgctattgatctgaccaaggcatttgaccctgcggagcttagagccgcttcagcaacccgtgagcagtag

SEQ ID NO: 24631 - DNA, 1701 bp, Artificial Sequence
  Description of Artificial Sequence: Synthetic coding sequence
atgggctccgccggcttctcagtaggcaagttccacgttgaagtggctagtcggggtagagagtgtgtgtccggtacacccgaatgcggtaatagactgggttctgcgggattcggggccctgtgcctagaactcagaggggccgatcccgcctggggtcccttcgctgctcacggtaggtccaggagacaggggagtagattcctgtggttactgaaaattctcgttataatcctcgtgctggggattgtcggctttatgtttggtagtatgttcctccaggcagtcttttcttctcctaaacctgaactgccttcccctgccccaggtgttcagaagctgaaactgctccctgaggagagactacgcaacctgttcagctacgacgggatatggctgttcccaaaaaaccagtgtaagtgcgaagcgaacaaggaacagggcggctataactttcaggatgcttacggacaaagcgacttaccagccgtcaaggcgcgcaggcaggctgaattcgagcatttccagagacgcgaaggtctaccacggcctctgcctctactcgtgcaacccaacctgccatttggatatcctgtgcatggtgtagaggtcatgcctctccacaccgttccgattccagggctgcaattcgagggccctgatgccccggtgtacgaggttactttaaccgccagtttaggtacattaaatacccttgctgacgttcccgacagcgttgtgcaaggccggggacaaaagcagctcattatttctacaagtgaccgcaaactgctcaaatttatcctgcagcacgtcacttatacaagcactggctatcagcatcagaaggtcgatatagtgagcctggaatcacgtagttctgtggctaaatttcctgttaccatccggcaccctgtgatccccaagttatacgaccccgggccggagcgcaagctccgaaatctcgtgactatagctaccaagacgttccttagaccacataagttaatgataatgctgagatcgattcgcgagtactaccctgacctgactgttatcgtggcagatgactctcaaaagcctctcgagatcaaggacaaccacgtagagtactataccatgccttttggcaagggctggtttgccggaaggaatctggctattagccaagtgaccaccaagtatgtgttatgggttgatgatgactttctcttcaacgaggagactaagattgaggtgctagttgatgtgctggaaaagactgagcttgacgtggtggggggaagcgttctagggaacgttttccagtttaagctgctgcttgaacagagtgaaaatggggcttgcctccacaaaaggatggggttctttcagccgcttgacgggttcccgtcttgtgtcgtgacttccggtgtcgtcaacttttttctggcacatactgagaggctgcagagggtgggtttcgacccaagactgcagcgggtggcccatagcgaattctttatcgacggtctcgggactttgctggtgggttcttgcccggaggtgatcatcggacaccaaagccgctctcccgtagtggatagtgagctcgctgcgctcgaaaaaacatacaatacttaccgaagcaacacactcacacgcgtgcagttcaaactggcattgcactactttaagaaccatctgcagtgtgccgcctag

SEQ ID NO: 24632 - DNA, 1521 bp, Artificial Sequence
  Description of Artificial Sequence: Synthetic coding sequence
atgacctcaggcggctctaggttcctttggcttctgaagatccttgtgatcatactcgtcctcggaatcgtgggatttatgtttggtagcatgttcctgcaggccgtctttagttctccaaaaccggaattaccatccccagccccaggcgtccaaaagttgaagctgctgccagaagagagattaagaaatctgttctcttacgacggaatctggcttttccctaagaatcagtgtaaatgtgaagccaataaagaacaagggggctacaatttccaggatgcctatgggcagagtgaccttcccgctgtgaaggcccgtaggcaggcagagtttgagcatttccaaaggcgcgaagggttgccaagacccctgccgttgcttgtgcagccaaacctaccctttggataccccgtgcacggcgtcgaagtcatgcctctccacaccgtccccataccaggcctccagtttgagggccctgacgcacccgtgtatgaagtgaccctaacagcttccctcggcacgttgaatacgctggctgatgtacctgacagcgttgttcaaggccgaggccaaaaacagcttataatttctaccagcgaccggaaattgttgaaatttatattgcagcatgtgacatacacctcaaccgggtatcagcaccagaaggtcgacatagtgagtcttgagagtcgaagcagcgtggctaaatttccagtcacaattcggcaccctgtgatccctaaactctatgatcctggcccagagagaaagctgcggaacctggtcactatcgcgacaaagacctttctgagaccacacaaactgatgattatgctccgaagtatccgtgagtactaccctgacctcaccgtcatcgtggctgatgactcgcagaagcctctcgagataaaagacaaccacgttgagtactacaccatgccttttggaaaggggtggttcgctgggcgaaatctggctatcagccaagtgacaaccaagtacgtgctgtgggttgacgacgattttttgttcaacgaagaaacaaaaattgaggtactggttgatgttctcgaaaagaccgagctagacgttgtgggtgggagcgtcttggggaatgtattccagttcaagttgctgctggagcaaagcgagaacggcgcttgtcttcataagcggatgggattctttcagccattggacggattcccttcatgtgttgtcaccagcggagtagtgaacttctttctcgctcacacagaaagacttcagagagtaggtttcgatcctcgcctgcagagggttgctcatagcgaattcttcatcgacgggttaggcacactcctcgtcggctcatgtcctgaggtgatcatcgggcaccagtcccggtcccctgtggtggactccgaacttgccgccctggagaaaacctacaatacatatcgatcaaataccctgactcgtgtacagttcaagctggctcttcattattttaaaaatcaccttcaatgtgccgcgtag

SEQ ID NO: 24633 - DNA, 1443 bp, Artificial Sequence
  Description of Artificial Sequence: Synthetic coding sequence
atgtttgggagtatgttcctccaggctgtgttcagttccccaaaacccgaactgccatcccctgctcccggcgtacaaaagttgaaactgctgcccgaagagcggctccgcaatctgttttcctatgatggaatctggctcttccccaaaaatcagtgtaagtgcgaagctaataaagaacagggtgggtataactttcaggacgcctacggtcaaagcgacctcccagcagttaaagctagaaggcaggcagagttcgagcatttccagagaagggagggcttgccgcgacctcttccgctgttggtccagcctaatctcccttttggataccctgtgcatggggtggaagtcatgccccttcacacagtccctatcccaggattacaatttgaaggccctgatgcgccagtttatgaggttactcttaccgccagcctggggacgttaaataccctggccgatgtgccagattctgttgtgcagggccggggccaaaagcagctgataatctccacttccgacaggaagctcctcaagttcatcttgcaacacgtgacatatacgtctacaggctaccaacaccagaaggtggatattgtgagcctcgagtccagatcttcagttgcaaagttccctgttacaatccgacatccagtaatcccaaagttgtatgacccagggccagagcgcaaactccggaacctagtcactattgccaccaagaccttccttcgcccccacaaacttatgatcatgttgcgctccattagagagtattaccctgatctgactgttatcgtggctgacgactcccagaagcccttggaaataaaggacaatcacgtggagtactataccatgccatttggaaaggggtggttcgccggccggaacctagctatctcccaagtcacaacaaagtatgtcttgtgggttgacgatgacttcctgtttaatgaggagacgaaaatcgaggttctcgtggacgtgttggagaaaacggaactcgatgtcgtcggcggctccgtgctcggaaatgtgttccagttcaagctactcctggaacagtcagaaaacggtgcatgtctgcataagaggatgggcttcttccagccgctcgacggttttccctcctgcgtggtcacaagtggggtagtgaattttttcctcgcacatactgagagacttcagcgcgtcgggtttgatccccgactccagcgcgttgcccactccgagtttttcatcgacggtcttggaacactgcttgtgggcagctgcccggaggtaatcatcggccaccaatcccgctcccctgtcgtggacagtgagcttgctgcgttggaaaagacttataacacctacaggtctaatactctcacccgggtgcagttcaaactcgcactgcactactttaaaaatcaccttcagtgcgctgcctag

SEQ ID NO: 24634 - DNA, 3120 bp, Artificial Sequence
  Description of Artificial Sequence: Synthetic coding sequence
atgccccgcttgcccgtgaaaaagatacgaaaacagatgaaactcttattgcttctgctcctcctctcatgtgcagcttggctcacttacgttcatctaggtcttgttcgacagggcagagccctgagacaaaggctgggatacggaagggatggtgagaaactgacctcagagactgacggacggggcgtacatgctgccccttctacgcagcgggcggaagatagcagcgagagcagggaggaggaacaagcacccgagggacgagatctggacatgctttttcctggtggggccggcaggcttccactcaacttcacgcaccagaccccaccatggcgggaggaatacaaaggacaggtcaatctacacgtgttcgaagactggtgcgggggggccgtcgggcatctgcggcggaatctccatttcccattgtttcctcatacccggaccacagtgaagaaactggcagtaagccctaagtggaagaactatggcttgcggatatttggttttatccaccccgcccgcgatggtgacgtacagttcagtgtggcaagcgacgacaactctgagttctggctgtccctcgatgaaagtccagccgctgcccaattagtcgcttttgttggtaagacaggaagcgagtggactgctccaggagagttcaccaaattcagctcacaggtgtctaaacctagacgcctgatggcaagccggcgatactacttcgaactgctgcacaagcaggatgatagggggtcagaccacgttgaagtgggatggcgcgctttcctacccggtctgaaattcgaggtcatctcctcagcacacatctctctgtacaccgatgagagtgctctaaagatggaccatgtcgctcacgtgccacagtcacctgcttcccacgtgggcggaagaccaccacaagaagaaacatctgctgacatgttacggccagatcctcgggacaccttttttttgacaccaagaatggaatctagctccctggaaaacgtgttggaaccatgcgcatatgcacccacctatgtcgtaaaggattttcccattgctagataccagggattacagttcgtgtatttgagtttcgtctatcccaacgactatactcggttgacacacatggagacagataacaagtgtttctatagggagagccctctgtatctggagcgatttggtttttacaaatatatgaagatggacaaggaagagggggacgaggacgaggaagacgaggtccaaaggcgggcattcctattcctaaaccctgacgactttctggacgatgaggatgaaggcgaactgctggattctctggagcctacggaagccgcacccccccgatctggtccgcagagccccgccccagcagctccagcccagccaggagctacactggctccccccacacctcctaggccaagggacggcggtactccgcggcattcgcgagcgctgagctgggcggcaagagccgcccgacctttgcctctgttcttgggcagagctcctccccctaggccagcagtagagcagcccccacctaaagtatacgtgactcgggtgcggcctggacagagggcctctcctcgcgccccggccccccgcgccccttggcctccatttcctggcgtgttcctgcatcctagaccacttcctagggtgcagctgagggcacctcccagaccaccacgcccgcatgggcggagaaccggcggtcctcaagccacacaaccacgacctcccgcccgggcacaggccacacaggggggaagggagggccaggcacgtacacttggtcccgcagccccaaccgtcgacagcaatttgtcttccgaggcaagacccgtgaccagcttcttgagcctgtcccaggtcagtggtccacagcttccaggagagggagaggaggaggaggagggagaggacgatggagcccccggggatgaagccgctagcgaagactccgaggaagctgcggggcccgccctgggaaggtggcgagaggatgccatcgattggcagcgcactttttctgtgggcgcagtcgattttgaactcctgcggagcgactggaacgatttgagatgcaatgtgagcggcaatctgcagctgcctgaggcagaggctgtggacgtcacggcccagtacatggaacgacttaatgcccgccatgggggcaggttcgctcttctacggatcgtcaacgtggaaaagcggcgcgattcagcgagggggtcccgatttttactcgagttggagctacaagagagaggtggcgggcggctgagactctcagagtatgtgtttctgcgcctgcctggcgccagagtcggggatgctgacggcgagtcccctgaaccagctccagccgccagcgtgcggccagatggaagacccgaactctgcaggcctctcaggcttgcctggcggcaggacgtgatggtccattttatcgtacccgtgaaaaatcaagctaggtgggtggcccagtttctcgcggacatggcagcactgcacgcccggacgggggacagtagattcagtgtcgtactggtggatttcgagtctgaggatatggatgtggaaagagctcttagagccgctcgcctcccgcgctaccagtatctgaggaggacgggaaactttgaacgttctgccgggctccaggcaggcgttgatgctgtggaggatgccagttccattgtgttcctgtgtgatttgcacatacatttcccgcctaatatcctcgacggaatacgcaagcattgcgtggagggtagactggctttcgctcctgtcgttatgcggttgtcgtgcgggtcatcaccgcgggatcctcacgggtattgggaggtgaacggcttcggtctgtttggcatctacaagtccgactttgacagggttggaggtatgaatacagaggagttccgcgaccagtggggaggtgaggattgggagctgctagatcgcgtgcttcaggccggtttagaagtggagaggctccgcctcaggaatttctatcatcattaccacagcaagcgaggtatgtggagtgtgagaagcagaaagggaagtcgcacaggggcttcctag

SEQ ID NO: 24635 - DNA, 708 bp, Artificial Sequence
  Description of Artificial Sequence: Synthetic coding sequence
atggatcccgcacgtcctcttggtctctccatattattgttgtttctgacggaggccgccctaggcgacgccgcccaagagcctaccggcaacaacgcagaaatatgcctgctccccctggactacggaccatgtcgtgctttgctgttacgatactactatgatcggtacacccagagctgtcggcaattcctgtatgggggatgcgaggggaatgctaataatttctacacttgggaagcttgtgatgacgcatgctggcgaatagagaaggtgcccaaagtgtgtaggctgcaagttagcgtcgacgaccagtgcgaaggatcgaccgagaagtattttttcaacctgagttcaatgacatgcgagaaattcttctcaggagggtgccaccgaaaccgaattgagaaccgatttcctgatgaagcaacctgcatgggcttctgtgcccctaaaaagataccctcattttgctattctcctaaggatgaaggcctttgctccgcaaacgttacccggtactactttaaccctcgatacaggacatgtgatgctttcacatacaccgggtgcgggggcaatgacaacaactttgtgtctagagaggattgcaagagggcttgcgctaaggctctgaagaaaaaaaaaaaaatgcctaaactgcggttcgcatcccggatccgaaaaatcagaaagaagcagttttag

SEQ ID NO: 24636 - DNA, 309 bp, Artificial Sequence
  Description of Artificial Sequence: Synthetic coding sequence
atggcagattgggcacgggctcagagccctggtgccgttgaggagatcttggacagagagaataagcggatggccgactctctggccagtaaggtgacccgactgaagtctcttgccttggatattgacagagacgccgaagaccagaatagatacctcgacgggatggtgcgcgcccatggcgtgagagtgtcggtgccatgtccatccaccacctgctgcagagcctgctccgtgagcttttctacaggcgccggcggctggagcaaccatcacttttgtgtgattctgctgggatttctgccatag

SEQ ID NO: 24637 - DNA, 336 bp, Artificial Sequence
  Description of Artificial Sequence: Synthetic coding sequence
atggctgactgggcgcgcgcccaatcgccaggcgctgtggaggaaattctggatagggaaaacaaaagaatggctgactcattggcaagcaaggttacccgccttaagtcattggccctggatatcgatcgcgacgccgaagatcagaaccgttatcttgatggcatggatagcgattttaccagcatgacatctctcttgactggaagcgtgaagaggtttagtaccatggctcgttccgggcaggacaatcggaagcttttatgcggcatggctgtgggattaatcgtcgcatttttcattctaagctattttctttctcgtgctcgtacctag

SEQ ID NO: 24638 - DNA, 3348 bp, Artificial Sequence
  Description of Artificial Sequence: Synthetic coding sequence
atgctcaggggaactatgaccgcctggagaggcatgagacctgaagtgacactcgcttgcctgttgcttgctactgcaggatgcttcgcagacctgaatgaggtccctcaagtcaccgtgcaacctgcatctacagtacaaaagcctgggggcaccgtgatactgggctgcgtcgtagaacctccacgcatgaacgtaacctggcggctgaacggaaaggagctgaacggttcggacgacgccctgggcgtcttaattacccatggcacgctggtcataacggctctgaataatcacacggtcggacgatatcagtgcgtggcccgcatgccagctggggctgtagcgtcagtgcccgccacagtgactctggcaaatttgcaagattttaaactcgacgtccagcacgtgatcgaagttgatgaaggcaacaccgcagtcatagcgtgccacttgcccgaatctcatcccaaagctcaggtgcgctacagcgtcaagcaggaatggctggaagcatcaagaggaaactacctcatcatgccctcaggcaatctccaaattgtgaacgcttcccaagaagatgagggcatgtataagtgcgccgcatacaatcccgttacacaagaggtgaagacatctggctcatccgatcgcctaagggtcaggaggagtaccgcggaagctgcgcgaatcatctatcctccggaagcacagacaatcattgtaacgaaaggacagagcctgatcctggaatgcgttgcttcggggattcctccaccaagggtgacatgggccaaggacggcagtagcgtcaccggatataacaaaactagatttctgcttagtaatctcctcattgacacaacaagcgaggaggactctggcacgtacagatgtatggctgataatggagtgggacagccaggcgccgccgtcatcctgtacaatgtccaggttttcgaacctcccgaggtgacaatggaactctcacagcttgtgataccgtggggacaaagcgcaaagctgacgtgtgaagtgcgcggaaatcctcctccatcagttttatggctgcgtaacgccgtgcccctcatctccagccagaggttgcggctctctaggagagctctaagagtcctctccatgggccccgaggacgagggcgtctaccaatgcatggcagaaaatgaggtcggtagcgctcatgccgtggtgcagttaagaacctccagacctagcataacgccccgtctgtggcaggatgccgaacttgctacaggaactccacctgtcagtcctagcaagcttggaaatcccgaacagatgctcagaggacagcccgctctgccccggccacccacttcagtgggacctgctagccctcagtgtccaggcgaaaaaggacaaggagcccctgccgaggcccccattattctcagttcaccgaggaccagcaagaccgacagttatgagttagtctggaggccacgtcacgaaggatccggtagggctccgatcttgtactatgtagtgaaacaccggaagcaagtaactaactctagtgacgattggacaatcagcggcattcctgccaaccagcacaggctgacattaacccggctggatcccggctcactgtacgaagtcgagatggctgcctataactgcgctggcgaggggcaaaccgccatggtgacttttagaaccggccggcgccccaagccagaaataatggcatctaaggagcagcagattcagagagacgacccaggcgcatctccccagtcttcatctcagcctgatcacggtcgcttgagccccccagaagctccagacagacccactattagcacggcctccgaaacctctgtctacgtcacctggatccctcggggaaacggcggattccctattcagagttttagggtcgaatacaaaaagctgaaaaaagttggagactggatacttgccaccagtgccattcccccctctcgcctgtcagtcgagattactgggctcgaaaaaggtacatcatacaagttcagggtcagggccttgaatatgctgggcgaaagcgagcccagcgcccccagccggccttatgtggtttctggatatagtgggcgcgtgtacgaacgcccagttgccggaccatatataaccttcaccgatgctgtgaatgaaaccaccattatgttgaagtggatgtacatccctgcctctaataataatacaccaattcatggcttttatatctattataggccgaccgactccgataacgattctgattacaaaaaggacatggtggagggagataaatattggcactccatctcacatctccagcctgagacgtcctacgacatcaaaatgcagtgctttaacgaggggggtgagtcagagttttccaatgtgatgatttgtgagacaaaagccagaaagagttccggccagcccggccgactcccaccccccacattggcacctccacagccccctttgcctgagacgatcgaacggccagttggcaccggagcgatggtcgctcggagcagcgatttgccttacttgattgtcggcgtggtcttaggatctatcgtgctgatcatagtgacttttattcctttctgcctgtggagggcttggagcaagcaaaagcacacaaccgatcttggattcccacgatctgcgcttcccccttcgtgcccttatacaatggtgccgctggggggcctgccaggccatcaggcttctgggcagccctacctgagcgggattagcggccgcgcgtgtgccaatggaattcatatgaaccgcggctgcccatctgccgccgttggctatccagggatgaagccccagcaacactgtcccggggagcttcagcaacagagtgatacatcttcccttcttagacaaacccacctaggaaacggctacgatccccagagccatcagatcacacgggggcccaagagtagccccgacgagggtagtttcctgtacaccctgcccgacgattcgacacaccagttgctgcagccccaccacgactgttgccagcgccaagagcagcccgctgcggtgggacagtcaggcgtgagacgcgcgcccgattcacccgtcctcgaggccgtatgggatcccccatttcactctggccccccttgctgtctgggcctggtaccggtcgaagaggttgactcccccgattcgtgccaagtttctggaggcgactggtgtccgcaacatcccgtgggggcttacgtcggccaggaacctggtatgcagctcagccccggtcctcttgtgcgggtcagtttcgaaactccccccctgaccatatag

SEQ ID NO: 24639 - DNA, 3345 bp, Artificial Sequence
  Description of Artificial Sequence: Synthetic coding sequence
atgctgcgaggaaccatgacagcctggcgtgggatgcgtcccgaggtgaccctggcttgcttgttattggccacagccggatgctttgctgatttgaacgaagtcccccaggtcactgtccagcccgcttcaacagtccaaaagcccggcgggaccgtcatattagggtgcgttgtagagccgccccgcatgaacgtcacctggcggctcaacggcaaggaattgaatggttctgacgatgcactaggtgtgctgataactcacggtacgctggtgattaccgctctcaacaaccacacagtgggccggtatcaatgtgtcgccaggatgcctgctggagcagttgcttctgtccccgccactgtcactctggccaatctgcaggacttcaagctagacgtacaacacgtgatcgaagtggacgagggcaacaccgctgtgatcgcgtgtcatttaccggagtctcacccaaaggcgcaagtcaggtacagcgtgaagcaggaatggctagaggcgtcccggggaaactatttaataatgccctccgggaacttacaaatcgtgaatgcttcccaggaagacgaaggcatgtacaagtgcgctgcgtataatcccgtcacccaggaggttaagacaagcggttccagcgatcgcctccgtgtccggcgttccaccgcagaagccgctagaatcatttacccaccagaggcccagactataatcgtcaccaaagggcagtcgctcattctggaatgcgtagcttctggcatcccgcccccgcgagtcacatgggcgaaggacggttcatccgtcactggctataacaaaactagatttctcttaagtaatctcctaatcgacaccactagtgaggaagatagcggcacttatcgatgcatggccgacaacggcgttggtcaacctggcgcagccgtcatactatataatgtccaggtttttgaacctcccgaggtgactatggagcttagccagcttgtgatcccctgggggcagtcggcaaaacttacatgcgaagtgcgtggaaacccgccaccctccgtgttatggctccgaaatgctgtgcctctcatctccagtcagagactgaggctgtctagacgcgcactgcgggtgttaagcatgggcccagaagatgagggggtctatcagtgtatggccgaaaatgaggtgggatcagctcatgcggtggtgcagctcagaacctcccgcccatctattactccacgactctggcaagatgcagagcttgcgactggcacacccccagtaagcccaagcaagctgggtaatcctgagcagatgctcaggggccagcccgccttgccgaggccgcctacatcagtagggcctgcctctcctcagtgtcccggggagaaaggacagggcgctcccgctgaggcacccattatcctcagcagcccccgcacaagtaaaactgactcttacgaactggtgtggagacctcgccatgaaggaagtgggcgggcccccatcttgtactatgtggtgaaacatcgcaaggttacgaatagctcagatgattggacaattagtggcatccccgcaaatcagcaccgactgacgcttactcgcctcgaccctggtagcttatatgaggtcgagatggcagcctataactgcgccggcgaagggcagactgctatggtaaccttccgcaccggtagacgtcctaagcctgagattatggcgagtaaggagcagcagattcagcgggatgatcccggcgcttctcctcaaagctctagccagcctgaccatggacggctctccccccctgaagctcccgaccgccccactatctcaactgctagtgagacgtctgtgtacgtgacctggatccccagaggtaatggcggattcccgattcagtcatttcgcgtggagtataaaaagttgaaaaaggtgggggactggatacttgccaccagtgcaatcccaccttccaggttatcagttgaaataaccggcctagagaaaggtacttcctacaaatttcgggtgcgcgcgttaaacatgctgggagagtccgagccctccgctcctagccgaccatatgtggtcagcgggtactcaggaagggtctacgagagacctgtcgccggcccttacatcacttttacagatgcagtgaatgaaaccaccataatgctgaaatggatgtacatccctgcaagcaataacaatacgcccattcacgggttttacatctactataggcccaccgactctgacaatgatagcgactataagaaagatatggtggaaggcgacaaatactggcattcaatctcgcatttacagcctgaaacctcatacgatattaaaatgcaatgctttaacgaagggggcgagagtgagttttcaaatgtaatgatttgtgagactaaggctagaaagtcatctggacaacccggcagactaccacctcctactcttgctcccccccagcccccgctgcctgaaaccattgagcgccccgtgggtacaggcgccatggtggcaaggtcttccgacctcccttatttaatagtgggagtcgtgctggggtccatcgtcctaattatcgttacattcatccctttttgcctgtggcgggcatggagcaagcagaagcatactaccgatctggggtttcccagaagtgccctcccaccaagctgcccctacaccatggtaccactgggcgggctgccaggccatcaggctagtggccagccatatctcagtggcatcagtggaagggcgtgtgccaacggaattcacatgaaccgaggttgccccagcgctgccgtcgggtaccccggaatgaaaccacagcagcattgtcccggcgagttgcaacagcagtctgacacaagttccctgctgcggcagacgcacctcggcaacggatatgacccccagtcccaccagattacccgaggacccaaaagctcgcctgacgagggtagcttcctgtataccctccccgatgatagcactcatcagcttttgcagccccaccatgattgttgccagcgacaagagcagcctgcggcagttggacagagcggcgtgcggagggcgccagactctcccgtactcgaagcagtgtgggatcccccttttcattccgggcccccgtgctgtctcggcctcgttccggttgaggaagtggacagtcccgacagctgccaggtatcaggcggggactggtgccctcaacaccccgtgggggcatatgtgggccaggaaccaggcatgcagctttctccaggaccattagttagagtgtcgttcgaaacacccccgctgaccatatag

SEQ ID NO: 24640 - DNA, 69 bp, Artificial Sequence
  Description of Artificial Sequence: Synthetic coding sequence
atgctaagaggcacaatgactgcttggcgaggcatgagacccgaggttacattagcttgtctgctctag

SEQ ID NO: 24641 - DNA, 258 bp, Artificial Sequence
  Description of Artificial Sequence: Synthetic coding sequence
atgttgagagggactatgaccgcgtggaggggcatgcggcccgaggtgacccttgcctgtctccttctcgctactgcaggttgcttcgccgacttaaatgaagtacctcaggtgaccgtacagccagcatccacagtgcagaagcccggggggaccgtgatacttggctgcgtggtggagccccccaggatgaatgtgacctggagactgaatggtaaagagttgaacgggtcagacgacgctctcggtgtgctgtag

SEQ ID NO: 24642 - DNA, 474 bp, Artificial Sequence
  Description of Artificial Sequence: Synthetic coding sequence
atgctcagaggaacaatgaccgcatggcggggcatgcgaccggaggtcactcttgcctgcctgctcctggccactgctggttgctttgcagatctgaacgaggtacctcaggtgaccgtccagccggcctcaactgtccagaagcccggcggaaccgtgatcttgggatgcgttgtggaacccccacgtatgaacgttacctggcgccttaacgggaaggagctgaacggctccgacgacgctctgggtgtgttgataactcatggaaccttggttattactgcactgaacaatcatactgtggggagatatcagtgtgtcgccagaatgcctgccggggcagtggcatctgtgcctgccaccgtaacactcgcctctgagtccgcccctttacctccttgtcatggagctgtcccgcctcacctatcccatcccgaggcccccactattcacgccgccagctgctattcgtag

SEQ ID NO: 24643 - DNA, 474 bp, Artificial Sequence
  Description of Artificial Sequence: Synthetic coding sequence
atgttgcgaggtactatgactgcctggcgagggatgcgccctgaggttacactggcatgcctgctgctagcaactgcaggctgctttgcagacctcaatgaagtaccacaagtaactgtgcagcccgcctccaccgtccaaaagccgggagggactgtgattctcgggtgcgttgttgagcccccccgtatgaatgtgacatggcgcctgaacggcaaagaattgaatggttcggacgacgccctgggcgttctgatcacacatggtacacttgtgattaccgctctgaacaatcacactgttggtcgctaccaatgcgtggcgcgcatgcctgctggtgcggtcgcctctgtgccagctacggtgaccttggcttctgaaagtgcgcccctcccaccttgtcatggggcggtgcccccccatttgtctcaccccgaagcaccgacaatccatgcagcgagttgttactcctag

SEQ ID NO: 24644 - DNA, 99 bp, Artificial Sequence
  Description of Artificial Sequence: Synthetic coding sequence
atgcttagggggaccatgactgcgtggagaggtatgcgccccgaagtgacccttgcctgtctcctcctcgctactgcaggctgcttcgcagacctgtag

SEQ ID NO: 24645 - DNA, 3345 bp, Artificial Sequence
  Description of Artificial Sequence: Synthetic coding sequence
atgctaaggggcactatgaccgcctggcgaggaatgcgtcccgaggtcacccttgcttgtctcttgctggcaacagccggttgttttgctgacttgaacgaagtacctcaggtgacggtgcaaccggcttccaccgtgcagaagcctggtggcacagtgattctcggctgtgtggtggaaccgcctcgcatgaacgtgacttggcggctgaatggcaaggaactgaacgggagcgacgatgctctcggagtgctcattacccatggcaccctggtcatcaccgccctgaataaccacacagtgggccgataccaatgtgtcgcgcgcatgccagcgggcgcagtggcctctgtgccagccaccgtgacactggcaaatcttcaggattttaagctggatgtgcagcacgtcatcgaagtggacgaaggcaatacggccgttatcgcctgtcacctgcccgagtctcaccccaaggcacaagtgaggtactcagtgaagcaagagtggctggaagcatcccggggaaattatcttatcatgccctctgggaacttgcagatagtgaatgcctcacaagaggacgaaggtatgtataagtgtgccgcttataatcccgtcacacaggaagtcaaaacaagcggttcttctgataggctgcgagtcagaagaagtacagccgaggctgcacgcatcatttaccctccagaagcccagaccatcatcgttaccaaaggccaatccctgatcttggagtgcgtggcctcggggatccctcctccccgcgtgacttgggcgaaggacgggtcaagcgtcactggatacaataaaacccgtttcctgctgtctaatctactcattgatacgacaagcgaagaggatagtggtacatatcggtgcatggctgacaatggagtgggtcaacccggtgccgccgtgatactttacaacgttcaagtttttgagccacctgaggtgacaatggagctaagtcagttagtgatcccttggggacagtcagccaagctcacttgcgaagttcgaggcaatccccccccaagcgtgttatggctgagaaacgccgtcccgctcattagcagtcagcgcctgcgattgagcaggcgggcgcttcgagtgctcagcatggggccggaagacgagggcgtgtaccagtgtatggcagagaacgaagtcggaagtgcccacgcagtggtacaactgcgtactagcagacccagtataacccctcgactatggcaggatgcagaactcgcaaccggcactccgccagtaagtccatccaaactgggtaacccggaacagatgcttcgaggccaacctgctctgccgcgcccccctacgtctgtggggcccgcaagtccgcagtgtcccggcgaaaaaggccaaggggctcccgctgaggccccgattattctcagcagccctcgcacatccaaaactgactcttacgaattagtttggcgaccaaggcacgagggatcggggcgagcgcctattttatattatgtggtgaagcaccgcaaagtgaccaactcctctgatgactggacgatcagcggaattccggccaaccagcaccgcctcactcttacgcgcctagatccaggttcattgtatgaggtggagatggccgcctataactgtgccggtgagggacagaccgctatggtgacatttaggacaggacggcggccaaagcccgagatcatggctagcaaggaacagcaaattcagcgcgatgatccaggcgcttctccccaaagttccagtcaaccagaccacggacgcctcagccctcccgaggcacctgatcggcctacaatcagcacagcctctgaaacaagtgtgtatgtgacatggatcccacgaggcaatgggggatttcctatccaaagtttcagggtcgaatacaaaaaattgaagaaagtgggagactggattctggccaccagcgccataccaccctctagactgtctgtcgaaattacaggcctggaaaaagggacttcctataagttcagagtgcgcgccttaaacatgctgggggagtcggagcctagcgcaccctctcgaccatacgtcgttagcgggtacagcgggagggtgtatgagcgccctgtcgccggcccctacatcacttttaccgatgctgtaaacgaaaccacgatcatgctaaagtggatgtacataccggcctctaacaacaacaccccaatccacggtttctatatctattataggcctacagattctgataacgacagtgattataaaaaggacatggtggaaggggacaagtactggcactcaatatcacacctccagccggaaacaagttatgacataaagatgcaatgtttcaatgaaggtggcgagtctgaattttccaatgtcatgatctgtgagactaaagcccggaagtctagtggccagcccggcagactgcctcctcctacactggcccccccacagccacccctaccggaaaccattgagaggcccgtaggcactggcgcgatggtcgccaggagcagcgacctgccttatcttatcgtcggagtcgtgctggggagcatagtactgatcatagtgacgttcatccctttttgcctttggcgcgcctggtctaagcaaaagcatacgacggacctgggatttccgagaagtgcccttcccccgagctgtccatatacaatggtgcccttaggcggcctccccggacatcaagcgtccggccagccctatctcagcggcatttcaggccgtgcctgcgcaaatggaatccatatgaaccgaggctgcccctcagctgccgtgggctatccaggcatgaaaccgcagcagcactgtccaggggaactgcagcagcaatccgacacttcgtcacttttgagacagactcacctgggcaatgggtacgacccgcaatcccaccaaatcacaaggggcccaaagagcagtcccgatgaggggagctttctatatactctaccagatgattctacccatcaactgctccaacctcaccacgactgctgtcaacgtcaggagcagccagcagcggtcggccaaagcggggtgcggcgagcgcctgattcgcctgtgcttgaggcggtctgggaccccccatttcactccggaccaccgtgctgtctgggactagtgccagtggaggaagtcgactcacctgattcatgtcaagtaagcggcggcgactggtgtccgcagcatcctgttggcgcttacgttggtcaggaaccgggcatgcagctgtcaccaggtcctctagttcgggtgtcgttcgaaaccccacccctgaccatttag

SEQ ID NO: 24646 - DNA, 627 bp, Artificial Sequence
  Description of Artificial Sequence: Synthetic coding sequence
atgagatacgcttgcagcagctccgaggattggccaccaccactcgacatttctagtgacggggacgtggatgctaccgttttgagggagctgtacccagactctccccccggagtaagcctttccagactgcgctggtctgccatgatgtacacggggagtttcacttactgggtcagaagcatgctgtcacgccacaaactagatgctatcctgggacgattggggtatacagcaaccctcgaaagcgaattctcccttgtgcaggcaatctcgaaggaaaacgtcaagcagatggtcttcaaaatttttctcgtacgcgtctcttgtgaggcagtcctaagaacggctggtactcgcatgctggagcctggcaccgaaaaactcgcccggactcactcccgacattctagtgagaagcgcctggtgaagccctgctcgtgcctggagggcgtgcaaccaggccccggcagcgggggacctcagcagggcccctccgagggcgtaggctctgaaaccgctttggctgaaggaacagccgggcaacgaagcctgcccatggccctttcgcccagcgaggtctccactgctcccaatagcctgccttccggatcgcccgttttatag

SEQ ID NO: 24647 - DNA, 753 bp, Artificial Sequence
  Description of Artificial Sequence: Synthetic coding sequence
gctcgctacaatcgcacatcttatttctaccccacctttagcgagtcttcagagcactcgcatctgctcgttagtcccgtgctagtagcatctgccgtgataggtgtggttatcattctgtcatgcatcaccatcatcgtaggatctattcgccgcgaccgtcaggccagactgcaaagacataggcatcggcatcatcggcaccaccatcaccatcaccaccaccgcaggcgcagacacagggaatacgaacatggatacgtctccgatgaacatacttattcccgctctagtaggcgaatgcggtatgcttgctcaagtagcgaagactggcctccacctctggacattagctcagatggcgatgtggatgcaaccgtactaagggaactttatcccgattccccccctggctatgaagaatgtgtgggaccaggggccacacagctgtacgttcccacagacgcacctcccccgtatagtctgactgactcttgccccacactggatggcacatcggatagcggcagcggccactcccccggaaggcatcagcaggagcaacgcacacctgcccaggggggactgcacacggtaagtatggataccttgcccccttatgaagcggtgtgtggcgctggtccgccctcaggactgctccccctccccggtcccgatcctggcccccgaggttctcagggcagtcccactccaactcgggcccctgcaagtggacctgagcgcatcgtgtag

SEQ ID NO: 24648 - DNA, 780 bp, Artificial Sequence
  Description of Artificial Sequence: Synthetic coding sequence
atgagcttcaagcgcccctgtcctctcgctcgctacaaccggaccagctacttttatccaactttctccgaatcttctgagcatagtcatctgctcgtctccccagtgcttgtagctagcgcagttataggcgtcgtaatcatcttatcttgtatcaccatcatcgtgggctcgattcgccgggaccgccaggcccgactccagaggcatagacatcggcatcatcggcaccaccaccaccaccaccaccaccgccgccggagacacagagaatacgaacacggctacgtcagcgatgagcatacttactccaggagcagcaggcgaatgagatatgcttgctcgtcctcagaagattggccgcctcctctggacattagttccgacggggacgtggatgcaaccgtgctgcgcgagctctaccccgattccccacccggctacgaagagtgtgtcggtccgggggcaacccagctctacgtgcccactgacgcgccccctccttacagcctcacagatagctgtcctactcttgatggcactagcgattctggatctgggcattctcctgggcgccatcaacaggagcagcggacccctgcccaggggggcttgcacacagtgagcatggacaccctccccccatatgaagctgtctgcggcgccgggccccctagtggactactgcccctccccggtcccgaccccggccctaggggatcccaaggctcccccacaccaacgcgtgcaccggcgtccgggccagagcgaatcgtgtag

SEQ ID NO: 24649 - DNA, 384 bp, Artificial Sequence
  Description of Artificial Sequence: Synthetic coding sequence
atgagtgccgccggcgcccgggggctgcgggcaacgtaccaccgcctcctggataaagtagagctaatgctgccagaaaaactcaggccgctctacaaccacccagcaggaccacgcacagtgttcttctgggcacccatcatgaaatggggtctggtgtgtgctggtcttgctgacatggcccggcccgccgaaaagctgtccactgcacaatcagcagtattgatggcaacgggctttatctggtctcggtacagcctggtgattattccaaaaaactggagcttgttcgctgtgaactttttcgtgggcgctgccggggcttcccagcttttccgcatttggcggtacaatcaggaactgaaagcgaaagcccacaaatag

SEQ ID NO: 24650 - DNA, 384 bp, Artificial Sequence
  Description of Artificial Sequence: Synthetic coding sequence
atgtccgccgcgggcgcccgcgggttgcgggctacctatcaccggttactggacaaggtcgagctgatgctgcccgaaaaacttagacctctgtacaaccacccagccgggcctcgtacagtgtttttctgggcccctattatgaagtgggggctcgtttgtgccggattagctgacatggcccgacccgctgaaaaactctccacagcacagtcagccgtcctgatggcaaccgggtttatatggagcaggtactcccttgtcattatccccaaaaactggagtctgttcgcagtgaattttttcgtgggtgcagcaggtgcatcccagctgttccgaatttggcgctacaatcaggagttgaaagctaaggcccacaagtag

SEQ ID NO: 24651 - DNA, 318 bp, Artificial Sequence
  Description of Artificial Sequence: Synthetic coding sequence
atgtcagcagctggggcgagaggcctgcgcgcaacctatcaccgactgctggacaaggtggaactaatgcttccagaaaaattgcgtcccctgtataaccaccctgccggcccacggactgtgttcttctgggcccctattatgaagtggggactggtctgcgcaggtctggctgatatggctaggccagctgagaagctctccaccgcacagagcgctgtccttatggccaccggattcatttggagccgctactccttggtgatcatccctaagaattggtccctgtttgctgtaaatttctttgtgggagcatag

SEQ ID NO: 24652 - DNA, 330 bp, Artificial Sequence
  Description of Artificial Sequence: Synthetic coding sequence
atggccggagcattggtccgaaaggctgcagactacgtaaggtcaaaggactttagggattatctgatgtctaaacatttttggggtcccgtcgctaattgggggctgccgatagcggcaataaatgatatgaagaagtcaccagaaattatctccggacggatgacgttcgccctgtgctgctactctctgaccttcatgagattcgcgtataaggttcagccgcgcaactggctgttgttcgcctgccacgcgaccaacgaggtagcccagctcatacagggtggacgcttaatcaagcacgaaatgacaaaaaccgctagtgcctag

SEQ ID NO: 24653 - DNA, 330 bp, Artificial Sequence
  Description of Artificial Sequence: Synthetic coding sequence
atggcgggcgccctggtgcgcaaggcagccgattatgtgcggtctaaagatttccgagactatttgatgagcacccacttttggggcccagtcgcaaattggggcttacctattgcagcaataaacgacatgaagaagtctccagaaatcatatctgggaggatgactttcgcactctgttgctattccttgacattcatgaggtttgcatacaaagtgcagccgcgcaactggctacttttcgcttgtcatgctactaacgaggtggcacagctgatccagggtggaaggctgatcaaacatgagatgaccaagaccgctagcgcttag

SEQ ID NO: 24654 - DNA, 201 bp, Artificial Sequence
  Description of Artificial Sequence: Synthetic coding sequence
atgaaaaagtcaccagaaattataagtggaagaatgactttcgccctgtgctgttactcgttaactttcatgcgctttgcctataaagttcaacctcggaactggctgctcttcgcatgccatgccactaatgaggtggctcagttaatacagggcggaagattgatcaagcatgagatgacgaaaaccgcttcagcctag

SEQ ID NO: 24655 - DNA, 642 bp, Artificial Sequence
  Description of Artificial Sequence: Synthetic coding sequence
atgcctgacgaaaatatctttcttttcgtgccgaatctcataggctacgctcgaatcgtgttcgccatcatcagcttctacttcatgccttgctgccctctcactgcttcctccttctacttactctctgggttgctggacgcctttgacggccacgccgccagagcactcaatcaggggacacgttttggcgctatgcttgatatgctgacagaccgctgttctacaatgtgcctgctggtgaatctcgcccttctgtacccaggagccacactattctttcagattagtatgagtttagacgtcgcttcccactggttgcacctgcacagcagtgtggtacgcggcagtgaaagtcacaaaatgattgatttatcaggaaatccagtccttagaatctattacacctcccgccccgccctgtttaccctgtgcgcaggtaatgagctgttctactgtttactctacctctttcactttagcgaaggcccgctggtggggagcgtcggcctgtttaggatggggctgtgggtgactgcacctattgctctactgaagagccttattagcgtcatccatctgatcaccgccgcgcggaacatggccgccctcgacgcagctgatcgcgctaagaaaaagtag

SEQ ID NO: 24656 - DNA, 1008 bp, Artificial Sequence
  Description of Artificial Sequence: Synthetic coding sequence
atgattctggccagtgtgcttaggtcgggtccaggtggagggctacccttgagacccttgctgggccctgcgcttgctctgcgggcaaggtcgactagtgccactgatacacaccacgtagagatggcccgagaaagatcaaaaaccgtgaccagtttctacaatcaatccgcaatagacgccgcggcggagaagccctccgtgaggctgactccaaccatgatgctgtacgcaggccggtcccaggacggatctcacttgctgaagagcgcccggtacctccagcaggagttgccagttagaatagcccatcgcattaagggctttcgatgtctgccttttattattgggtgcaatcccacgattctgcacgtgcacgaactgtacattcgcgcgtttcaaaaactcaccgacttcccgcctattaaagaccaggcggacgaagcccaatattgccaattagtccgacagcttctggacgatcacaaagacgtggtaactctgctagctgagggtctgagagagagccgaaagcatattgaggatgagaagttggttagatacttccttgacaagactctgaccagccgcctcggcatcaggatgctcgcaacgcatcatctagccctgcatgaagacaagcccgacttcgtggggatcatttgtacccggctgtccccaaaaaaaatcattgaaaagtgggtggatttcgcccgacggttgtgtgaacataaatatggcaatgcccccagggtccgaattaacggacatgtagccgcaaggtttccatttatcccgatgccattggactacatcctacctgagctgctgaaaaacgcaatgagaatcagcgatcggggcgggggcatcgcccacaaagacctggatcgcgtgatggactatcattttacaaccgccgaggcatccactcaggatccacgcatttctcctttgttcggacatttagatatgcattctggcgcccaaagcggcccaatgcatggttag

SEQ ID NO: 24657 - DNA, 1098 bp, Artificial Sequence
  Description of Artificial Sequence: Synthetic coding sequence
atgatcctagctagcgtgctaaggtccggccccgggggaggcttaccgctcaggcctctgctcgggcctgctcttgcccttagggcccgctcaacctcggccacagacacacaccacgtggagatggctcgcgaacgttccaaaacggtgacatctttttataatcaaagcgctatcgatgcagctgctgagaaaccgagcgtgagactgactcctaccatgatgctatacgcgggccgctctcaggatgggagccatctgttgaagtcagctcgttatctgcagcaagaactgcccgtccgcattgcccaccgtataaaaggcttccgctgccttccatttattatcggttgtaatcctacaattctgcatgtccatgaactgtatatcagagccttccagaagctgactgattttccgcccattaaggatcaagcagatgaagctcagtattgtcagctagtgcgccagctgctggacgaccacaaggacgtagtgacattactcgcagaaggcctgcgcgagtctaggaagcacattgaagatgaaaaactggtcaggtactttctggacaaaactcttacctcaagattaggaatcagaatgctggctactcatcatctggccctgcacgaggacaaacctgattttgtcggtatcatctgcacccgcctgtccccaaaaaagataatagagaagtgggtagattttgcccggagactttgcgagcataaatacgggaacgctccccgggtgcgcatcaacggacacgtagccgccagatttccttttatacccatgccattagactacattttgcccgagctcttgaaaaatgctatgcgggctactatggagagtcacctggacacgccatataatgtgcccgatgtagtcattaccattgcgaacaatgatgtagatctgatcatcaggatctctgaccgaggcggtggcatcgctcacaaggaccttgaccgagtgatggactatcactttaccaccgccgaagcctccactcaggacccgcgtattagccccctgtttgggcatctggacatgcatagtggcgcccagtctgggcccatgcacggctag

SEQ ID NO: 24658 - DNA, 1239 bp, Artificial Sequence
  Description of Artificial Sequence: Synthetic coding sequence
atgatactggcctcagtgctgcggagcgggcccggaggggggttgcctctgagaccgctcctaggacctgcccttgccctgagagccaggtcaacgtctgctacagatacgcaccacgtcgagatggcccgggagcgctccaaaaccgttaccagcttttataaccagagcgctattgatgccgccgctgaaaaaccatccgtccgcctgactcccacgatgatgttgtatgcaggcaggagccaggatggaagccacctgcttaaaagcgcacggtacctgcagcaggaactccccgttaggatcgcccatcgaattaagggatttcggtgcctgcccttcataattgggtgcaaccccactatactccatgttcatgagctgtacataagagccttccaaaagcttacagatttcccgcctattaaggatcaggccgacgaggcgcagtactgtcagctggtacggcaactcctcgacgaccacaaggatgtggtgactctgcttgcggaaggccttcgcgagtcacgtaagcatattgaggatgagaagttggtgagatatttcctcgacaaaactctgacaagtaggctcggcattcgaatgctggcgacacaccatttagcactgcacgaagacaaacccgactttgtcggtattatttgtacacgcctaagtcccaagaaaattatcgagaagtgggtcgattttgcccgtagattgtgtgagcacaagtatggtaacgctcctagggttcgaataaacggacacgtggccgcccgcttcccattcatcccgatgcctcttgattacatccttcccgaattactgaagaatgcaatgagggccacgatggaatcccacctcgacacaccatacaacgtgccagacgtggttattaccatagctaataacgacgtggatctaattatccgcatttccgaccgcggaggcggcatagcccataaggacttggatagagtaatggattatcactttaccacggcggaggcatctacgcaggacccaaggatttctcccctctttggacatctagacatgcatagcggggctcaatcgggccccatgcacggtttcggattcggcttgccaacaagtcgcgcatacgcagagtacttgggaggctctttgcagctacagagcctgcagggtatcgggacagacgtgtatctgagactccggcatattgacgggcgtgaggaaagcttcagaatttag

SEQ ID NO: 24659 - DNA, 756 bp, Artificial Sequence
  Description of Artificial Sequence: Synthetic coding sequence
atgggggcccgggccagtggggggcccctggcccgcgcaggcctactgctacttctgcttctactgctccttctaggtctgcttgcaccaggtgcccagggcgccagaggaagaggcggagccgagaagaactcgtacaggagaacagtcaacactttcagccagagcgtcagctccctgtttggggaggataacgtgcgggctgcccagaagtttttagcccggctaaccgagagattcgtgctgggagtggacatgttcgtggaaactttatggaaggtctggaccgaactgttagacgttcttgggttagatgtgagtaatctgtcccagtacttcagccccgcttcggtttcttccagccctgctcgggctctcctgctcgttggggtggtcctcctggcctactggttcttaagcttgacattggggtttactttttctgtcctgcacgtggtctttggacgctttttttggatcgtgcgcgttgtcctcttctctatgtcatgcgtctacattctgcacaagtatgaaggagagcccgaaaatgcagtgctgcccctttgcttcgttgttgctgtgtatttcatgactgggcccatgggcttttactggcgcagttcaccctcaggcccatctaatccgagcaaccccagtgtggaggaaaagctcgagcacctggaaaaacaggtgcgcctgctcaacattcggctgaatagggtcctggaatccctcgacagaagcaaggataaatag

SEQ ID NO: 24660 - DNA, 1236 bp, Artificial Sequence
  Description of Artificial Sequence: Synthetic coding sequence
atgactcactggtttcacagaaaccccttgaaggccacagcaccagttagtttcaattattatggtgttgttaccgggccttctgcatcgaaaatctgcaatgacctccggtcttctagggctaggctcctggagctttttactgatctgagttgtaaccccgagatgatgaagaatgcagccgacagttatttttctctcctgcaaggattcatcaatagcctagatgaatctacccaggaatccaagctacgatacatccagaatttcaaatggactgatacccttcagggacaggtgcccagtgctcagcaggatgcggtgttcgagcttataagtatggggtttaacgtagccctgtggtatactaagtacgctagccggttggccgggaaggaaaacatcactgaggacgaggccaaagaggttcaccggtcccttaaaattgcagcaggaatttttaagcatttgaaagaatctcatttaccaaaactgatcacacctgcggagaaggggcgcgatctcgaatcacgcttgatcgaggcctatgtgatacagtgccaggcagaggcgcaagaagtcaccatcgctagagcgatcgagcttaagcatgctcctgggcttatcgccgctctagcttatgaaacggcaaatttttaccagaaggccgatcacacgctgtcttctctggaaccagcgtatagcgccaagtggcgcaagtatttgcacttgaagatgtgcttttatacagcttatgcctactgttaccatggtgagactttgctcgcatcggacaagtgtggggaagccatccgatcactccaggaggccgagaagctgtacgctaaggcagaggccctgtgcaaggagtatggtgagacgaaggggcctggacccactgtgaagccttcaggacacctgttctttaggaagctgggcaatttggtgaaaaacacactagaaaagtgtcagagggagaatgggtttatctattttcagaaaattccgacagaagccccccagctggagctcaaagctaattatggccttgttgagcccattcctttcgagttcccacccaccagcgtgcagtggacccccgaaacattagcagcttttgatctgaccaagcggcccaaggacgatagtacaaagcccaagcccgaggaggaagtgaaaccagtcaaagagccagatataaaaccccaaaaagataccgggtgctatatttcatag

SEQ ID NO: 24661 - DNA, 648 bp, Artificial Sequence
  Description of Artificial Sequence: Synthetic coding sequence
atgacccactggttccacagaaaccctctaaaagccaccgcccccgtatcctttaattactacggggttgtgactggaccttcagcgagcaaaatctgtaacgatctgaggagctccagagcccggctacttgagctgttcaccgatttgtcctgcaatcccgaaatgatgaagaacgcagccgactcttacttttcgttgcttcaggggttcatcaactcactcgacgagtccacacaggagtcaaagctcagatatattcagaacttcaaatggacagatacactacagggccaggtcccttcggcacagcaggacgctgtgtttgagctgatttccatgggattcaatgtggctctctggtacacaaagtacgcatcccgtctggctggcaaggagaacatcaccgaggatgaagcgaaggaagtgcatcggtcactcaaaattgccgcggggattttcaagcatctcaaagagtcacacttaccaaagcttatcactcctgccgagaagggacgtgacctcgaatctcgactcatcgaagcgtacgtgatacagtgccaggccgaggcacaggaagtcaccatcgcaagggctattgagctgaagcatgctcccggattaatcgccgcactagcctacgaatag

SEQ ID NO: 24662 - DNA, 1017 bp, Artificial Sequence
  Description of Artificial Sequence: Synthetic coding sequence
atgacccattggttccatcggaaccccttaaaggcaacagcacccgtttcatttaactattacggcgtcgtgacagggcccagtgctagcaaaatttgtaatgaccttagatcatcacgcgcccggctgttggaacttttcaccgacttgagctgcaatccggaaatgatgaaaaatgcggccgattcctactttagcctgttgcaagggtttataaactcgctggacgagtccacacaggagagtaagttgcggtacattcagaattttaagtggaccgacactctgcaggggcaggtgccctctgcacagcaagatgctgtattcgagttaatatccatgggtttcaatgtggcgctttggtatacaaaatacgcatcaaggctcgcagggaaagaaaacatcaccgaagatgaagccaaggaggtacatagaagcctaaagatcgccgccggcatcttcaaacacttgaaagagagtcacctgccaaaactgatcactccggcagaaaaaggcagggatctggagagccggttaattgaagcctacgtgatccagtgccaggccgaagcacaggaggtgacaatagcccgcgccattgagctaaaacacgctccaggattgatcgctgcacttgcctatgaaacggcaaatttttaccagaaggctgaccacaccctcagctccctggagcccgcttacagcgccaagtggagaaagtacctgcacctgaaaatgtgcttttacaccgcctatgcatactgttaccatggggaaacccttcttgcctccgataaatgtggggaagcaatacggagcctgcaagaggcagaaaagctgtatgccaaggctgaggccctgtgcaaggaatacggagagaccaagggacctggccccaccgtgaagccatctgggcatctgttcttcagaaagcttggcaatctggtgaagaacacgttggagaagtgccagcgcgagaatggttttatccttaatccaaaccagaaaaagaagtag

SEQ ID NO: 24663 - DNA, 1140 bp, Artificial Sequence
  Description of Artificial Sequence: Synthetic coding sequence
atgacccactggtttcatcgtaaccctctcaaggcaacggcaccggtgtcctttaactactacggcgtggttacagggcctagtgcctccaaaatatgcaatgacctgcggagtagcagggccaggcttttggaactctttaccgacttatcatgtaaccctgagatgatgaaaaacgccgctgatagttattttagcctcctccagggatttatcaattctcttgacgaaagcactcaggagagcaagctcagatacatccaaaatttcaaatggaccgacacccttcagggccaggtgccttcaatcaccgaagacgaggcaaaggaagtgcatagaagccttaagatcgctgcaggtattttcaagcacctgaaggagtctcaccttccaaagctaataactcccgccgaaaaaggacgcgacttggagtcaaggctaattgaggcttacgtgatacagtgccaggccgaagcccaagaagtcaccattgcccgggccatcgagctgaagcacgctccaggcttgattgccgctctggcctatgagactgcaaatttctaccaaaaggcggaccacactttaagtagcttggagcctgcgtactcagctaagtggcggaaatatttgcaccttaaaatgtgcttttacacggcatatgcctattgttaccacggagaaacgctcctagcctcagacaaatgcggagaagctataagatcactgcaggaggctgagaagctttatgctaaggctgaagcactctgtaaagagtacggtgagaccaaaggacctggcccaacggttaaacccagtggccacctgttctttcggaagctgggaaacctggttaagaatactctcgagaaatgtcagagggaaaatggttttatatatttccagaaaatacccactgaagcccctcagcttgagctcaaagctaactacggcctcgtggagcctatcccattcgaattcccaccgaccagtgtacagtggacacccgagacccttgctgcttttgatcttacaaagcgtccaaaggatgatagcacaaaaccaaaaccggaagaggaggtgaagcctgtgaaagagcctgacattaagcctcagaaagataccggatgctacatcagctag

SEQ ID NO: 24664 - DNA, 309 bp, Artificial Sequence
  Description of Artificial Sequence: Synthetic coding sequence
atgtcctcaccgcctgaggggaagttagaaaccaaggcgggtcaccctccagcagtgaaagcaggcggaatgcgcatcgtgcagaaacatccgcacaccggggacacgaaggaagaaaaagacaaggatgaccaggaatgggagtccccgtcccccccaaagcccaccgtctttatttcaggggtcatcgcaagaggagacaaagattttccgcctgccgcagcacaggtagctcatcagaagcctcacgcatctatggacaaacatcccagcccccggacacagcacattcagcagccacgaaagtag

SEQ ID NO: 24665 - DNA, 2274 bp, Artificial Sequence
  Description of Artificial Sequence: Synthetic coding sequence
ctcgctaagaagatcaccttgaagaagaagcttgaggaagaggaggccgaagtaaagagaaaggccacggacgccgcataccaggccagacaagccgttaaaacaccccctaggcggttgcctacagttatggtgcggagcccaatcgattcggctagtcctggtggggattaccctcttggagacctcactccaaccacaatggaagaagcaaccagcggggtgactcccggaactttgcccagtaccccagttacctctttcccaggcattccagacaccctcccaccgggtagtgccccccttgaagcgcccatgacccctgtgactgacgactcaccacagaagaagatgctggggcagaaggccacccctccaccttccccactgctgagcgagctgttgaaaaaggggagcctgctgcccaccagcccacggttggtcaacgagtctgaaatggccgtagcctcgggtcacctcaacagtactggtgtcttgctggaggtaggcggcgtgctccctatgatccacggaggggaaatccagcagaccccaaatacagtggccgcctctcccgccgctagtgagtccgtgagccaggcgaccatcgtcatgatgccagcattgcccgctcccagtagtgctcccgccgtgagcacaacagagtctgtggcgcctgtgagccagccggacaactgtgtccctatggaggcggtgggcgatccgcacactgtcaccgtatctatggactcatctgaaatctccatgatcatcaacagtatcaaagaagagtgttttcgctctggcgtcgcagaggctcctgtgggctctaaggctcctagtattgacgggaaagaggagctggatctggcagagaagatggatatcgctgtttcatacactggggaggaactcgatttcgaaactgtgggagacattattgccatcatagaagacaaggtggatgatcacccagaagtgctggatgtggccgctgtcgaggccgccctgagcttctgtgaggagaatgatgatcctcagagcctgcctgggccatgggaacaccccatccagcaggaaagagataagcccgtccccctgcccgctccagagatgaccgtgaaacaggaacggctcgactttgaagaaaccgagaataagggtattcacgaactggtcgatatcagggaaccttccgcggagatcaaggtggaaccagcagaaccggaaccggtgatttccggcgctgagattgtggccggcgtggtgccggctacttctatggaaccccctgaacttcgctcacaggatctggatgaggagctggggtctaccgccgccggtgagatcgttgaggcagacgtggctatcggtaagggagacgagaccccactgacaaacgtgaagacggaggcaagtcctgagagtatgctgagcccctcccatggctctaacccgattgaagatccgctagaggccgaaacccagcacaaattcgagatgagcgacagcttgaaagaggaatctgggactattttcggatctcagattaaagacgcccccggtgaggacgaagaggaggacggagtttctgaggctgcctccctagaggaaccaaaggaggaagaccagggagaaggatatctgagcgagatggacaacgagcccccagtcagcgaaagtgatgatggcttctcgatacataatgctacgctgcagtctcatacactggctgacagcattccttccagtcccgcctctagtcagttcagtgtgtgcagcgaagaccaggaagcgatccaggctcagaagatctggaagaaagccattatgctggtgtggcgagcggcagccaatcatagatatgccaacgtgttcttgcaacctgtaacagacgacattgctccagggtatcacagcattgtgcagagacccatggacttgtccacaattaagaaaaacattgagaatggcctgatcaggagcaccgccgaatttcaaagagatattatgcttatgttccaaaacgcagtgatgtataatagcagcgatcatgacgtataccacatggccgtggagatgcagagagacgtcctggaacagatacagcaatttctcgcaactcaactcatcatgcagacaagtgaatccggaatcagcgctaaaagtctgcgaggtagggattccacaagaaaacaggacgcttctgaaaaggacggaggtacacgaggtaggcggtgtgccatagaagccgatatgaaaatgaagaagtag

SEQ ID NO: 24666 - DNA, 3708 bp, Artificial Sequence
  Description of Artificial Sequence: Synthetic coding sequence
atggctacagggactggaaagcataaactcctcagtactgggcctactgaaccttggtctatccgcgagaaactctgcttggcttcctcagtgatgagaagtggggaccaaaactgggttagtgtgtcgcgcgcgattaaaccttttgctgagccaggacgccctcccgattggttcagccagaaacattgcgcctctcagtatagcgaacttctggagaccacggagactcccaagagaaaacgaggtgagaaaggagaggttgttgagaccgtagaagatgttatcgtaaggaaactgactgccgaaagggtcgaggagctgaaaaaagtcattaaagagacacaagagagataccggagattaaagagggatgccgaactaatccaggcagggcatatggatagcaggctggacgaactctgcaatgacattgcgacgaagaaaaagctggaggaggaggaggcggaggttaaacggaaagccaccgatgctgcttatcaggcgcgccaagccgtcaagacccccccccgcaggttaccaacagttatggtgcgatcacctatcgattccgcctcaccaggtggcgattatccactcggagatctgaccccaaccacgatggaagaggctacgtccggggtcaatgagtccgagatggccgttgcgtccggacacctaaattctaccggggtactgctggaggtcggtggagtgttacctatgatccatggcggcgagattcaacaaactcccaatacagtagctgcttccccagctgcgtccggagcgccaactctttcccggctgctggaagcaggaccgacgcaattcacgacacccctggcaagctttacaaccgtagctagcgagcctcccgtgaaactggtccccccaccagtggagagcgtatctcaggccactatcgtgatgatgcctgcactgcctgcgccaagcagtgcaccagctgtaagtacaactgaatcagtggctcctgtctcgcagcctgacaattgcgtgcctatggaagccgtgggtgaccctcacaccgtgactgtttccatggactcatctgaaatctccatgattatcaattctataaaggaagaatgcttccgaagcggggttgctgaagccccagtaggaagcaaagctcccagcatagacggcaaggaggagctggatctagccgagaagatggatatcgcggtcagctacactggcgaagaacttgacttcgaaaccgttggggatattattgctattatcgaggataaggtggatgatcaccctgaggtactcgacgtagctgcggtggaagcggccctaagcttttgtgaggagaacgatgaccctcaaagtctgcccggaccctgggagcaccccattcagcaggagcgtgacaagccggtgccacttcctgccccggagatgacagtcaaacaagagcggctggattttgaagagaccgaaaacaaaggaatccatgaattagtcgacatcagagaaccctccgctgagattaaggtggagcccgccgagcctgaaccagttatttcgggggccgagattgtggctggtgtggtccccgccacctccatggaaccccctgagcttcgcagccaggatctggatgaggagctcggaagtacagctgcaggggagattgtggaggccgacgtagcaatcgggaagggagatgaaactcctctcacaaacgtgaaaacagaagcgtcaccggaaagtatgctttcccctagccacggttcaaatccgattgaagatcccttggaagcagaaacccaacacaagtttgaaatgtctgatagtcttaaggaagagtccgggaccatcttcggatcccaaattaaagatgcgcctggcgaggacgaggaagaggacggagtgagcgaagccgcaagccttgaagagccgaaggaagaggaccaaggcgaagggtatttgtctgaaatggacaacgagccccccgtgtcagagtcggacgatggattctctatccacaatgccacgcttcagtctcacactctggctgattcaattccgtcctcccctgccagtagccagttcagcgtctgctctgaggatcaggaagcgattcaggcccagaaaatctggaagaaggcaatcatgttggtgtggcgtgcggctgcaaaccaccgctatgcaaatgtttttttacaacccgtcactgacgacatcgcccccggataccactctatagtgcagcggcccatggaccttagtaccattaagaaaaatattgaaaatggtctaatccgcagcacagccgaattccagcgggatatcatgctgatgttccaaaatgcggttatgtacaacagctccgatcacgatgtctaccacatggctgtggagatgcagcgagacgtcctggaacagattcaacagtttctggcaacccagctcatcatgcaaacgtccgaaagcggcattagtgccaaaagcctccgtggccgcgacagtaccagaaaacaggatgcctcagagaaagatagcgtcccaatggggtcccctgcgttccttctctccctgttcatgggccacgaatgggtgtggctagactccgagcaagatcatcccaacgactcggaattgagcaatgattgtcgttccctgttttcttcatgggatagctccctggaccttgatgtggggaactggagagaaaccgaagatccagaggcagaggagttagaagaaagctcacccgagcgcgagccttcggaacttcttgtgggtgatggcggcagtgaagagtcccaagaggctgcaagaaaggcatcccatcaaaatctactccacttcctctccgaagtggcatacctgatggagcctctgtgtatttcctccaacgagtcgagcgagggttgctgcccacccagcggaacgcgccaagaggggcgagaaatcaaggcttctgaaggggagcgcgagttgtgccgcgaaactgaggagctctcagctaagggagaccccctggtcgcggagaagccacttggagagaatggcaagcctgaggtggcctctgcaccgagcgtgatctgtactgtacagggtctgttaaccgaatccgaagaaggagaggcacaacaagaatctaaaggggaggatcagggagaagtctacgtctccgagatggaagaccagccgcccagcggtgagtgcgatgatgctttcaatatcaaggaaaccccccttgtcgacacactattttcccacgccacatccagtaaactgacagacctgtcccaggacgaccccgtccaggatcacctattatttaagaagacactcctgcctgtatggaaaatgattgccagtcatcggttttcgtctcctttcctgaagccggtgtccgagcgtcaggctccaggatataaggatgtggtcaagagaccaatggatcttactagcttaaaacgcaatttgtccaagggtaggattaggaccatggcccagttcctgcgcgatttgatgttaatgtttcagaatgccgtgatgtacaacgactcagaccaccatgtgtaccatatggctgtcgaaatgagacaagaggtactggaacagatccaggtcctgaacatatggcttgataaaaggaaaggctcaagcagcctcgagggggagcccgctaaccccgtagacgatggaaagcctgtcttttag

SEQ ID NO: 24667 - DNA, 2601 bp, Artificial Sequence
  Description of Artificial Sequence: Synthetic coding sequence
atggctacagggacgggaaaacataagcttctgtcaactgggccaaccgaaccatggtccatcagggagaagctctgcctggcttcaagtgtgatgcggtccggagatcaaaactgggtaagtgtgagtcgggctataaaacctttcgccgagcctgggcggcctcccgactggttcagtcagaaacattgtgcaagccaatacagcgagcttctggaaaccactgagacacccaagcgcaagcgcggggagaaaggcgaagtggtggaaacagtagaggacgtgattgtgagaaagctcactgcggagcgcgttgaagaactgaaaaaagtcataaaggagacccaggaacgctacagaaggctcaaaagggatgcggagctgatccaggctgggcacatggacagtcggctggacgagctgtgcaatgacatagcaacaaagaaaaaacttgaagaagaagaagctgaggttaagagaaaggccacagatgccgcatatcaggcccgacaagctgtgaagacccccccccgccggctgccaacagtaatggtgagatcaccaatcgacagtgcctctccaggtggagactacccactcggagatcttaccccgactaccatggaggaagcgacatccggtgtaactccaggaacactgccatccactcctgtgacaagctttccaggtatccctgatacactcccgccggggtccgctcccttagaagcgcctatgacacccgtgacggacgatagcccccagaagaagatgttaggacaaaaggccactcctccaccaagcccccttcttagcgagcttctgaaaaagggttccctgctgccgaccagccctcggctggtcaacgagagtgaaatggccgtggcgtctgggcacctgaactccaccggtgtgctgctcgaggttggcggagttctacctatgatacacggaggggaaattcagcaaacacccaatactgtggctgcaagtcccgctgcaagtgtgtcccagcctgacaattgcgttccgatggaagcagtaggcgacccccacactgtgaccgtgtccatggactcttctgagatcagcatgatcattaactcaatcaaggaagaatgcttcagatccggagtggccgaagcaccggtgggctctaaggccccaagcatcgacggtaaagaagaactcgatctggcggagaaaatggatatcgctgtgtcctacaccggtgaggaactggacttcgaaacagtgggagatattatcgccattattgaggataaggtcgatgaccatcctgaagtgctcgatgtcgccgcagtcgaggcagcattgtccttctgtgaggagaacgatgatccacaaagcctcccagggccgtgggaacacccaattcagcaagagcgcgataagcccgtgccacttcccgcccctgagatgacagtgaaacaggagcgcctggattttgaggagacagaaaataaagggatccatgaactggtggacattcgtgagccttcagccgagatcaaggtggagccagctgaaccagaaccagttattagcggcgcggagatagtcgctggcgtggtgcccgctaccagcatggagcctccagagctgcgatcccaagatctggatgaggaattggggagcaccgccgcaggagaaatcgtagaagcggatgtggccatcggaaaaggagacgagacgcctctgactaacgttaaaactgaagctagccctgagtcaatgctttctccatcacatgggtccaatccaatcgaagatcccctggaggctgagacacagcacaaattcgaaatgagtgacagcctgaaagaagaatcaggtacaatctttggttcccagattaaagacgcaccgggggaggacgaagaggaggacggggtgagcgaggcggcctccctggaagaaccaaaggaagaagaccaaggcgaagggtacctatccgaaatggacaatgaacctccagtatcagagagcgatgacgggttcagtattcacaacgccaccctgcagagccacaccctcgccgactcgatccctagctcccccgcttcaagccagttctcggtctgttccgaagatcaggaggccatccaggcccagaagatctggaaaaaagccatcatgctggtttggcgggctgctgccaatcacaggtacgctaacgtcttcctgcagcccgtgaccgatgacattgcaccgggatatcactcaatcgttcaaaggccgatggatctcagcaccatcaagaagaacatagagaacggcctcatacggtccaccgcagaatttcagcgtgatattatgcttatgttccagaacgctgtgatgtacaacagcagcgaccacgacgtttaccacatggccgtggagatgcaacgcgatgtattagagcagatccaacagttcctcgccacccagcttattatgcaaacgtcagaaagcggaatatctgcaaagtcactcaggggccgagactccacccgtaagcaagacgctagtgaaaaggacggaggaacaagaggccgacgctgcgctatcgaggcagacatgaaaatgaagaagtag

SEQ ID NO: 24668 - DNA, 2586 bp, Artificial Sequence
  Description of Artificial Sequence: Synthetic coding sequence
ggcaaacataagctcctaagtacaggccctactgagccgtggtctattcgggagaaactgtgcctcgcctcctcagtaatgagaagcggtgaccaaaactgggtctctgtcagtcgggcaattaaaccctttgccgagccgggcagaccgccggattggttttcccagaagcactgcgctagccagtattctgagcttctcgaaaccacagagacaccgaaacgtaagcgtggcgaaaagggtgaagtcgtggaaactgtagaggacgttattgtcaggaaactgactgccgagagggtggaggagcttaaaaaggtcattaaggaaactcaggagcgttatcgacgtctaaagcgagatgccgaactcatccaagcagggcacatggacagtagactggatgaactgtgcaatgatatcgctaccaaaaaaaagctagaggaggaagaggcggaagtgaagaggaaagcaaccgatgcagcctatcaagctcgacaggctgtcaaaactccaccgagacgacttcctactgtcatggtgcgcagccccatagatagcgctagcccggggggagactatcctcttggcgatctaactccaaccaccatggaggaggccactagtggggtcactccaggcaccctgcccagtaccccggtgacctcctttccgggcattcccgacacgctgcctcctggaagcgccccacttgaagccccaatgactcccgtcacagatgattctcctcagaagaaaatgctgggacaaaaggccactccccccccttccccccttcttagtgaactactcaagaagggcagcctgctgccaacaagcccccgtctggtgaatgaaagcgaaatggcagtggcctccggacatctcaattcaaccggtgtgctgcttgaagtgggaggcgtgctgccaatgattcacggaggggagatccaacagacccccaacaccgttgccgcaagtcccgctgcctccgtttctcagcctgacaactgtgtgcctatggaggccgtgggcgatcctcatacagtaaccgtatccatggattcttcagagatctcaatgatcataaactctattaaggaggagtgtttcagaagtggggtcgctgaggcccctgtgggaagcaaggcgccaagtattgacggtaaggaggagcttgatctggcggagaagatggatatagccgtttcatacaccggggaagagctggatttcgagacggtcggggatattatcgccatcatcgaggataaggttgatgatcatcctgaggtgctggatgttgccgccgtggaggccgccctgtccttttgcgaagaaaacgatgatccacagtccctgccaggcccctgggaacatccaatccagcaggagcgcgacaaaccagttcccttgcctgcccctgaaatgactgtgaagcaggagaggctagatttcgaagagacggaaaacaagggtatccacgagttggtcgacatcagagaaccttcggcagagatcaaagtggaaccagcggagccagagccggtaatcagcggtgcagaaatcgtggcaggagtggtccccgccacctccatggaaccaccagagctgcggagtcaggacctggacgaagaattgggatctacggccgctggagagatagtggaagccgacgtggctatcgggaagggggatgagacccccctgaccaacgtgaagacagaggcgtccccagagtcaatgctgtctccttcacacggcagtaaccccatcgaggatccgctcgaggccgaaacccagcataaattcgagatgtcggatagtctgaaggaggagagtggcacgattttcgggtctcagatcaaggacgcccctggcgaggatgaggaggaggacggagtctcagaagcggcatctctggaggagcccaaggaagaggatcaaggggagggctatctttccgagatggataatgaacctcctgtgtctgagagcgatgatggctttagtatccataatgcgaccttacagagccacactctggccgattcaatcccctctagtcctgctagtagccagttctcagtatgtagtgaggatcaggaggcaatacaggcccagaaaatttggaagaaggccattatgcttgtgtggagagcagccgcaaaccatcgatatgcaaacgtcttcttgcagcccgtgaccgacgacatcgcccctggatatcattccatagtacagcgccccatggacctaagcactattaaaaaaaatattgagaacggtttgatacggagtactgctgaatttcagagggacatcatgctgatgtttcagaacgcagtgatgtataactctagcgaccatgacgtctaccacatggccgtggaaatgcaaagagacgtattggaacagattcaacagttcctcgccacccagctgattatgcaaacttctgagagcggaattagcgccaaaagcttgcgcggacgtgacagtacacggaaacaggatgcaagcgaaaaggacggagggacccgaggaaggagatgtgctatcgaggcagacatgaagatgaaaaagtag

SEQ ID NO: 24669 - DNA, 2679 bp, Artificial Sequence
  Description of Artificial Sequence: Synthetic coding sequence
ggcaagcacaaattgcttagtaccggaccaaccgagccctggtcaatccgtgagaagttatgtctcgcctcaagcgtgatgcggtctggagatcaaaactgggtgagcgtcagccgagctataaaaccttttgcagagccggggagacctccggattggttctcccagaagcactgcgcctcgcagtattctgaactattggagaccacagagacacccaaacgtaagcggggcgagaagggggaggtcgtggaaacagtggaagacgtgatagttcgcaaattgacagcagagcgagttgaggaattgaagaaggtgatcaaggagacacaggagcgatacaggcgcctgaaaagggacgctgagctgatccaagccggacatatggactcacggctggacgagttatgtaatgacattgcaactaagaagaagctggaggaggaagaagccgaagtcaaacgaaaggctactgacgccgcttaccaagccaggcaggccgtgaagactccaccaagacggttgccaaccgtcatggttagaagcccaatcgactcagcctctccaggtggagactatccactgggcgatctcacaccaactacgatggaggaggcaacatctggtgttaccccaggtactctcccatctactcccgttacgagtttccctggtattccggataccctgcctcccggctcggcgccgctcgaggcacctatgacccccgtgaccgatgacagcccccaaaaaaaaatgctgggccagaaggcaacacccccaccctctccactgctgtcagagttacttaaaaagggatcgcttttgcccacctcaccccggctggttaatgagagcgagatggccgttgcgagcgggcacttgaactcaactggagttttgctggaagtgggaggtgtgttgccaatgatccatggcggcgaaatacagcaaaccccaaacaccgtggcggcatccccagcagcgagtgagtctgtctcccaggctaccattgtgatgatgccagcacttcctgctccatcatcagcacctgccgtgagtaccacagagagcgtggcaccagtgtcccagccagataactgcgtgcctatggaagctgtcggggatcctcacacagtaactgtgtccatggatagcagtgaaatttccatgattattaattccatcaaagaagagtgttttaggtctggcgtggcagaggctcctgtgggctccaaagctcctagtattgacggaaaggaggaactggatcttgcggaaaagatggacatcgccgtgtcatataccggcgaagaactggacttcgagacagttggagatattatagcgatcatagaagacaaagtcgatgatcacccggaggtgctggacgtggctgccgtagaggctgcattgtccttctgcgaggagaacgatgacccacagtctctcccagggccctgggagcaccccatccagcaggaacgggacaaacccgtgcctctgccagcccccgagatgacagtgaaacaagagaggcttgatttcgaggaaacagaaaataagggcatccatgagttagtagatatcagagagccaagtgccgagatcaaggtcgaaccagcagagcctgaacccgtgatctcgggtgcagaaatcgtggccggggtggtcccggctacaagcatggaaccgcctgagctgagatcgcaagatttggacgaggagttaggtagtactgctgctggcgagattgtggaggccgacgtcgcaattggtaagggggacgagacgccgcttactaatgtaaagaccgaggcctcccccgaatcgatgcttagcccctcacacgggtccaatcctatcgaggacccactcgaggcagaaacgcagcacaagtttgagatgtccgatagtctgaaagaggagtccgggaccatctttggtagccagatcaaggatgcaccaggcgaggacgaggaggaggacggcgtgtctgaagccgcgtccctggaagaacctaaggaagaagatcaaggtgagggatatctgtcagagatggacaacgagccccccgtgagcgaatctgatgatggattctctatccataatgctactttgcagagccatacactggcagattcgattcccagcagccccgctagtagtcagttctccgtgtgctccgaagaccaagaagccatacaggcccagaaaatctggaagaaggctattatgctggtgtggcgggctgcagcaaaccaccgttacgccaacgtttttctacagccagtgactgacgatatcgctcccgggtaccacagcattgtgcagcgccctatggatctgagcaccatcaagaagaatatcgagaacggcctcatccggtctaccgcagagttccagagagacattatgctcatgttccagaatgcagttatgtataactcctccgaccacgatgtttaccacatggccgtggagatgcagcgggacgtactggagcaaattcaacagttccttgccacccagctgattatgcaaacatctgagagcggaatatccgcaaaaagtctgagaggcagagactccaccagaaaacaggacgcatcagaaaaggacggggggactcgcggacgcaggtgcgcaatcgaagctgatatgaagatgaaaaaatag

SEQ ID NO: 24670 - DNA, 2514 bp, Artificial Sequence
  Description of Artificial Sequence: Synthetic coding sequence
atggtgcatccccgcgaggctatgttctctattttctgtcatgagaagtggcggtccaagctccattgtgcatcccagtacagcgaactattggaaactactgaaactcccaagcgaaagaggggggaaaagggggaagtagtggagacagtggaagacgtcattgtcagaaagctaacagctgagagggtggaagagttgaagaaggtcattaaggagacacaagaaaggtaccgacgactaaaaagagacgcagagttgattcaggctggacatatggatagtcgcctcgatgaactctgtaacgatatcgccactaaaaaaaaattagaggaggaggaggccgaagtgaaacgaaaggccacggacgcggcctatcaggcccgtcaggctgttaaaaccccacctaggcgccttccgactgttatggtccgctctccgatagactctgcaagtcccgggggcgattatccgctgggagatctgaccccaacaactatggaggaggctacttcaggggttaatgagtccgagatggctgtcgcttcggggcacctcaattcgacaggagtcctgctcgaagttggtggcgtgctgccaatgattcacggaggggagattcaacaaacacctaacaccgtggctgccagccctgctgcgtctggggctcctaccctgagtcggctgttagaagcgggacccacccagtttaccaccccactcgcttcctttaccacagtggccagtgagccacctgttaagctggtgccccccccagtggagagcgttagccaagctaccatcgtgatgatgccagcccttcctgccccatcctccgcgcccgctgtctcgaccactgaatctgtagctcctgtgtcgcagcctgacaactgtgtgcctatggaagctgttggggatccccacacggtgacagttagtatggattccagcgagatcagcatgatcatcaattccattaaggaggaatgcttcaggtccggcgtcgctgaagcgcccgttggctcgaaggccccctctatcgatggcaaagaagagctcgatctcgccgagaagatggacatagccgtcagttatactggtgaggaattggatttcgagacagtgggcgatataatagcaatcattgaagataaggtggacgaccacccggaagtcttggatgtagccgctgtagaagcggctctctcattctgtgaagagaatgatgatcctcagtctttaccaggcccttgggaacacccaattcaacaggaaagagataagcccgttcccttacccgctccagaaatgacagttaaacaggaacgcctagactttgaggagaccgagaacaagggcatccatgaactcgtcgatataagagaaccttcagcagagattaaagtagagcccgctgagcccgagcccgtgatttccggcgcagagattgttgccggggttgttcccgccacatcaatggagccgcctgaactccgctcccaggatctcgacgaggagttaggtagtaccgcagcgggcgagattgtggaggctgatgttgcaattggcaagggggacgagactcccctgacaaacgtaaaaactgaggcatctcctgagtccatgctgagtccttcccatggaagtaaccccatcgaggaccctctggaggccgagacacagcacaaattcgaaatgagcgactcgctgaaggaagagtctggaactattttcgggtcccaaataaaagacgccccaggcgaggatgaagaagaagatggagttagcgaagcagcgtctctagaagaacccaaagaagaagatcagggcgaaggatatctgtcagagatggacaatgagccacctgtttcagagtctgacgacggattttccattcataacgctacgctgcagagtcacacactcgccgactccatccctagctcacctgcgtcttcacaattttccgtatgctctgaagaccaggaagccatccaggcgcagaagatctggaaaaaggctattatgctggtctggagagccgcggcaaaccatcgttacgcgaacgtttttctgcagcctgtcactgatgacattgcacccgggtaccatagcattgttcagaggccaatggatctgtccactatcaagaagaatattgagaatggcctaatccggtcaactgccgagtttcagagagacatcatgctcatgttccagaatgctgtgatgtataatagctctgatcacgacgtgtatcacatggcagtcgaaatgcaacgcgacgtgctggaacagatacagcaatttcttgcaacacagctgatcatgcagactagtgagtcgggcatctctgcaaagtctcttcgaggaagggatagcactcgaaaacaggatgcgtccgagaaagatagcgttccaatggggagtccagcctttctgttgtcactattcgatggaggaacaagagggcggcgatgtgccatcgaggccgacatgaagatgaaaaagtag

SEQ ID NO: 24671 - DNA, 3315 bp, Artificial Sequence
  Description of Artificial Sequence: Synthetic coding sequence
atggcacgtcggggaaagaagccggtcgtcagaactttggaagaccttactcttgattcaggctatgggggtgctgccgacagcgtgcgcagttcaaatctgagcttgtgttgctcggacagccaccctgcgtccccatacggaggctcttgctggcccccacttgcagatagtatgcactcccggcataacagtttcgatacagtgaacactgcccttgtagaggactcagagggtctagactgtgccgggcagcattgtagcaggctgctcccagatctcgacgaggttccatggacactacaggaactggaagctctgctattaaggtcccgagacccaagggcgggcccagccgtgcccggcgggctgcccaaagatgctttggcaaaactgtcaaccctggtgtcaagggctctggttcgcattgcgaaggaggcacagcggctcagcctgcgctttgccaagtgcactaagtacgagatccagagtgctatggagattgtgctgtcgtggggattggctgcccactgcacggccgccgctctggccgcactgtcactttataacatgtcatcggcaggtggcgatcgccttggccggggaaagtctgcacgctgtggattgaccttttctgtgggacgtgtgtataggtggatggtggatagccgcgtcgccctgcgtatacatgaacatgccgcaatatatctgacagcctgcatggagagcttattcagggacatctacagccgtgtggttgcttcaggcgtccccaggagttgtagcggacccggaagcgggtctggcagcgggcctggcccttcaagcgggcccggagcagctcccgctgcagacaaggagagagaagccccaggtggcggcgcggcctccggaggcgcatgctccgccgcaagcagtgcttccggcggctcttcctgttgcgcaccccctgctgcagctgcagcagccgtacccccagcagctgctgccaatcatcaccatcaccatcatcacgcccttcatgaggctccaaagtttaccgtcgaaacccttgagcacaccgtaaataatgactcagaaatctgggggctgctgcaaccatatcaacatcttatttgtgggaagaacgccagcggagtattgtgtctccccgattctctgaatcttcatagggacccccagcgttcaaataagcccggtgaactccccatgttctcacagtcagagctgaggaccatcgagcagagcctgctggccacccgcgtgggttccatcgctgaattgagtgacctagtgtctcgagcgatgcatcatctgcagcccctgaacgctaagcaccacgggaatggtacccctctccaccataagcagggggccctttattgggagcccgaagcgctgtacactctctgctactttatgcactgcccgcaaatggagtgggaaaaccccaacgttgaaccaagcaaggtcaacctccaggtagaacgcccatttctggtgctcccccctctaatggagtggatccgtgtggctgtggcccacgccggccacaggcgcagctttagcatggactccgacgacgttcgacaggcagccaggctgttactccctggcgtggattgtgaaccccggcagttgagggccgatgactgtttctgcgcaagccggaagctggacgccgtcgcgattgaagcaaagtttaagcaggatctcggattcaggatgcttaattgtgggcggacggatcttgtgaagcaagcagtgagcctccttggaccagacggaataaacactatgagcgaacagggaatgacccctctgatgtatgcatgcgtgaggggcgacgaagccatggtccagatgctgctggatgctggcgctgacctgaatgtggaagtcgtaagcacaccacacaagtacccatcagtgcaccctgaaacccgacattggacggctctgacattcgcagtgttgcacggacatatcccggtggttcagctactgttggatgccggagcaaaggtcgaaggctcagtggaacatggcgaggaaaactattctgagaccccactgcagttggctgccgcagtgggtaacttcgagcttgtatctcttctgctcgagaggggagctgaccctctgataggaactatgtatcgcaacggtattagcaccacaccccagggggatatgaattctttctcccaggctgcagctcacgggcacaggaacgtgtttagaaaactcctggcccagccggagaaagagaagagcgatattctgtctcttgaagagatcttggccgaaggcactgatctggccgaaactgccccaccgccgctttgtgcctctaggaacagtaaggccaaactccgggcacttcgtgaggcgatgtaccattcggcagagcatgggtacgtggacgtgactatagatattcgctcgataggggtcccctggaccctgcacacctggttagaaagccttcgcatcgcttttcagcaacatagaagaccgttaatacagtgccttctcaaagagtttaagacgattcaggaagaagagtatactgaagaactggttacgcaaggccttccactgatgtttgaaatcctcaaagccagcaaaaacgaggtaataagtcagcagctgtgcgtaatcttcacccattgctatggaccataccccattccaaagttaaccgaaattaagcggaagcagacttcgcggcttgacccccacttcctcaataacaaagagatgtcagatgtgacctttcttgtagagggccgccccttctacgcacacaaggttctgttattcactgcatctccccggtttaaagccctcttgtcatcgaagccaaccaacgacggaacatgtatcgaaatcggatacgtgaaatatagcatcttccagttggtgatgcagtacttatattatggagggcccgagagtttgttgatcaaaaacaacgaaatcatggaattgttaagcgctgcaaaattctttcaattggaagcactccagcgtcactgtgagatcatttgcgctaagagcataaatacagacaactgcgtggatatttataatcacgcgaaattcctgggggtcaccgagctatctgcttattgcgaaggctattttctcaaaaatatgatggtcctgattgagaatgaagccttcaagcagcttctgtatgacaagaatggggagggtacaggccaggacgtcctgcaggacctgcagcgcacccttgccatcagaattcagagcatccacctgtcctcttccaaaggttccgtcgtctag

SEQ ID NO: 24672 - DNA, 1926 bp, Artificial Sequence
  Description of Artificial Sequence: Synthetic coding sequence
atgcgtaagttaagaccgaaagatagtcgagaaccggcgcctggctcccccgtcagaagtggatgcctacaacgactctcacactacagcgggattcagcgcccgtttctggtactccctccactgatggaatggatacgggtggccgtggcccacgcggggcatcggaggtccttcagcatggactccgacgatgtccgacaggcagctcgccttctcttaccaggagtggactgcgagcctagacagctccgtgcagatgactgtttctgcgcttccagaaaactagatgctgtggccattgaggccaagttcaagcaggatttggggttccgtatgttaaattgtggacgaaccgacctggtgaagcaggctgtcagcttgttaggtcctgatgggattaacaccatgtcagagcagggtatgacaccactgatgtatgcgtgtgtgcggggggacgaggccatggtccagatgctgttggacgccggtgctgacctgaacgtggaggttgtctcaacccctcacaaatacccttccgtccaccccgaaaccagacactggactgcccttacattcgccgtgctgcacggccacattcctgtggttcagctcctgctggatgccggcgctaaggttgagggttccgttgaacacggggaggaaaattactccgaaactcccctccaacttgccgcagccgtgggcaacttcgagcttgtatcccttttgctggaacggggagccgatcctcttattggcactatgtaccgtaatgggatttcaactactccgcagggagatatgaattctttctctcaagcagcggcccacggacatagaaacgtattccgaaaacttttggcccaacctgaaaaggagaagagtgatatattgtccttagaagaaatcttggccgagggtacagacctcgctgagaccgcgccacctccactctgtgccagccgaaatagcaaagcgaaactgcgggctctgcgtgaagccatgtatcacagtgctgaacacgggtacgttgacgtaacaattgacatcaggtccattggcgtgccctggacacttcatacatggctggagtctctcagaatcgcgtttcaacagcaccgccgcccccttatccagtgtttgctgaaagagttcaagacaattcaagaagaggaatacaccgaggaactggtcactcagggtttgccactgatgtttgagatcttaaaggcttcaaaaaatgaagtaatcagccagcagctgtgcgttatctttacccactgctacggcccctaccctatacccaaacttacagagataaaaaggaaacagacctcgcgcctggacccacattttctcaacaacaaagagatgtccgatgttacctttttggtggaaggtagaccgttctacgcgcataaggtgctgcttttcacagcctcaccacggttcaaggccctcctctcaagtaaacctacgaacgatggaacatgtatcgaaattggctacgtcaaatactctatcttccagctggtcatgcagtacttgtactatggcgggccagagtccctcctgatcaaaaacaacgagattatggaactcctgtctgcagccaagtttttccaactggaagccctgcaaaggcattgtgagattatctgtgcgaagtctatcaacaccgacaactgtgtcgacatttataatcacgccaagttcctcggtgtcaccgaactgtccgcctattgtgagggctacttcctgaagaatatgatggttctcatagagaatgaggcttttaaacaactcttgtatgacaaaaacggcgaaggtaccggacaagatgtcctgcaggatttgcaacgaacccttgctatccgtattcagtccatccatctgtcatcctcaaagggaagcgtagtttag

SEQ ID NO: 24673 - DNA, 2958 bp, Artificial Sequence
  Description of Artificial Sequence: Synthetic coding sequence
atggccaggagagggaaaaaacctgtggtaagaacgctcgaagatctgactctagactctgggtacggcggagccgctgactctgtgcgcagctccaatctgtccttatgttgcagcgattcacaccctgcttccccttacggaggatcttgctggcctccactcgctgattcgatgcactcccgtcacaactcattcgacacagttaacacagccctggtcgaagatagcgagggattggactgcgcaggacagcactgttccaggctactcccagacctcgatgaggtgccttggactctgcaggagctagaggcgctgttgctccggtcccgagatcccagagcggggccagccgtacctggtggactgccaaaagatgcccttgccaagctgagtacactggtatcacgggccttggttaggatagcaaaggaagcccagagactatctctgaggtttgctaaatgtactaagtacgagatccaaagtgccatggaaatcgtgctgtcatggggcttggccgcacactgtacagccgcagcgctggctgcactgtccctctacaatatgagctccgctgggggtgaccgacttggccgcgggaaaagtgcgcgctgtggtcttaccttctctgtcgggcgcgtttataggtggatggtcgacagccgcgtggcgctcagaattcacgaacatgcggccatctacctcaccgcctgcatggagtctctgttcagagatatttatagccgcgtggtggcatccggcgtgcctcgtagctgcagcgggccaggatctggctccggctccgggcccggcccatcttccgggccgggagccgcgcctgcagccgacaaggaacgcgaggcaccgggtgggggcgccgcgagcggaggtgcctgcagcgccgcctctagcgccagcggaggtagttcatgctgtgcaccccctgcagccgcagccgccgccgttcctcctgccgctgcagctaatcaccaccaccatcaccaccatgcactgcatgaggctccaaagttcacagttgagacccttgagcacaccgtgaataatgattccgagatctggggcctgcttcagccctatcagcacttaatttgcggtaaaaatgcaagtggtgtgctttgtctcccggattcgctgaatttgcacagggaccctcagaggtccaataaacctggtgagcttcctatgtttagccagagtgaattgcggaccatcgagcagtccctcctggcaacacgcgtgggtagcattgccgagctgagtgacctcgtgtcaagagctatgcaccatctgcaacctcttaatgcaaagcaccacgggaacggcacacctctgcatcacaaacagggtgccctttactgggagccagaggcgctttatacgctttgctattttatgcattgtccgcaaatggaatgggagaatcctaatgttgagccgagtaaggttaacctgcaagttgaaagaccgtttctggttctgcctccgctcatggagtggatcagggtggccgttgcacatgcaggtcacagaaggtctttctccatggatagtgacgatgtgaggcaggcggctaggcttcttctgcccggtgtggattgcgaaccacggcagctccgcgcagacgactgtttctgtgcaagtaggaaactcgatgctgtcgccattgaggcgaaatttaaacaggatctgggcttcagaatgctgaactgtggcagaaccgacctagttaagcaggctgtttccctcctgggtccagatggtataaatacaatgtctgagcagggcatgacacccttaatgtacgcttgcgtccgtggtgacgaagccatggtgcagatgctattggatgctggtgcagatctaaatgttgaggttgtgagtaccccacacaagtacccctcggtgcatcccgaaacccggcactggactgcattaacttttgccgtgttacatggccatatccccgtggtgcagctcctcctcgacgcaggggctaaagtggagggctcagtggagcacggggaggaaaattactcggagacccctttacagctagcagctgccgtgggggtgccatggacattgcacacctggttggagagcctgaggattgccttccagcagcatcggaggcctctgattcagtgcctccttaaggaattcaaaacgatccaggaggaggagtacacagaggagctggtgacccagggactacccctgatgttcgaaattctgaaggccagcaagaacgaggtcatttcccagcaactgtgtgtgatctttacacattgttacggcccatacccgatcccaaaactaacagaaatcaagcgaaaacagacctccagactagaccctcattttctcaacaacaaagagatgagcgatgtcacattcctcgtggagggcagacctttctacgcgcacaaagtgttgttatttacagccagcccgcgcttcaaggctttgttgtcctccaagccaactaacgatggcacttgtattgagatcggctacgtgaaatatagcatctttcagctggtgatgcagtacctgtactacgggggacctgagtccttgctaattaagaataatgaaatcatggagctcctgagcgccgccaagttctttcagttggaagcactgcagcggcactgtgagattatctgcgcaaaatccatcaatactgacaattgtgtagacatttataatcatgccaagtttctgggcgtgacggaattgtccgcctactgtgaggggtatttccttaaaaatatgatggttctgatcgaaaatgaggcttttaagcagctgctgtatgacaagaatggcgagggcaccgggcaggatgtcttgcaggatttgcaacgaacactggctatcaggattcaaagcatacacttgagttcttctaaagggtccgtcgtgtag

SEQ ID NO: 24674 - DNA, 3024 bp, Artificial Sequence
  Description of Artificial Sequence: Synthetic coding sequence
atggcacgccgcggcaaaaagccagttgtcagaactctcgaagacttgaccttagattctggctatgggggagccgcagactcagtccggagttcaaatcttagcctatgttgttcggactctcatccagcgtccccctatggcgggagttgctggccacccttggccgactcaatgcactcacggcacaactcatttgacactgtgaacacagccctcgttgaagactcagaaggtctggattgtgccggacagcactgttccaggcttcttcctgatctagatgaagtgccctggacactccaggaactcgaagctctgttacttagatccagagaccccagggcagggcctgctgtgcctggtggactccccaaggacgcgttggcaaagctttccacactggtgtccagggccttggtgagaatcgctaaagaggctcagcggctctcactgcgcttcgccaagtgcacgaaatatgagattcaaagtgccatggagattgtgctctcatggggccttgccgctcactgcaccgccgctgcactcgctgctctgagtctgtataacatgagctcagctggtggggataggctggggcgcggaaaatcagcccgctgcgggctgaccttttcagttgggagagtctacagatggatggtagactcacgcgttgccctccgtattcacgagcacgccgccatatacttgactgcctgcatggagtccctcttccgggatatatacagcagagttgtggcctccggagtgcctaggtcatgtagcggtcctgggtcaggatccggctcaggccccggtccttcctcgggccctggtgccgctcctgctgccgataaggagcgagaagcaccgggcggtggagcagcctccggcggcgcttgttctgccgcctccagcgctagcggggggtccagctgctgcgcacctcccgcagccgcagcagcagcggtgccaccagctgctgccgctaatcaccaccaccaccaccaccatgctctgcacgaagccccgaagttcaccgtggaaaccctagagcacacagtgaataacgattccgagatctgggggctcctgcagccttaccaacacttgatttgcggcaagaacgcaagcggtgtactctgtctccctgactctctcaacctgcacagagatcctcagagatcaaataaacctggggagttgcctatgtttagccagtcggaacttcgtactatcgaacagtccctactggccaccagagtggggtctatcgccgaactgtccgatttggtttcacgtgcaatgcaccatttacaacctttgaatgccaagcatcatggaaacggcacacccctccatcataagcaaggcgcgctgtattgggaaccagaagctctgtacaccctctgctattttatgcattgtccccagatggagtgggaaaaccctaacgtggaaccaagtaaggtgaatctccaagtcgagcgcccttttttagtgctgccccccctgatggagtggattagggttgcggttgctcacgccggccataggcggtccttcagcatggacagcgacgatgtcagacaggccgccagactgctgttaccgggggtggattgcgagccacgtcaactgcgtgcggatgactgcttctgtgctagtcgaaagctggacgccgtggcaatcgaagctaagtttaaacaggatctgggctttcgcatgctgaactgtggaaggactgacctcgtcaaacaagctgtctccctgctcggtccagacggaattaacacaatgtccgagcaggggatgactcccctcatgtacgcctgcgtgcgaggtgacgaggctatggtgcagatgctgctcgatgctggcgctgacttaaatgtggaagtggtcagcaccccgcacaagtatccaagtgtgcaccctgaaacaagacattggacagcgctcaccttcgcagtcctgcacggccacatcccagtggttcagttgctactggacgccggggccaaagttgaaggtagcgttgaacacggggaagagaattacagcgaaaccccactccagctcgcggccgccgtgggcaacttcgagttggtgagcctccttctggaacgtggggccgatcctttgattggaactatgtatcgaaatgggatctcaaccaccccacaaggggacatgaatagttttagtcaggcagcagcacacggtcatcgcaatgtatttcggaagctgctcgcgcagccagaaaaagagaagtccgacatcctgtccctcgaggagatactggcggagggaaccgatctggctgagaccgccccaccaccactgtgcgcatcgcgaaactcaaaggctaaactgagggcactgcgggaggccatgtatcactctgccgagcacggatacgtcgacgttacaatcgatatcaggagtatcggggttccctggacacttcacacttggctcgagtcacttcgtatcgccttccaacaacatcgcaggcctctgatacagtgcctgcttaaggagttcaaaacaatccaggaagaagaatatactgaagagctggtcacgcagggacttcctttgatgtttgaaatcctgaaagcatccaaaaacgaagtcatcagtcagcagctgtgcgtgatttttacgcactgctacggcccctatcccattcctaaactcactgagattaaaagaaaacagacaagccgtttggatccccactttctgaacaataaggaaatgtctgacgttactttcctggttgaaggccggcccttttacgcacataaggtgttactctttacagcttctccgcggttcaaagccctactgagttctaagcctacgaatgatggcacctgtatcgagatcggctatgttaaatactccatcttccagttggtcatgcagtatttgtactacggagggcccgagagtttgctcatcaaaaataacgagattatggaagtgagggaccccttatggtgttggctgtcatag

SEQ ID NO: 24675 - DNA, 552 bp, Artificial Sequence
  Description of Artificial Sequence: Synthetic coding sequence
atgtccgatgtgacgttcttggtggaggggcggcccttttacgcccacaaagtgcttctgttcactgcttctccacgcttcaaagcactgcttagctccaaacctactaacgatggcacctgtatcgaaattggctacgtaaagtacagcatattccagttagttatgcaatacttgtactatgggggtcctgaaagcctgttgatcaagaacaatgaaatcatggaactgctgtctgctgccaagttttttcaactagaagcgctacagcgtcactgcgaaattatttgtgctaaatcaatcaacaccgacaactgcgtagacatttacaatcatgcaaaattcctcggagtaaccgagctgagcgcctactgtgagggctatttcctgaaaaatatgatggtattgatcgagaacgaggcctttaaacagctgctatatgataagaatggcgagggaaccgggcaggatgtcctccaagatctccagcgtaccctggccatcaggatacagtccatacacctgtcatccagtaagggcagtgttgtctag

SEQ ID NO: 24676 - DNA, 987 bp, Artificial Sequence
  Description of Artificial Sequence: Synthetic coding sequence
atgtgtcatcagcagctggtgatttcttggttttcactggtctttttagcctcgcccctggttgcaatttgggagcttaaaaaggacgtgtatgttgtggagctagattggtaccccgatgcccctggtgaaatggtcgtgctgacatgtgacacccctgaagaggacggcataacatggacgctggaccaatcaagtgaagtactagggtcaggcaagacattgacaatccaggtcaaggagtttggggatgctggacagtacacctgccacaaaggcggcgaggtcctaagccactcactgctgttgctccacaagaaggaggatggaatttggagcaccgatattcttaaggatcagaaagaaccgaagaacaaaacttttttgagatgtgaggcaaaaaactatagcggtagattcacctgctggtggttaacaaccatttcaactgacctgacattttccgtgaagagctcccgagggagttcagacccgcagggcgtcacctgcggcgccgccactctgtccgctgaacgagtccgcggggataataaggaatatgaatactcggtggaatgccaagaagacagcgcttgtcccgctgccgaggagtctcttcctatcgaagttatggtcgatgctgtgcataagctgaaatatgaaaattacacttcttcgttcttcatcagagatataattaagccagatcctcctaaaaatctccagctaaagccgctgaaaaatagccgccaggtggaagtgtcctgggagtatcccgatacttggagtaccccacattcctactttagtctcaccttttgtgtccaagtgcaagggaagagcaaacgggagaagaaagatcgcgtttttaccgacaagacatctgctacagtgatatgtcggaaaaatgctagcatcagcgtcagggcgcaggaccggtactattcctcaagctggtctgagtgggcatctgtgccctgctcgtag

SEQ ID NO: 24677 - DNA, 1503 bp, Artificial Sequence
  Description of Artificial Sequence: Synthetic coding sequence
atggcactcatgctgtctctggtccttagcctgctcaagttaggatcagggcagtggcaagtattcgggcccgataagcccgtgcaggccctggttggcgaagacgcagccttcagttgctttttgtcccctaaaactaacgcggaggcaatggaggtgagattttttaggggacagttctctagcgttgtacatctttacagggatggcaaggatcagcccttcatgcagatgccgcaatatcagggccgcaccaagttggttaaagacagcatagctgagggaaggatctcccttcgcttagaaaacatcaccgtactggacgcgggcctgtacgggtgcaggatatcttctcagtcttactatcaaaaagccatatgggagctgcaggtttctgccttaggtagcgttcccctgattagcattaccggatacgtggaccgggacatacaactcctttgtcagagtagcgggtggtttccaagacctacagctaaatggaagggaccccagggccaggatctgagtactgactctcgaaccaatcgcgatatgcatggtctcttcgatgtagagattagtctcaccgtccaggaaaacgctggaagtatttcctgctctatgagacatgctcatctttcgcgagaagtagagtcccgggtccagattggcgacactttctttgaacccatctcatggcacctggccactaaagtcctgggaattctgtgttgcggattgttctttggtatcgtgggactgaagatatttttctcaaaatttcagtggaaaatccaagccgaacttgactggagaaggaagcatggtcaagccgagctgagggatgcccgaaagcacgctgtggaggtcactttggatcccgaaacagcccacccaaagttatgtgtgtcggacctgaagactgtgacccatcggaaggccccacaagaagtccctcacagcgaaaaacgtttcactcgtaagtctgttgtggcctcccaatctttccaggccggcaagcattattgggaggtggatggaggacataataaaaggtggcgcgtgggagtttgtagggatgacgtagaccggcggaaggaatacgtgactctgtcaccggaccatggttattgggtcctgcggctcaatggcgaacacctgtatttcacgctcaatcctaggtttatatctgtgtttccccgcaccccacctaccaaaattggtgtgtttctggactacgagtgtgggaccatatcattcttcaatatcaacgatcaatctctgatctatactctcacttgccgctttgaaggactgctgagaccctacatcgagtacccttcctacaatgagcaaaacggcacccctatcgtgatatgtccagtcacccaggagtccgaaaaggaagcctcttggcagagggctagcgcaattcctgaaacgtccaatagcgaatctagttctcaggcaacgacgcccttcttacctcgaggggaaatgtag

SEQ ID NO: 24678 - DNA, 951 bp, Artificial Sequence
  Description of Artificial Sequence: Synthetic coding sequence
atgcacggcctgttcgacgttgagatatccctgaccgtacaagagaacgctggtagcattagctgtagcatgaggcatgctcacctgtctagggaggttgagtcaagagtgcagatcggggacacattctttgagcctatttcttggcatctggcaaccaaagtactcggtatactgtgttgcgggctgttcttcggtattgtgggtttgaagatcttcttcagtaaatttcagtggaagattcaggcagagctagattggagacgtaagcacggacaggcagagctgcgagacgcccggaaacacgccgtggaagtgaccctggacccggagactgcccatccaaaactttgcgttagcgatctgaagacagtgacacatcggaaggctccgcaagaggtgcctcattctgagaaacgctttacacgtaagagcgtggtggcctcccagtccttccaggcaggtaaacattactgggaagttgatggagggcacaacaagcgttggagagttggagtttgtagggacgacgttgacagacgaaaggagtacgtgacactctcccccgaccacggctattgggtgctgcgcctgaatggtgagcatctctattttaccctgaatcctcgtttcatcagcgtttttccacgcacaccaccgactaaaatcggcgtatttctggattatgagtgcggaaccatcagcttttttaatatcaatgatcagtcattaatttatactctcacttgccgcttcgaggggctactccggccttatattgagtatccatcatataacgagcagaatggtactcctattgtgatatgtcctgtgactcaagaatcggagaaggaggcgtcttggcagagggcttccgcaatccctgagacctccaacagcgagagcagcagtcaggcaactaccccattccttcctcgcggtgagatgtag

SEQ ID NO: 24679 - DNA, 1128 bp, Artificial Sequence
  Description of Artificial Sequence: Synthetic coding sequence
atgtggacttggttcgtcaaaagtctaggctctgtgccattgatatccatcactggctatgtcgaccgcgatattcagctgctgtgtcagtcctcaggctggttcccaagacccacagctaagtggaagggtccgcagggtcaggatctaagtaccgattcccggacaaatagggacatgcatggactcttcgatgtggagatctctttgaccgtacaggagaacgccggcagcatctcctgttcaatgaggcatgcacatctgagcagagaggtcgagtctagggtgcagataggagacaccttctttgagccaatatcatggcatctggcaactaaagtgctgggcatactttgttgtggcctgtttttcgggatcgtggggctcaagatttttttttccaagtttcagtggaaaatccaagcagagcttgattggcgccgaaaacatggccaagccgaactgcgagacgcacggaaacacgccgtggaagtgactctggacccggaaaccgcacaccctaagctgtgcgtctccgatcttaagaccgtcactcacagaaaagctccccaggaggttccacattcagaaaagaggttcacacggaagtcggtggttgccagtcagtctttccaggccggaaagcattattgggaggttgacggcggacataataagcgctggcgggttggcgtgtgtcgagacgacgtcgaccggcgaaaagagtatgtgaccctgtctccagatcacggctactgggtgctgaggctgaatggggagcacctgtatttcaccctaaacccccgcttcatctccgttttccccagaaccccacctactaagataggggtctttttggactacgagtgtggtacaatcagcttcttcaacatcaatgatcaatctctgatctatacactgacatgtagattcgagggccttctgagaccctatattgaatacccctcctacaatgaacaaaacgggactcccatcgtcatctgcccggtaacacaagaatccgaaaaggaagccagctggcagagggcatctgctattccagaaacctctaattccgaatctagctctcaggctacaacaccctttttgccccggggcgaaatgtag

SEQ ID NO: 24680 - DNA, 1023 bp, Artificial Sequence
  Description of Artificial Sequence: Synthetic coding sequence
atggcactgatgctgtctctggtcctgtcactcttgaagctgggctccgggcagtggcaggtttttggaccggataaacccgtccaggcactggtgggcgaagacgcagctttctcatgtttcctttctcctaaaacaaacgccgaagctatggaggtgcgatttttccgtggccagtttagctctgtggttcacttgtaccgtgacggcaaagatcagccctttatgcagatgcctcaataccaggggcgaacaaaattagtgaaggatagcattgcggagggtaggataagcttacgcctcgagaacatcacggtgctggatgccggtctgtacggttgtcggattagcagccagtcatactatcaaaaggccatatgggaactgcaggtgagcgcactgggttctgtgcctctgatcagcatcacaggttatgtggatcgcgatatccagctactgtgccagagctcaggatggtttccgagaccaaccgccaagtggaaaggaccccagggccaagatctgtctactgatagcaggactaacagggacatgcacgggctgtttgacgtagaaattagcctcacagtacaggagaacgccgggagcatttcctgctcgatgagacacgctcacctttctagagaggtcgagtcaagagtgcaaattggggatacattctttgagccaatctcgtggcacctcgccacaaaagttctgggaatcctgtgctgtggattgttttttggcattgtgggtctgaagatcttcttctccaaatttcagtgcaaacgggaacgagaagcatgggctggcgctctttttatggtcccagccggcacgggatccgagatgctgccccaccccgcagcgtcgttgcttctggtcctggcttctaggggtcccggtcctaagaaattggagaagaaggcccggaccggaagaattgaacggaggccagagacgagaagtgggggggatagcgggagcagggacggcagtccagaggcactcaggttttag

SEQ ID NO: 24681 - DNA, 1155 bp, Artificial Sequence
  Description of Artificial Sequence: Synthetic coding sequence
atggctctgatgctttcccttgtactttccctgctgaagctgggctcagccctcgggtcagtcccactaatctcaatcacgggatatgtggaccgcgacatacagctgctatgtcagagcagcggttggttcccccggcccactgccaagtggaaggggccccagggacaggacctgagcacggattcgcggaccaacagagatatgcatgggctgttcgacgtggagatttcgcttaccgtgcaggagaacgctggcagtatttcttgtagcatgagacacgcccatctctctcgggaggttgagagccgcgttcagatcggcgatactttctttgaacccatctcttggcatctagctactaaggtgttgggtattctgtgctgtggtctgttcttcggtatcgtcgggcttaaaatctttttttcaaaattccaatggaagatacaagctgaactagactggagacgtaaacacggacaggctgagctgcgcgatgcacggaaacatgcagtggaggtcacccttgacccggaaacagctcatcccaaactgtgcgttagcgacctcaagacagtgacacatcggaaagctccccaggaggtaccccattctgagaaacgtttcacaagaaaatctgttgttgccagccagtccttccaggcaggcaagcattactgggaggtcgatggtggccataacaagcgctggagagttggggtttgtcgggatgacgtagaccggcgaaaggagtacgtgaccctgtcgccagatcacggatactgggttttgcgcctgaatggggagcatttgtattttacactgaaccctagattcatcagtgtcttcccccgaactccacccacaaaaattggcgtgttcctggactacgaatgcggcactatcagtttctttaatataaatgaccagtctcttatctacaccctcacttgccgcttcgagggactgctgcgcccgtatattgagtatccttcttataacgaacaaaacggtacaccaatagtaatctgcccagttacccaggagagcgagaaggaagcctcttggcaacgagcatccgccatcccagagacgtctaatagtgaatcttcaagtcaggcaacaaccccctttctgcccaggggcgaaatgtag

SEQ ID NO: 24682 - DNA, 1608 bp, Artificial Sequence
  Description of Artificial Sequence: Synthetic coding sequence
atggtagatctaagtgtgtctcctgatagcctaaagcccgtttctttgacctcttccctggttttccttatgcacctgctcctccttcaacctggcgagccatccagcgaggtaaaggtcctgggtcctgagtatcctattctggctctcgtcggggaagaggttgagttcccctgccatctgtggccacagctggatgcccaacagatggaaatcaggtggttcagatctcagacatttaatgtggtgcatctttatcaagagcagcaggagctccccggtcgccagatgcccgccttcagaaatcggacgaagctggtgaaggacgacatcgcctacgggagcgtggttctacagctccattcaatcatacctagcgataagggcacctatggctgtcgattccattctgataacttcagcggcgaggctctttgggaactggaggtggcagggctcgggagtgaccctcatctctctctcgagggttttaaagagggcggaattcagctgagattaaggtcatctggatggtatcctaagcccaaagtccaatggagagaccaccaaggccaatgtctgccacccgaattcgaggctatcgtgtgggacgcgcaggaccttttctcactcgaaaccagcgtcgtggtgagggcgggagcgctgtctaatgtgagcgtgtctatccagaacttactgctttcccagaagaaggagttggtggtccagatcgctgacgtgtttgtccctggcgcgtctgcttggaaatctgctttcgtggcaacactccccctgcttctagtgctcgctgcactagccttaggagtgctccgcaagcagcgccgctcacgagaaaagttgcgtaagcaggcggaaaaacggcaggagaaattgacggccgagcttgagaagctacaaacagaattagactggcgtagggctgagggacaggccgaatggcgggccgcccaaaaatacgctgtcgacgtcactttggacccagcctctgcccaccccagtttggaggtgagtgaggacggcaagagcgtgtcttctagaggagcacctccaggacctgcccccggccaccctcagcgcttctccgagcagacatgcgctctgagcctagagcggttttcggctggccgtcactactgggaggtgcatgtggggaggcgatctcgatggttcctgggggcctgcctagcggccgtgccgagagcaggtccagctcgcctgagccctgctgccggatactgggtgctgggcttatggaatgggtgtgagtattttgtcctggcccctcatcgggtggcccttacactccgcgtccccccaagacgtctcggagtctttctggactacgaggccggcgagctgtcgttctttaatgtctccgacggctcacatatcttcactttccacgacacattttctggtgccttgtgtgcctatttcagaccaagagcccacgacgggggtgagcaccctgatccactgaccatctgcccgctccctgtgcgcggtacaggcgtgcccgaagaaaacgattccgatacgtggctccaaccgtacgagcctgctgaccctgctctcgattggtggtag

SEQ ID NO: 24683 - DNA, 1035 bp, Artificial Sequence
  Description of Artificial Sequence: Synthetic coding sequence
atggtcgatctgtcggtgtcccccgattctcttaagcctgtgtccctcacatctagcctcgtcttcttgatgcatctccttctgctccagccgggagagccctccagtgaggtgaaagtgctgggacctgaataccccatcttggcgctagtcggcgaggaagtcgagttcccttgccacttatggccccagcttgatgcccaacaaatggaaatacggtggttcagatcgcagactttcaacgtcgtccacctctaccaggagcagcaggagctgcctggaaggcagatgccagcgtttagaaatcgcaccaagctcgtaaaggacgatattgcgtatggtagtgttgtactgcagctccactcgatcatcccttcagacaagggcacctatggttgcaggttccattctgataacttttccggcgaagccctgtgggaactcgaagtggcaggactcggcagtgacccccacctatctcttgagggattcaaagagggcggaatacagttacgtctccggagttccggatggtatccaaaaccgaaagtgcagtggcgggatcatcagggacaatgtttgcctcccgagtttgaagccattgtttgggatgcccaggatctgtttagtcttgagacctcggtcgtggtccgcgcaggggcgctcagcaatgtatccgtgagcatccagaatcttcttctgagtcagaaaaaggagctagtggtccagatcgctgacgttttcgtgcctggcgcaagcgcgtggaaatctgcctttgtcgctaccctgcctctcctacttgtgcttgctgctctcgccctgggtgttctgcggaaacagcgccggtcccgggaaaaactacgaaagcaggctgaaaagcgtcaggaaaagctgaccgccgaattggaaaagcttcagacagaactcgactggaggagagcggaagggcaggccgagtgctttgtgcttgcctctcacccaccaggggaagggatccaggcggccagcaatagtacaaccactctcaatgcctag

SEQ ID NO: 24684 - DNA, 1611 bp, Artificial Sequence
  Description of Artificial Sequence: Synthetic coding sequence
atggtggacctatcagtatctcctgacagtttgaaaccagtgagcttaacctcatcactggtatttctaatgcatctactcctgctacagccaggagagcctagcagtgaggtgaaggtgcttggaccagaatatcccattctggcattagtcggcgaggaagtcgaattcccgtgccacttatggccacagctcgatgcccaacagatggaaatccggtggttccgaagccagactttcaatgtggtgcatctgtaccaggaacagcaggagctgcctggtcgccaaatgccggccttcagaaaccgcacaaagctggtcaaggatgacattgcgtatggatccgtggtgctgcagctacacagtatcatcccaagcgataagggcacctatgggtgtcggttccactcagacaacttctccggcgaagcgctgtgggagcttgaggtggccggtctgggatctgatccacatctctccctagagggatttaaggagggcggcatccagctccggttgaggagctcagggtggtacccaaaacccaaggtgcaatggcgagaccaccagggccaatgcttacctccggagttcgaggcaattgtctgggacgcgcaagacttattcagcctcgagacctcagtggtggtgcgggctggggccctctccaacgtgtccgttagtatccaaaacttgctcctgtctcaaaagaaggaactggtggtccagatagctgatgtctttgtccctggcgctagcgcttggaaatccgcttttgtagccactctgccgctgctactggtcctggccgccctggccttgggggtactgcggaagcaaaggcggtcccgtgaaaagctgcgcaagcaggctgaaaagagacaaggaactgaaaaaactgctcagctcccacctaatcaggtggcctcagattggcggagagcggaggggcaggccgagtggcgggctgcacagaagtacgccgtggatgtgacgctagatcctgcttctgcccatcctagtctcgaagtgagtgaggacgggaagagtgtgtcctctagaggagccccacctggacctgccccagggcatccccagcggtttagtgaacagacgtgtgcactcagcctcgagcgcttttcagccgggcgccattattgggaagtccatgttggtcgaagatccagatggttcctcggggcttgtttggctgctgtgcccagagcaggacctgcaaggttaagtcccgcagcagggtactgggtgctgggcctgtggaatgggtgcgagtattttgttctggcgccgcatagggttgccctcaccctcagggtccctccacggcgcctgggggttttcttggactatgaggctggggaactgtctttcttcaacgtttctgacggtagtcatatctttacattccacgacacctttagcggagccctctgcgcttatttcaggccacgggcccacgacggcggcgaacaccctgatcccctcacgatttgccctttgcctgtgcgcgggacaggagtgcccgaagaaaatgactctgatacttggctgcagccatatgaacctgctgatccagcccttgactggtggtag

SEQ ID NO: 24685 - DNA, 1035 bp, Artificial Sequence
  Description of Artificial Sequence: Synthetic coding sequence
atggtggatctttcggtctctcctgattctctgaaacccgtcagcctgacatcaagtctagtctttctgatgcacttacttctgctgcaacctggcgaaccctcaagtgaagtcaaggtgctgggacccgaatatcccattctcgctcttgtgggtgaagaggtagaatttccttgccacctgtggcctcaactggacgcacagcagatggaaataaggtggttcagatcacagacctttaatgttgtacacctctaccaagagcagcaggagttacctggcaggcagatgcccgcattccgcaacagaacaaagctggttaaagacgacatagcttacggatcagtcgtgctccagctgcattctattatcccatcggataaaggaacctacggctgccgatttcactccgataacttcagtggcgaggccctctgggagctggaagtcgcgggcctaggttccgatcctcatctcagcctggaaggcttcaaagagggcggtatccagctgcggctcaggtctagtggctggtaccccaagcccaaggtccagtggagggatcaccagggtcaatgcctgccccctgagttcgaagcaatcgtttgggatgcacaggacctattcagcttagagactagcgtagttgtgagagctggagccctgtcaaacgtgtctgtgagcatccaaaaccttctgttgtctcagaaaaaggaactggttgtgcagattgctgacgtctttgtgccaggggcaagcgcctggaaatcggcctttgtcgccacgcttccacttctccttgtgcttgcagcactggcacttggggtccttaggaaacagcggcggagccgagagaagttgagaaagcaggcggagaaacggcaggccagatacgacgctcaagccggccctcttctggtggcttctgattggagacgggccgaaggacaggcagagtgttttgtgctggcatctcaccccccgggggaaggaattcaagcagcctcgaattcgaccacaacactcaacgcctag

SEQ ID NO: 24686 - DNA, 3672 bp, Artificial Sequence
  Description of Artificial Sequence: Synthetic coding sequence
atgcgtcggctcgccgccgaagagctcggtgtggtgaccatgcagagaatattcaactccttcgtctataccgaaaaaatttctaacggagagtccgaggttcagcagcttgccaagaaaattcgggagaagttcaaccggtatcttgatgttgttaatcgcaacaaacaagtggtggaagcctcatataccgcgcacctgacatcacccctaaccgcaatccaagactgttgtacaattcctccgagtatgatggagttcgacggtaattttaacacgaatgtgagcaggaccatctcttgtgatcgccttagtaccactgtgaattctagggcctttaatcctgggcgagatctgaactccgtattggctgacaacttgaagtcaaatcccggaatcaaatggcagtattttagcagcgaagagggcattttcaccgttttccctgcccataagttccgctgcaagggctcttacgagcaccgcagcaggcctatctatgtaagtaccgtcaggccacagagcaaacatatcgttgtaatcttggaccatggcgcatctgtgactgacacccagctccagatcgccaaagatgctgctcaggtgatactttctgccatcgacgagcacgacaaaataagcgtgctgaccgttgcagacacagttcgaacctgctctcttgaccagtgctataagacctttctgtcacccgcgacttccgaaacgaaacgcaaaatgagtacctttgtttcgagcgtaaaatcttcagattcacccacgcagcacgcagtggggtttcaaaaagcctttcaactcattaggagcacgaataataacaccaaattccaggcaaacacggatatggttattatttatttgtcggcaggtatcactagcaaggactcttctgaagaagacaaaaaggccacattacaggtaattaatgaggaaaattccttccttaacaactctgttatgattttaacctacgccctcatgaatgatggcgttaccggcttgaaggagctggctttcctacgcgatttggcagaacagaacagtgggaagtacggcgttccagaccggatggcactacccgtgatcaagggcagcatgatggtcctcaaccagctaagcaacctcgaaaccaccgtgggccggttttacaccaacctgcccaataggatgattgacgaggccgtcttttcattgcccttttcagacgagatgggagacggccttatcatgactgtctcgaaaccatgttatttcggtaatttgctgcttggaattgtcggcgtcgacgtgaacttggcttacattttagaagacgtgacttactaccaggactctctggccagttacaccttcctgatcgacgacaaggggtacaccctcatgcacccatcgctcacacgcccgtatcttctctccgagccgcccctgcacacagatataatacactatgagaacatcccaaaattcgaactcgtgcggcagaatatacttagcctgccactggggagtcagattatagcggtgcccgttaattcatccctgagttggcacattaataaacttagagagacgggaaaagaagcttacaatgtcagttacgcctggaagatggtgcaggatacaagttttattttatgcatcgtggtgatccagcctgaaatccctgtgaagcaattgaagaacctgaatacggttccaagttcaaagctgctgtatcaccgcttggacctgctggggcagcccagcgcttgcctgcatttcaagcagcttgccacattagagagccctacaattatgttaagcgccgggtcattctcatcaccttacgaacacctctcacagccagaaacgaaacgaatggttgagcattacaccgcttatctcagcgacaacacaaggttgattgcgaacccgggtctcaaattttcagtacgcaacgaagtgatggcgacctctcacgtgaccgacgagtggatgacccagatggagatgagctcattgaacacttacatcgtgcggaggtatatagcgaccccgaatggcgtgctgaggatctatccaggcagcctgatggacaaagccttcgatccaacccggcggcagtggtatctacacgccgtcgcaaacccagggcttatcagtctgaccggaccttaccttgacgtagggggggcgggctatgtggttactatctcccacactatccattcatcatctactcagctctcgagcggccacacagtcgccgttatgggcatcgactttacgctcagatacttttacaaggtgttaatggacctgctccctgtctgtaatcaggacggcggaaataagatcagatgcttcatcatggaggaccggggttacctagttgctcatccgacgctaatcgacccaaaaggtcacgctcctgtggaacagcagcatattacccataaagagccgctcgtcgccaacgacatactcaaccaccctaactttgtgaagaaaaatctgtgcaactccttcagtgataggacagttcagcggttctacaagttcaataccagtcttgctggggatcttaccaatctagtgcacggatcccactgctcaaaataccgactcgcgagaatccctggtacaaatgcatttgttgggatcgtaaatgaaacctgtgattccttggctttttgcgcctgttcaatggtagaccgactgtgtctcaactgtcaccgaatggagcagaatgagtgcgaatgtccctgtgagtgccccttagaggtgaacgagtgcactggcaatctgactaacgccgaaaacaggaacccgagttgtgaggtccatcaagaaccagtgacctacactgccatcgacccaggtcttcaggatgcgctgcaccaatgcgtgaactcccggtgttcacagcgcctggagagtggggactgcttcggagtgctggattgcgagtggtgtatggtcgatagcgacggcaaaacacatctggataagccttattgcgcaccacagaaggagtgcttcggcggtattgtcggcgcaaagagtccatatgtggacgacatgggcgcgatcggagatgaagtgattacattaaatatgataaagtcggccccagtgggacctgtggcaggcgggattatgggctgcattatggtgctggttcttgctgtttatgcataccggcatcagatccacagaaggtctcatcagcacatgagtcctctggctgcgcaggagatgagcgtgcgcatgagcaacctggaaaacgaccgtgatgagcgtgacgatgatagccacgaggataggggcatcatctctaatacacggttcatcgcagcagtgattgagcgacatgcccactcgcctgagcggcggaggcgttactgggggagatccgggacagaatcagatcatggctactccactatgtcaccacaggaagattctgaaaaccctccatgtaacaatgatcccctcagtgcaggtgttgatgtgggaaatcacgatgaggaccttgatttagatacacccccccaaacagccgccctcctgagtcacaaattccaccactaccgatcacatcacccaacactccaccattcccatcacttgcaggctgctgtgaccgtccataccgtagacgcagaatgctag

SEQ ID NO: 24687 - DNA, 3825 bp, Artificial Sequence
  Description of Artificial Sequence: Synthetic coding sequence
atggcccgccagcctgaggaggaagagaccgctgtcgctcgggccagaaggcccccgctctggctgctttgtttggttgcctgttggctgctgggcgctggcgcagaagcggacttttccattttagatgaagcccaggtcctggcctcacagatgcggagactagccgccgaagagctgggggtggtgaccatgcaacggatttttaatagctttgtttacactgaaaagatttctaatggagagtctgaggttcagcagctggctaaaaagattcgcgagaagttcaatcggtacttggatgtggttaatcggaacaaacaggtggtggaagcgtcctataccgcacacctgacttcacctctcaccgcaatacaggattgctgcacgatccccccttccatgatggaattcgatggtaatttcaacaccaacgtcagccggaccattagctgcgatcgcttgtccacaacagtgaactcgagagctttcaaccctggacgtgatttaaactccgtgctggccgacaatttgaagagtaatcccggtataaagtggcagtatttttcttcagaggaaggaatttttactgtgttccctgctcacaaattccgatgcaaaggatcatacgagcaccgctcccgcccaatatatgtttcaaccgtccgaccccaatccaaacacatcgttgtgatactggaccatggtgcaagcgtgacagacacacagctgcaaattgccaaggatgcagctcaggtgattctgagcgcaatcgatgagcacgacaagatatctgtgttgacagtcgccgatacagttcggacatgttcactagatcaatgttacaaaaccttcctcagcccagctacttccgagaccaagcgaaaaatgagcacattcgtctccagcgtcaagagctcagatagtcccacacagcatgcggtaggcttccagaaagcatttcagctcatccggtcgacaaataacaacaccaagttccaggcaaacaccgatatggtgataatttacctgagcgctggaattacttcaaaagattcctccgaggaagataagaaggcgactctccaggtgataaatgaggagaacagtttcttaaataactccgttatgatcctcacatacgcactgatgaacgatggcgtgacagggctgaaggaactggcattccttcgagatttagccgaacagaattctggcaagtacggagtgccagatagaatggctttacccgtcatcaaggggtccatgatggttttaaatcagctgagcaacctggaaaccacagtcggaagattctatacaaacctgccgaatcgaatgatagatgaagcagtgttttcgctcccttttagcgatgaaatgggcgatgggctgatcatgactgtgtccaaaccctgctatttcggcaatctactgctcggcattgttggtgtggacgtgaaccttgcttacattctggaagacgttacctactaccaggactccctagcttcatacacttttctgatcgacgacaagggttatacccttatgcacccctccctcacacggccatacctgctctcagaacccccactacatactgatatcatacattatgagaatataccaaagtttgaactggtcaggcaaaatatactttccctgccgctgggcagccagattatcgccgtaccagtgaacagctccctttcatggcacatcaataagctgagagaaacgggaaaagaggcttacaatgtgagctacgcttggaaaatggtgcaggatacatcctttattttgtgtatcgttgtcatccagcccgagatacctgtcaagcagctgaagaacctgaataccgtgccatcatcgaagttgctctaccatcgcctggacttgctggggcagcccagcgcatgcctccacttcaaacaactcgctacccttgagagcccaactattatgttgagtgctgggtctttttcgagtccttacgagcacctctcccagcccgagacaaaacgcatggtagaacactataccgcctatttaagcgataatacacggctcattgctaatccaggactgaaatttagcgtccggaatgaagtgatggccacctcccatgtgactgacgagtggatgacacaaatggagatgtctagtctgaacacgtatatcgttcggagatacattgccaccccaaacggtgtgctcaggatctatcccggctcactgatggataaggcctttgatccgactaggaggcaatggtacctgcacgcagtcgcaaatcctggcctgatctccctgaccggcccatacctagacgttgggggagctggctacgtggtcactatctctcatacgatccactccagcagtactcagttgtcatccggccacacagtggccgtgatgggaatcgattttacattaagatatttttacaaagtgctgatggacctcctgcccgtatgtaaccaggatggcggcaataagatcaggtgtttcattatggaagaccgtggatacctggttgcccaccctacacttatcgatccaaaggggcacgcccctgtcgagcaacagcacatcactcacaaagaacctcttgtggctaatgatatcctcaatcatccaaacttcgtcaaaaaaaacctctgtaacagtttttctgatcgcaccgtacaaaggttctacaagtttaacacatccctcgcgggtgacttaacgaatctcgtacatgggtcccattgctcaaaataccgccttgcccgaatcccagggaccaacgctttcgtggggattgtgaatgaaacctgtgattcgctcgctttctgcgcttgcagcatggtggaccggctgtgtctgaactgccacagaatggagcagaacgaatgcgaatgcccctgtgaatgtcctctggaggtaaacgagtgtacggggaacctgacaaatgcggaaaacaggaatccatcctgtgaagtccatcaggaacccgtcacgtataccgctatcgaccccggactccaggacgccttacaccagtgtgttaattctagatgcagccaaaggcttgaatcgggcgactgtttcggggttttagattgtgaatggtgcatggtcgattctgacggcaaaactcacttagataaaccctactgcgcgccccaaaaggaatgttttggaggcattgttggagctaaatcaccctacgtggatgatatgggcgctattggcgatgaggtgatcaccctcaacatgatcaagagcgcacctgtgggtcccgtggctggtggtataatggggtgcataatggtgcttgtgctggcggtctatgcttaccgacatcaaatccatcgcagatcccatcagcacatgagtcctctcgccgcccaggaaatgtcagtacgaatgtctaacttggagaacgacagagatgagcgagatgacgactcccatgaggatcgcgggatcatcagcaacaccagattcatagctgccgtaatcgagcgtcacgcccatagcccggagcgaagacgacgctactggggaaggagcggcaccgagtccgaccatgggtacagtacaatgtctccgcaagaggacagcgaaaacccaccatgtaacaatgacccactcagcgccggcgtggatgtgggaaaccacgatgaggaccttgatctggacactccccctcaaacagccgcacttttgagccacaagtttcatcattatcgctcccatcacccaactctccaccacagtcatcatctgcaggctgccgtcactgtgcacactgtggacgccgagtgttag

SEQ ID NO: 24688 - DNA, 2460 bp, Artificial Sequence
  Description of Artificial Sequence: Synthetic coding sequence
atgtggggtcttgtgcggctgcttcttgcatggttgggcggatggggatgcatggggagattggcagccccagcacgagcttgggccgggtcacgcgagcaccccggaccggccctgttgcgaacacgacggtcttgggtgtggaaccagtttttcgttatcgaggaatacgccggcccagaaccagtcctgattgggaagctgcacagcgatgtcgatcggggggaaggcagaaccaaatacctgctcacaggagaaggtgcaggcaccgttttcgttattgatgaggccactggtaatattcacgtcacaaagagcctcgatagagaggagaaagcacaatatgttcttctcgcccaggctgtggaccgcgcttccaataggccacttgaacccccgagtgaattcatcattaaggtccaggacataaatgataacccacccatatttcctctaggtccataccacgctactgttcccgagatgagcaatgtgggaacaagtgtgatccaagttactgcgcatgacgccgatgatccgtcctatggtaactcagcaaaactggtgtataccgtgcttgatgggctgccattcttttccgtagacccccagaccggggttgtacggacagctattcccaacatggacagggaaacccaggaagagttcctcgtcgtcatccaagccaaggatatgggaggccatatgggaggacttagcggatctacaactgtcactgtaaccttgtccgatgtgaacgacaatcctcccaagttcccacagagcctataccagttcagtgtcgttgaaacagctggacccggcacactggtcgggcgccttcgcgcccaagaccccgatttgggggataatgccctgatggcctattctatcctggacggagagggcagcgaagcttttagcatctcaaccgacctccagggaagagatggtctgctaacagtgcgcaagcctctagactttgagtcccagcgcagctacagctttagggtggaagctacaaatactcttattgatccagcctacctccggaggggacccttcaaggacgtcgccagtgttcgggtggcggtacaagacgcacccgagccacccgcttttacgcaggctgcctaccatctcaccgttcccgaaaacaaagcccctggtacattggtggggcaaatttccgcggccgatttggattcaccagcctccccaatccgatattccattctcccccatagcgatccagagcgttgtttcagcatacagccagaggagggcacgatccacaccgccgcccccctagacagagaggcacgcgcctggcataacctgaccgtgcttgctacagagcttgggtggagctggggacctgagagaggttgggtacctctcctcgtcgctgaatggtcagcgccagcagcgcccccgcagcgcagccccgttggttccgcagtggggattccgcaagattcttcagctcaggccagccgcgtccaggtcgccatccagacccttgacgagaacgataatgccccacagctcgctgagccgtacgatacgttcgtgtgcgactctgccgcaccaggtcaactgatccaggtgatccgggctctggacagagacgaggtcgggaacagtagccatgtgagctttcaagggccactgggacccgacgcgaatttcacggtgcaggataacagggacggatccgcctcattattgctgccgagtaggccagccccaccgagacacgccccctacctcgtgccgatcgaactgtgggattggggtcagcctgctctgtcttcgacggccacagtgacggtgtccgtctgtcgctgccaacctgacggcagcgtggcctcctgctggcccgaggctcatctgtccgccgcgggcttatccaccggagctctgttggccataatcacgtgcgtcggagcgctcttggccctcgttgttttattcgtggctctcaggaggcagaagcaagaggcgttgatggtcctcgaagaggaggatgttcgggagaatatcattacatacgacgacgaaggcggtggcgaggaggataccgaggccttcgatattaccgccctacagaatccggatggcgccgccccgcccgcgccgggccccccagctcgacgggatgtgctgccacgtgctcgggtgagccggcagccacgtccaccgggacctgctgatgtcgcccagctcctggccctgcggctgcgtgaggccgatgaagatcccggtgttcctccctatgactctgtgcaagtatacgggtatgagggcaggggctcctcatgcggcagcctgtccagcctcgggtctggctcagaagctggtggggcacccggcccagcagagcctctcgacgattggggccctttgttcagaacattggcagagctctatggcgctaaggagcctccagccccttag

SEQ ID NO: 24689 - DNA, 2460 bp, Artificial Sequence
  Description of Artificial Sequence: Synthetic coding sequence
atgtgggggctagtaagattgctgcttgcatggttagggggctggggttgcatggggcgcttggcggccccagcacgtgcctgggccgggagcagagagcaccccggtccggctcttctccgaacccggcggtcgtgggtttggaatcagttcttcgtcattgaggaatatgctggccccgagcccgttctcatcgggaagttgcactcagacgtcgaccgcggcgagggtcgcacgaaataccttctcaccggagagggcgccggaacggttttcgtcattgatgaggccacgggtaatatccatgttaccaagagcctcgacagagaggaaaaggcccaatacgtgctactggcccaggctgttgacagagctagcaatcgtcccttggagcccccaagcgagttcatcattaaggtgcaagatataaatgacaatcctcccatctttccccttgggccataccacgcaacagtgcccgagatgtctaacgtaggaacttccgtaattcaggtgaccgcccacgacgctgatgacccttcatatggtaacagtgcgaagctagtttacaccgtactggatggcttaccatttttcagtgtcgacccgcagacaggtgttgttagaacagcgatcccaaatatggacagggagacccaggaggaattcctcgttgttattcaagccaaggacatgggagggcatatgggaggactgagtggatccacgacagtcacagtgacccttagcgacgttaacgataacccgcctaaatttccacagtcgctatatcagttctccgtcgtggaaaccgcgggacctgggactctggtgggccggttacgtgcccaagaccctgacttgggcgataatgccctgatggcgtacagcattctggacggcgaaggaagtgaagcgttctcaattagcacagatctccagggacgcgatggtcttctgacagtacgcaagccactcgacttcgaatctcagcgctcctattcattccgggtggaggccaccaatacattgattgacccggcctatctcaggagggggccatttaaggacgtggcaagtgttcgggtcgccgtgcaagacgcacccgagccacccgcttttacacaggcagcgtaccacctcaccgttccggaaaacaaagcgcccgggaccttggtaggccagattagcgccgccgacctggattcgcccgcctcccccatccgttacagcatcttgccccatagcgaccctgaaaggtgcttcagcatccagcctgaggagggcactatacacaccgctgcgcccctggaccgggaggccagagcatggcacaacctgacagtgctggccaccgagcttggttggtcgtggggcccagaacgggggtgggtgcccctgctcgttgctgaatggagcgcacccgccgctcccccccagagaagccccgtaggaagcgccgtgggcattccacaggacagcagcgcccaagcttcccgtgtgcaagtcgctatacagactctggatgagaacgacaatgccccacagttggccgagccatacgataccttcgtgtgcgacagcgctgctccagggcagcttattcaggtcatccgcgctctagaccgcgatgaggtgggcaattcttctcacgtgtccttccaaggccctctggggcctgatgcgaatttcacagtccaagacaacagagacggcagcgcctccttgttgctgccttccaggccggctccaccacggcacgccccttacctggtgcccatagaactgtgggactggggtcaacccgccctctctagcaccgccaccgtgaccgtgtctgtgtgccggtgccaacctgatgggagcgttgccagctgttggcccgaggcccatctgtcagccgcgggcctcagcaccggggccctgctagctatcataacgtgcgtcggcgcgttactcgctctggtcgtgctgttcgtcgccctgaggaggcagaaacaagaggccctcatggtcttggaggaagaagatgtgcgagagaacatcattacctacgatgatgaaggtggaggtgaagaagacaccgaggcctttgatattaccgccctgcagaatcccgatggggccgcccctccagcaccaggaccccccgccaggcgtgacgtccttccgagagctcgcgtttccaggcagcctcgcccacctgggcctgctgatgtggcccagttacttgctctgcggctgagggaggcagatgaggatcctggcgtacccccttatgactctgtgcaggtttacggctacgaaggccggggttcaagctgcgggtctctgagttctcttggttcgggctcggaagcagggggtgcccctggacctgccgaacccctcgacgactggggcccgctgttcaggacccttgccgaactttatggggccaaagaaccgccggctccatag

SEQ ID NO: 24690 - DNA, 945 bp, Artificial Sequence
  Description of Artificial Sequence: Synthetic coding sequence
atgtgggggctggttcgactcctcctcgcctggttaggcggctgggggtgtatgggtaggctggccgctccagccagagcctgggcaggctcccgtgaacatcctggccctgcccttctgcgcacacgcaggtcctgggtgtggaatcaatttttcgtgattgaggagtacgccgggcctgagcccgtcctgatcgggaaacttcattccgacgtggatcggggcgaaggcaggaccaagtatcttttgaccggcgaaggggcgggtacggtgttcgtcatagacgaagccacggggaatatccacgtgaccaaatcacttgacagggaagaaaaggcacaatacgtgctgctcgcacaagcggtggatcgtgcttctaatcgaccgttagaaccccccagcgagttcataatcaagatcatcacttgcgttggtgctttacttgcccttgtagtgctgttcgtggctctgcggcggcagaagcaggaggccttgatggtgctcgaggaggaagacgtccgtgagaacatcattacttacgacgacgaaggcggaggagaggaggatactgaggccttcgatattaccgctctacagaaccccgatggtgcagctccccccgcccccgggccacccgccaggagagatgtcctccctcgcgcgcgcgtttcacggcagcctcgacctcccggtccagccgacgtggcacagctcctagcattacgtctgagggaggctgatgaagaccctggagtgccaccatatgattcagttcaagtttacggatatgagggccgaggtagcagctgcggctccctgtcatctctaggaagcggaagtgaagccggaggcgctccaggccctgccgaaccattggacgattggggacccctcttccgaacactggccgagctgtacggcgccaaggagccccccgccccctag

SEQ ID NO: 24691 - DNA, 2346 bp, Artificial Sequence
  Description of Artificial Sequence: Synthetic coding sequence
atgtgggggctggttcgcttgctcctggcttggctgggcggctggggctgcatggggcggcttgcagctcccgctcgggcctgggccggcagtcgcgagcacccaggaccagcgctcttgagaacacgacgaagttgggtctggaaccagttcttcgtgattgaagagtatgctggtcccgagcccgtgctaatcggtaaactgcacagcgatgtcgataggggcgagggaaggacgaaatatttattgacgggggaaggcgcaggaacagttttcgtcatcgatgaggcaaccgggaacattcatgtgacaaagtcattagatcgggaggagaaggcgcaatatgtgctgcttgcccaggcagtggaccgggcctcaaaccggccccttgagccccctagcgagttcattattaaggtccaggacatcaatgataacccgcctatatttccactgggcccttatcacgccactgtgccagaaatgtccaatgttggaacctcagtcatccaggtgaccgcccacgatgctgatgacccctcttacggaaatagcgcaaaactcgtgtacaccgtcctggatggccttcccttctttagtgtggacccccagactggcgttgtgagaactgcaatccctaatatggatagggagactcaggaagaattcctggtggtaatccaggccaaagatatgggcggtcatatgggcggccttagcgggagcaccacggtgactgtgaccctatctgatgtcaacgacaaccctccaaagttccctcaatcactgtatcagttctccgtggtggaaacagccggccctggcacattggttggacgtttgcgcgcgcaagatcccgacctgggcgacaacgccttgatggcatacagcatcctggacggagagggaagtgaggcgttttccatttcaaccgacttgcaaggcagggacggcctccttacagtgcgaaagccactggacttcgagtctcagagatcgtatagctttcgggtggaggctacaaacaccttgatagatcccgcttacctcaggcggggcccttttaaggatgttgcatccgtgagggtggccgtacaggatgcccctgagcccccggcctttactcaggccgcttatcacctgacagttccagagaataaggccccagggactctggttggccagatttcagctgctgatctcgattcccccgccagccctataagatattcgatcctgccacacagcgaccccgaacgttgcttcagcatacaaccagaagagggtactattcacaccgcggcccccctagatcgtgaggctagagcatggcacaatttgacagtccttgccaccgaacttgacagttctgcacaggcatctcgggtccaggtcgctattcagacactggacgaaaacgataatgcgccccagctagcagaaccctatgacactttcgtttgtgactcagcagcccccggtcagctgatccaggtcattcgcgccctggacagggatgaagtcgggaactcttcacacgtgtccttccaggggccgctcgggcccgacgccaactttacagtacaggacaatagggacgggtccgcaagcctgttgctcccaagccgtcccgccccccccagacacgccccttatttggtgcccatcgagctgtgggactggggccagcctgcgctctcctccaccgccacagtcactgtttctgtttgccgttgccagcccgatggctcagtagcttcctgttggccagaggcccatctttcagcagcaggtctatccaccggggctctccttgccatcataacgtgcgtcggggctttgctcgccttggtggtgctctttgtagccctgcggcgacagaaacaggaagcactgatggtgctggaagaggaggacgttcgagagaatattatcacatatgacgacgagggtggcggcgaggaggacactgaagctttcgacataacagctcttcagaatccagatggcgcggccccacctgcgccaggtccaccagctagaagagacgtgctgcccagagcccgggtttcaaggcagccacggccaccgggccccgcagacgtcgcacagcttcttgccctgcgactccgcgaggccgacgaggaccccggcgtgccaccttatgacagtgtgcaagtatacggttatgagggcaggggatctagttgcggttctctgtcctcgcttgggagtggatcagaggccgggggggccccaggcccggctgaacccctcgatgactggggccccctgttccgcacactcgccgaactgtacggggctaaagaaccccctgctccctag

SEQ ID NO: 24692 - DNA, 2346 bp, Artificial Sequence
  Description of Artificial Sequence: Synthetic coding sequence
atgtggggcctggtccgcctccttctagcctggctcggaggttggggctgtatggggcgactggccgcacctgccagggcgtgggccggttctcgcgaacacccaggccccgctctgctccggacccggcgcagctgggtctggaatcagttcttcgttattgaagagtacgctggccccgagccagtgcttatcgggaaactgcatagcgacgtggacaggggggaaggccgtacgaagtatctgctgacaggagaaggtgctggcactgtgttcgtgatcgatgaagcaaccggcaacatacacgtaacaaagtctttagatcgcgaggaaaaggcccaatacgtgctcttagcccaggcagtggaccgggcaagcaacagacccctcgagccaccatccgaatttattatcaaggtccaagatattaatgataacccgcctatattccccctaggaccataccacgccactgtgcctgaaatgtccaatgtcggcacctccgtgatccaggtcactgcccatgatgccgacgatccctcctacggcaacagcgctaagcttgtatacaccgtgttggacgggctccctttttttagcgttgacccccagaccggagttgtgcggaccgcaatcccaaacatggatagggagacacaagaagagttcctggtcgtcattcaggctaaagacatggggggccacatgggcggcttaagtgggtccactacagtgacagttaccctttcggatgtgaacgataacccgcctaagtttccccaaagcttataccaattcagcgtggtcgagacagccgggccaggcacccttgtggggcggcttagagctcaggatccagacctcggcgacaatgctttgatggcatactcaattctggatggagagggaagcgaagcattctctatcagcaccgacctgcagggccgggatgggctgttgaccgtgagaaaaccgctggacttcgaaagccaaagatcttattcttttagagtggaagcaaccaatacattgatcgatcctgcgtatcttcggcgcggtccattcaaagatgtggcttcagtgcgagtcgccgttcaagatgcaccggaaccgcctgccttcacccaggctgcatatcatctaacagtgcctgagaacaaggcccctggaactctggtaggtcagatctcggcagccgacctagacagtccagccagccccatcaggtatagcatcctaccccactcggaccctgagcgatgcttcagcatccagcctgaggagggtaccatccatacagccgcccctctggatagagaggcaagagcttggcacaatctgaccgtgttggcgacagagctggacagtagcgcacaagcgtccagagtgcaggttgccatccagactctcgacgagaatgacaacgccccgcagctggctgagccttatgatacttttgtctgtgattccgccgctccaggtcagctcattcaagtgatccgcgcccttgatagggacgaggtcggcaactcttcccatgtttctttccagggccctctgggaccagacgcaaattttacagtgcaggacaatagggacggatcggcctccctcttactgcccagcaggcccgccccaccacgtcatgccccttatctagttccaatcgaactgtgggattggggacagccagccttgagttctactgctaccgttacagtgagcgtctgcaggtgtcagcctgatgggagcgtggcttcgtgctggcctgaagcccacttaagcgccgctggactgtctacaggggcattgcttgcgataatcacctgcgtgggcgcgctgttggccctggtggtgctgttcgtggccttgcgtcggcaaaaacaggaggccctaatggttctggaggaagaggacgtccgtgagaacatcatcacctacgacgacgaaggagggggggaggaagatacagaagcctttgatattaccgctctgcagaatccagacggcgccgcaccgcccgctcccggcccacctgcaagaagagacgtcctgcctcgtgcaagagtgtctagacaaccccggcccccggggccggccgacgtcgcccagcttctcgccctgcgtctccgcgaggccgacgaggatcctggcgtgccgccttacgattccgtgcaagtttatgggtacgagggaagagggtcctcttgcgggtctctgtcctccctgggtagtggcagcgaggccggcggcgcaccggggcctgcagaacccctggatgattggggcccattattcagaacacttgctgaactttacggtgccaaggaacccccagcaccatag

SEQ ID NO: 24693 - DNA, 2559 bp, Artificial Sequence
  Description of Artificial Sequence: Synthetic coding sequence
atggccatgcgatccggacgtcaccctagtttgctgctgctgctcgtgttgctcctatggctcttacaagtgtctatcattgactcagtgcagcaggagactgacgaccttaccaagcagaccaaggaaaagatctatcagcccctcaggagatccaagaggagatgggtgattaccaccctcgaactggaagaggaagaccccggacccttcccaaagctcatcggcgagctttttaataatatgagctacaatatgtcccttatgtatctgattagcgggcctggtgtggatgagtaccctgaaattggtcttttttctctggaggaccacgaaaacgggaggatctatgtccacaggccggtggacagggagatgaccccatcattcactgtttattttgatgtcgttgagcggtcaaccggaaagattgtggacacgagcctaatcttcaacatacgaatcagtgatgttaacgaccacgcaccccagttccccgagaaagaatttaacattacagttcaggagaaccagagcgccggccagccgatttttcagatgctcgccgtagatttggatgaggaaaacacccccaactctcaggtcttgtattttcttatttcacagacgccactgctcaaagagagtgggtttcgtgtggaccgcctttccggtgaaattaggctgtcagggtgcctggactatgagacagctccccaatttacgctactgatccgcgcaagagattgtggtgaacccagtctgtcgtcaaccactactgtccacgtggacgtgcaggagggcaataatcacagacctgccttcacccaggagaactataaagtccagatccctgaaggccgggcttctcagggcgtgttacgactcttggttcaagatcgcgactctccgtttacatcagcgtggagggctaagtttaacattctgcatggaaacgaagaaggccacttcgacatctctaccgaccctgagactaatgaaggaattctcaacgttattaagccactggactatgagacccgcccggcccagagcctcataatcgtcgttgaaaatgaagagcgactcgtgttctgcgaacgcggaaagcttcagccacctaggaaagcagcagcttccgccaccgtgtctgtccaagtcaccgatgccaacgatccccctgccttccatccgcagagctttatagttaacaaagaagagggtgcccgcccgggtaccttactgggtacatttaatgccatggatcccgacagccagattcgatatgaacttgtgcatgacccggctaattgggtctcagtggacaagaattccggcgtggtcatcactgtcgaacctatagaccgcgaaagcccgcacgtgaacaacagtttctacgtgatcatcatccacgcagtggacgatgggttcccgcctcagacagccacagggacgctgatgctgttcctatctgatatcaacgacaacgtgcccacactcagaccccgcagtaggtacatggaggtttgtgagagtgccgtgcacgagccactccatatcgaagcggaggatccagacctggagccattctccgaccccttcactttcgagcttgataacacttgggggaatgcggaagacacatggaagctggggcggaactggggccagtctgtggagcttctgactctacgttcattgcctcgcgggaattatctcgttcctttgttcatcggagataaacagggtctcagccagaagcaaacagtgcacgtcaggatctgcccctgtgcgtcgggcctgacatgcgtggaactggcagatgcagaagtgggcctgcacgtcggagcattgtttcccgtgtgcgcagccttcgtggcactggcagtcgccctgctgtttctgttacggtgctacttcgtcctggagccgaaacgccatgggtgttccgtgagcaacgatgagggacaccagaccctcgtcatgtataacgccgagagcaagggtacctctgctcagacttggagcgatgtggagggacagagacccgctctgctaatctgtaccgcagcggctgggccaactcaaggagtaaaagcatatccagacgcgactatgcatcgccagctcttagccccagttgagggaaggatggccgaaacgctgaatcaatctaaggagagaaataggttctcactgagccgcggctgtataattcctcaaggtagagctaccgctggcaggggtctgcctcaagacatttacaaagagatgatgcctaggaggttgacccagacgggaaaacgcaaacatggggccctcgcaagaacccccagcttcaaaaaagtggtgtacgatcataaagaggacgaggaaaacaaggccggacgcaaacagcggagtcatctgtttaaagtcatgcaactccggaacgagcaggggggtgttcgggtccagtctgctcatagtccatccccactcaataaaaaggcttgtttccctggcgattaccgaggcgagtcggccggaggccacaactgtcgtgctgtctccgggtag

SEQ ID NO: 24694 - DNA, 375 bp, Artificial Sequence
  Description of Artificial Sequence: Synthetic coding sequence
atgaaaccgttgatctggacctggagtgatgtggaggggcagcgaccggcgctacttatatgcaccgccgcggcagggccaactcaaggcgtcaaagcttaccccgacgcgacaatgcacaggcagctgttagcacccgtggaagggagaatggcagagactctgaatcaaaaattgcacgtagccaacgtgttggaggatgatcccggatatctgccacacgtgtacagtgaagagggcgagtgcgggggagctccctctttaagttccctggcaagcctcgaacaggagctccaacccgacctgctggattctcttggaagtaaggccaccccgtttgaggaaatctatagcgaatccggtgtgcctagctag

SEQ ID NO: 24695 - DNA, 2499 bp, Artificial Sequence
  Description of Artificial Sequence: Synthetic coding sequence
atggcaatgcggtctggacgccaccctagtctgctccttctcctcgtacttctgctgtggctattgcaggtgtctattatagattcagtgcagcaagagactgatgacctgaccaagcagaccaaagagaaaatctaccaaccgctgcgcaggtcaaagcgccgctgggtcattacgaccctagaactggaagaggaggaccccggcccttttcctaagctaattggtgagctgttcaacaacatgtcatacaatatgtccttgatgtatctaatatccggacccggcgtggacgaataccctgagatcggtctgtttagccttgaagatcatgagaacggaaggatttatgtgcacaggcccgtcgatagagaaatgaccccatcttttacagtgtacttcgatgtcgtggaacgatcaacagggaagattgtggacacctcattgatattcaatatccggatttcggatgtgaacgatcacgctccccagttcccagagaaagaattcaatataactgtccaggagaaccagagcgccggacaacccatctttcagatgctggctgtggatctggacgaagagaacaccccgaactctcaagtgctgtactttctgatatcccagacaccactgctgaaggaatccggatttcgcgtggataggctatcaggcgagataaggctcagcggatgtttagactatgagacagccccacaatttaccctgctgatacgcgcccgggattgtggtgagccttcactctctagtacgaccactgtgcacgtcgatgtgcaagaggggaataatcacagacccgcttttacccaagaaaactacaaggttcagattcctgaaggccgggcctcacagggggtactgcgcctgctcgtacaagaccgtgactccccctttacctcagcctggagggctaaatttaatatcctgcatggcaacgaagagggtcatttcgacatttccaccgatcccgagaccaatgaaggtatccttaatgttatcaagcccctggactacgaaactcgccccgctcagagcctcatcattgtggtagagaatgaagaacgcctggttttctgtgaaagaggaaagctgcagcctccaagaaaggcagcagccagcgccactgtcagcgtccaggtgaccgacgctaacgatccacccgcatttcatccccagtcattcatagtgaacaaagaggagggtgccaggcctggaacactgctcggaactttcaacgccatggatccagattcacagatacgatatgagctcgttcacgatcccgccaactgggtgtctgtggataaaaactccggggtggtgattactgtggagcccattgatagggagtcgccccacgtgaacaacagcttttacgtcattattatccacgctgtggatgacggctttcctccccagacagccaccgggaccttgatgctgtttctctcagacataaatgacaatgtgcctaccctgagacctagatcccgatacatggaggtctgtgaatccgctgtgcatgaaccacttcacatcgaagctgaagacccagacctggagccgttttccgacccgttcacattcgaattagacaacacttggggcaacgctgaggacacatggaaactaggccgaaattggggacagagcgttgagctgcttactttgcgatccctgcccagaggtaattaccttgtaccactgttcataggcgataagcaaggtcttagccagaagcagaccgtacatgtaaggatatgcccctgtgcttcaggcctcacttgcgtagagctggctgatgctgaagtcggtcttcatgtgggggccttgttccccgtctgcgcagcatttgtcgccctcgctgtggccctgctttttctgctgcgctgttattttgtcctggagcctaaaaggcatggctgcagtgtgtcaaatgatgaaggccatcagacgttagtgatgtacaacgccgagagcaaaggcacttccgcgcagacctggtccgatgtggaaggtcagagaccagctcttttgatatgtaccgcagctgcaggcccaacgcagggcgtgaaagatctagaggaggttcctccttccgccgcgtctcagtctgcgcaggccaggtgcgcccttggtagctggggctacggcaagccctttgaacctcgtagcgtaaaaaatattcatagtactccggcatacccagacgccactatgcaccgacagcttttggccccggtggaggggagaatggcggagacgctgaatcaaaagttgcacgttgccaacgtgctggaggatgacccaggctatctcccgcacgtctactctgaagagggtgagtgtggaggtgctccatctttgtcatctctggcatcattagaacaggaattacagccggatcttcttgactcactgggatctaaagctactccttttgaggaaatttattcagaaagtggcgttccttcgtag

SEQ ID NO: 24696 - DNA, 498 bp, Artificial Sequence
  Description of Artificial Sequence: Synthetic coding sequence
atgaaacctttgatctggacttggagcgacgtcgagggacaacgaccagcattgcttatttgtaccgccgctgccggtccaacccaaggcgtaaaggatttggaagaggtgccaccctccgccgcctcacagtctgcccaggcgaggtgcgcacttgggagttggggatatggtaaaccattcgagcctcgaagcgtgaagaatatccacagcacacctgcgtacccggacgctactatgcaccggcagctgctggcccccgtcgagggcagaatggccgagacattgaaccagaagctccatgttgctaatgtgttggaagatgaccccggctatctgccccacgtatactctgaggagggtgagtgcggtggcgccccttcgctgtcctcgctcgcttctttggaacaggaacttcagccagatttactagatagccttggcagcaaggccacacccttcgaagagatttactcagagagcggtgtccccagttag

SEQ ID NO: 24697 - DNA, 1335 bp, Artificial Sequence
  Description of Artificial Sequence: Synthetic coding sequence
tagcgcccgggcacgctgctagggacatttaacgctatggaccccgactctcagatccgatacgagcttgtccatgaccctgccaattgggtctctgttgataaaaactcaggggttgtgatcacagtggaaccaattgacagggaaagtccacacgtgaataacagcttctacgtgattatcattcatgccgtggatgatggcttccctccacagaccgctacaggcacccttatgctattcctgagcgacattaatgacaacgttcccactctaaggccgcgaagccgctacatggaagtctgcgaatccgccgtgcacgaacccttgcacatcgaagcggaagacccagacttggagcctttttccgacccattcactttcgaattggataatacctggggaaatgctgaagatacttggaaattaggacgaaattggggccaatctgtggagcttctgactttgcgcagtctaccgaggggcaactatttggtgcctctgtttattggggacaagcagggacttagccaaaagcagacggtccatgttcgcatctgtccttgcgccagcggccttacctgtgttgaactagcagacgccgaggtggggctgcatgttggcgcactgtttcccgtttgcgcagcttttgtcgcactggcagttgctctcctgtttctgctgcgctgctactttgttttagaacccaaaagacacggatgcagtgtgtccaatgatgagggtcatcagaccctagtgatgtacaacgcggagtctaaaggcacctctgcccaaacctggtcagacgttgagggtcagagacccgccttgcttatctgtacggcggcggctggtcctactcagggggtgaaagcttaccccgatgccacaatgcaccgccaactgttggctcctgttgagggacgaatggccgaaaccctgaatcaatccaaagagaggaacagattctccctgtccaggggatgcatcataccacagggccgggcaactgccggaaggggccttccccaggacatctataaggagatgatgccccgccgcctgacccagacgggcaagcgaaagcacggggccctcgcccgtacaccctcgtttaaaaaagtcgtgtacgaccacaaggaggacgaggagaacaaggccgggaggaagcagcggagccaccttttcaaggtcatgcaactccgaaatgaacaaggaggagttcgcgtccagtccgctcatagccccagcccactgaacaagaaagcttgcttccctggcgattatcgaggcgagagcgctgggggtcataattgccgcgctgtatcaggctag

SEQ ID NO: 24698 - DNA, 3933 bp, Artificial Sequence
  Description of Artificial Sequence: Synthetic coding sequence
atggcacagctgtggctctcctgctttctgctgccggcacttgttgtctcagtggcggctaatgtcgccccgaaatttctggccaatatgacctctgtgatattgcccgaagatctacctgtaggggcccaggctttctggttggtggccgaggaccaggataatgaccccctgacctacggtatgagcggccctaacgcctacttcttcgctgttacccccaagaccggtgaagtaaagctagcatccgcccttgactacgagacgctatatacgttcaaggtgactatcagtgtgtctgatccgtacattcaagtacagagggagatgttagtgatcgtggaggatcggaacgacaacgccccagtctttcagaacaccgcctttagcacgtccataaacgaaacgcttcctgtgggcagtgttgttttttccgtgctggcggtagacaaggacatggggtctgcggggatggtggtgtactcaatagagaaggtgatcccctccacaggcgacagtgaacacttgtttcggatcttggctaatggatctatagtgctcaacgggtccctaagctacaataacaagtcagctttttatcaattggagctgaaggcctgtgatctgggtgggatgtatcacaatacctttactatccaatgcagcctccccgtcttcctgagtatctctgtggtggatcagccggatctcgatcctcagtttgtgagagagttctatagcgcgagtgttgctgaagacgctgctaaggggacctccgtgctaaccgtcgaggctgtcgatggtgataaaggaatcaacgaccccgtcatctacagtatctcttattctacacgaccaggctggttcgatataggtgcagatggcgtcattcgagtgaacgggtccctggatagagagcagttgttagaggcagacgaagaagtgcaattgcaagtcactgcaaccgaaactcatttaaatatttatggccaggaagctaaggtttcaatttgggttactgtgcgagtcatggatgtgaacgaccacaaacccgaattctacaattgtagcctgccagcgtgcacatttactcctgaggaagcccaagtgaacttcactggctacgtggatgagcacgcctcgccccgaattcccatcgacgatctcaccatggtcgtgtacgatcctgataaaggatccaacgggaccttcctgctgagcctcggcggacccgatgcagaggccttctctgtgtcccctgaacgtgccgtggggtccgcatccgtgcaggtcttggtgcgggtttccgctctggttgactacgagcggcaaaccgcaatggcagtgcaggtcgtggctacagactccgtgagccagaattttagcgttgcaatggtgactatccatctacgtgatatcaacgatcatcgaccgaccttcccccagagtctttatgtcctcacagtgcctgaacacagtgccaccggtagtgtggtgaccgactccattcacgctaccgatccggacactggagcctggggccagatcacctacagcctgctccctggaaatggtgcagacctattccaagtcgatcctgtttctggaaccgttacagtacggaatggggaactgttagaccgggagagtcaagccgtgtactatcttaccctccaggcaactgacggcggcaacctctcctcttccacaacgcttcagatccaccttctggatattaacgacaatgcaccggttgtttcgggatcctataacatcttcgttcaggaagaggagggtaatgtgtccgtaacaatccaggcgcatgacaacgacgaacctggtactaacaatagccgactgttattcaatctgctccctgggccctattctcacaatttcagcctggaccccgacactgggctcctccgaaacctgggaccactggatagggaagccatcgatcctgcattggagggccggattgttcttacggtgctcgtgagcgattgcggcgagccggtgcttggaactaaggttaacgtgaccatcaccgtggaggatatcaacgataacttaccgatttttaaccagtccagttacaactttacggtcaaggaggaggacccgggtgtgctagtcggggtcgtgaaagcctgggatgccgaccagacggaggcgaataatcgtatctctttttctctctcgggctcaggggcgaactacttcatgatccggggccttgtccttggagcaggatgggctgagggatatttaaggctcccaccagatgtgtcccttgattacgagacccagcctgtttttaatctgaccgtgtccgccgagaatcctgacccccagggtggtgaaaccatcgtcgatgtatgcgtgaatgtaaaagatgtcaacgataacccacctacgctggatgtggcttcccttaggggtatccgcgtggctgagaacggaagccagcacggtcaggttgcagtggtggttgctagtgatgtcgacacttcagcccagctggaaattcaattggtcaatatcctttgcacaaaagctggcgtggatgttggtagcctgtgttgggggtggttctctgtggcggccaacgggtcagtgtacattaaccagtcaaaagcaattgattacgaggcatgcgatttggtcacactggtcgttagagcgtgcgatctggccaccgacccaggctttcaagcctactcgaataacggctcactgctgataacaatcgaggacgtgaacgacaatgctccttatttccttcctgaaaacaaaacctttgtgattattccagaactggtgttaccgaaccgggaggttgctagcgtgcgcgcaagagacgacgactctggaaacaatggagtgattctcttctccatcctgagggtggactttatctcaaaggacggagccacgattccctttcaaggggtgttctcaatatttaccagcagtgaggccgatgtctttgccgggtccatccagcctgtaacttccttggacagcaccctgcagggcacatatcaggtaactgtgcaggctagggacaggccttctttgggcccttttctggaggcaacaactacactgaaccttttcaccgttgaccagagctatcgatcccgtctgcagtttagcacgcctaaggaagaagtcggagccaacagacaggcaattaatgccgcccttactcaggccacaaggactactgtttacatagtcgacatccaggatatcgacagtgctgccagagcaagacctcactcctatttggatgcttatttcgttttccctaacgggagtgctcttaccctcgatgaactttctgtcatgattcggaacgaccaggactccctaactcagctcttgcagcttggcctggtggtcctcggatcccaggagtctcaagagtcagatctcagcaaacagcttatctccgtgattattggcctgggagtcgcgcttctgctggtcctggtgatcatgacaatggcattcgtttgcgtccgtaagtcctataatagaaaactccaggccatgaaagccgccaaggaagcaagaaaaacggctgccggcgtgatgccatctgcccctgccatccctggaactaacatgtacaacactgagagagccaatcctatgttgaatttaccaaacaaggatttgggcctcgaatatctgagccctagtaacgatcttgactccgtgtccgtcaattcacttgatgataactccgtggacgttgataagaactcccaagaaattaaggaacatcggcccccccacaccccgcctgagcctgaccccgaacctttgtccgtggtgttgttgggccggcaggctggtgccagcggtcagttggaaggcccgtcctacactaacgccgggttggacaccaccgacctgtag

SEQ ID NO: 24699 - DNA, 3933 bp, Artificial Sequence
  Description of Artificial Sequence: Synthetic coding sequence
atggcccagctgtggctgtcctgcttcctactgcccgcactcgtcgtcagcgtggccgctaatgtggcccccaaatttctagccaacatgacttccgtcatactgcccgaggacttacccgtgggcgcccaagcattctggctggtggctgaagatcaagataacgatccgttaacgtacgggatgagcggtcccaatgcatacttttttgccgtgacgcccaaaaccggcgaggttaaactggcgagtgccctggattacgagaccttatacactttcaaagtgaccatcagcgtctctgatccttatattcaggtgcagcgagaaatgttagtgatcgttgaagatagaaatgataatgcccccgtgtttcagaataccgcctttagcactagtatcaacgaaacactgcctgtcggttccgtggtgtttagtgtcctggccgtcgacaaagacatgggctctgcaggaatggtagtgtactcaatcgagaaggtaatcccttctaccggcgatagcgaacatctgtttcgcattctagcaaatggatccattgtgctgaacggatcactgtcctataataacaaatcagctttctatcagttggagttgaaagcttgtgatctagggggaatgtatcacaacaccttcacaatacagtgctctctgcctgtcttcctcagtatcagcgtcgttgatcagcccgatttggaccctcagttcgttagagagttttactctgcaagcgtggctgaggacgccgccaaagggacctcagtcttgaccgtggaagcagtggacggggacaaggggatcaacgatccagtcatttattccatcagttactcaacacggccaggatggttcgacatcggagccgatggcgtgatcagagttaatggttcgctggaccgcgagcaactgttagaggctgacgaggaggttcaattgcaggttacagcgacggagactcaccttaatatctatggtcaggaggctaaagtgagcatctgggtgaccgtgcgggtgatggatgttaacgaccataagcccgagttctacaactgttcattacctgcttgcacttttacacccgaagaggcccaggttaacttcacagggtacgttgacgagcacgcttcaccccggataccaatcgacgacctgactatggttgtctacgacccggataaggggtccaacggtacctttctcctcagcctgggggggcctgacgccgaggccttcagcgtcagtccagagcgcgctgttggctctgccagcgtccaagtgctggtgagagtttctgccctggtagattacgagcgccaaacagccatggccgtgcaagttgtggcgacagatagtgtcagccagaatttcagcgtcgctatggtaaccatccacctgagggacatcaacgaccacaggccaaccttcccccagtccttgtatgtgcttaccgttcccgaacactctgccactggatccgtggtcacggattccattcatgccaccgatcccgacaccggagcgtggggacagatcacctactctcttcttcccggaaatggcgcggacctgtttcaggtggacccagtttcaggtaccgtgaccgtcaggaatggcgagctgctagacagagagtctcaagcggtgtactatctgacattgcaagctactgatggcgggaacctcagctcctcgactactctacaaatccatctcctggatatcaacgataacgcacctgtcgtgtccggttcttacaatatattcgtgcaggaggaagaagggaatgtctccgtgacgatacaggcccacgacaatgatgagccaggaactaataatagtcgcctcctgttcaatctcctccctggcccatacagccataattttagtctcgatcccgatactggattacttagaaatctcggaccacttgatagagaagccattgacccagccctggagggccgcattgttctgaccgtgctcgtaagtgactgtggtgaacctgtgcttggcactaaagtcaatgtcaccataacagtggaggacatcaatgacaacttgccgatcttcaatcaaagctcttacaactttaccgtcaaagaggaggaccctggcgtgttggtaggtgtagtcaaagcgtgggacgctgaccaaaccgaagcgaataaccggatctcgttttccctgtctgggtccggggccaattatttcatgattcgcggcctggtgttaggggctgggtgggccgagggctacctgaggctgccgccagatgtttctctggactatgaaacccaaccagtgttcaatctaacagtctccgccgaaaatcctgatcctcaaggtggcgaaactatcgtggacgtgtgcgtcaatgtcaaagatgtgaatgacaacccacccactctggacgtggcttcccttcgtggaatcagagtggcggaaaatggcagccagcacggccaggtggctgtggtggtcgcttctgacgttgacacctcagctcagctggaaatccaacttgtgaacattctgtgtaccaaggccggagtggatgtcggctcactgtgttggggctggttttctgtcgcagccaatggaagcgtgtacattaatcagagcaaggcgatcgattacgaagcttgtgacctggtcaccctcgttgtacgggcgtgcgacctggctaccgaccccggattccaggcctatagtaacaacggcagccttctgattaccattgaagacgtgaatgataatgctccctacttcctcccagaaaataaaacatttgtcattattcccgagcttgtgcttcctaaccgagaggtggcgtcggtgcgcgcccgggacgacgatagcgggaacaatggagtgatcctgttctctatactccgagtggactttatttccaaagatggcgccactattccatttcagggggtctttagtattttcacgtcaagcgaggccgatgtgtttgctggttcaatccagcccgtgacatctctggacagcacacttcagggaacctatcaggtgacggttcaggccagagatcgacctagtctaggaccattcctggaggcaacaaccactctcaatcttttcaccgttgaccagagctatcggagcaggctgcagttttcgacaccaaaagaagaagtcggtgccaatagacaggccatcaacgccgctttaacccaggccaccagaaccaccgtgtacatcgtggatattcaagatattgattcagccgcccgggcccggccccacagttatttagacgcttattttgtatttccaaacgggagcgctttgactctggatgaactgtctgtgatgatccggaacgatcaggactccttaactcagctgctccagctggggctggtcgtgcttgggtcccaggagagtcaggaatctgacttgagcaagcagctcattagtgtaatcattggactcggcgtcgcgctgttgttggtcctggtgatcatgactatggccttcgtctgcgtaagaaaatcttataacagaaaactccaagccatgaaagctgctaaagaggcccgcaaaacagccgctggcgtcatgcccagcgcccccgccatcccaggtactaacatgtacaatactgagcgtgccaatcccatgctgaaccttcccaacaaggaccttggactggagtatcttagcccatccaatgaccttgattccgtgtccgtaaactccttggacgataattccgtggacgttgataagaacagccaggaaatcaaagaacatcgtccgccccatacgccacccgagcctgaccccgaacctctttctgtggtgctgttggggcggcaggctggcgcatccggccagctggaaggaccatcttatactaatgcaggcctggatactacggatttgtag

SEQ ID NO: 24700 - DNA, 3933 bp, Artificial Sequence
  Description of Artificial Sequence: Synthetic coding sequence
atggcgcagctttggctgagctgttttcttctcccagccctcgtggtgtccgtggccgcaaacgtggcacccaagtttctggcaaacatgactagtgtgatccttccagaggatctcccagttggggcacaggctttttggctggtcgctgaggatcaagataatgaccctttaacatacggaatgagcggtcccaacgcttactttttcgcagtgaccccaaaaaccggggaagtgaagttggcttccgccctcgattacgaaacactctatacattcaaggtcaccatatccgtgagcgatccttatatccaggttcagcgcgagatgttggtcatagttgaggacagaaatgataacgctccggtattccagaatacggcattctctacttctattaacgagacgctgccagttgggtctgttgttttttccgtgctggccgtagacaaagatatgggctccgcaggaatggttgtgtattctatagagaaggtgattccttccaccggtgactcagaacatctctttaggattctcgccaacggaagcatcgtgctgaacgggtctctgtcctataataacaaaagtgctttctaccagttggagttgaaggcttgtgacctcggcgggatgtatcataatacctttaccatccagtgttctctgcctgtgttcttgtccatttctgtcgttgatcagccggacctggacccacagtttgtccgcgaattttactccgctagcgtggcggaagacgccgcgaaaggcactagcgtactgaccgtagaggccgtggatggagataaaggaatcaacgaccccgtcatttattccatcagttattctacaagaccgggctggttcgacatcggggctgacggtgtgatcagggtgaatggctcactcgatagagaacaacttttggaggccgatgaggaagttcagcttcaggtgactgccaccgagactcatctgaacatctacgggcaggaagcgaaagtttcaatttgggtgactgtgcgcgtaatggatgttaacgaccacaaaccagagttctacaactgttcccttccagcctgtacattcacacctgaagaggcccaggtcaattttacgggctatgtggacgaacatgcatcaccacgcatccctattgacgatttgactatggtggtgtacgatcccgacaagggttcaaacgggacttttttgcttagtctgggggggcccgatgccgaggctttcagcgttagcccagagcgggccgtaggctctgcttctgtgcaggtgctggttcgggtgagcgccctggtcgactacgagcggcagacagcgatggcagtgcaggtggttgccacagacagtgtgagtcagaatttttcggtggccatggtgacaatccatctgcgggatattaatgaccatcgacctacctttccgcagagcctctatgttttgaccgtgcccgaacacagtgccactggatccgttgtgaccgacagcattcacgctaccgacccagacacaggggcttggggacagatcacatacagcttactcccaggcaacggcgccgatctgtttcaagtggacccagtgagtggcaccgtgacagttcgtaacggcgagctgttagaccgtgaatcacaggctgtgtattacctcaccttacaggcgaccgacggcgggaacctgagttcctcgaccacactgcagattcacctgctggatattaacgataatgcgcccgtggttagtggttcatataacattttcgtacaggaagaagagggtaacgtttcagtgaccatccaggcccacgataacgatgagcccggtacgaacaactcacgattgctgtttaatttgctgccaggcccgtactcacataatttttcgcttgatccagacaccgggttactgcgtaatttaggaccacttgaccgagaagccatagatcctgctctcgagggccggattgtcttgaccgtactggtgtctgattgcggtgagccagtcttgggcaccaaagttaatgtaaccataactgtggaggatataaatgacaatctgccaatttttaaccaaagttcctataattttactgtaaaggaagaagacccgggagtgcttgtgggagtggtaaaggcttgggacgcggaccaaacagaagccaacaacaggatatccttttcgttgagcggctccggggcaaactattttatgataagagggctggtgctgggcgcgggctgggctgaggggtacctccggctgcctccagacgtttctctggactacgagactcagccagtctttaatctgactgtgtccgccgagaatccagatccgcaaggcggggagaccatagtggacgtgtgtgtgaacgttaaggacgttaacgataatcctcccaccctggacgtcgcctctctgagggggattagagtggccgagaatggaagccagcatggtcaggtcgccgttgtggtcgcctcggatgtggatacgagtgcccagctcgaaatccagctggtaaatattctgtgtaccaaagctggcgtggacgtgggaagcctctgctgggggtggtttagcgtcgcagctaacggaagcgtttatatcaatcaatccaaggcaatcgactatgaagcctgtgacctcgtcacgctggtggtgcgcgcatgtgaccttgcaacagaccctggatttcaggcttacagcaataatggatcactgttgataactattgaggatgtgaatgacaatgcaccatatttcctccctgaaaacaaaacgtttgttattattcctgaactcgtgctacctaatagggaggtcgcaagtgttagagcccgggatgacgatagtggcaacaacggagtgatactctttagtatattgagggtggactttattagcaaggatggagcaacgattccgttccagggggtcttttcaatctttaccagttctgaagccgatgtgtttgcaggcagtatccagcccgtgaccagtttggactctacattgcagggaacctatcaagtgactgtgcaggccagggacagacccagcttgggtccctttttggaagccaccaccacgctgaatctgttcacagtggatcagtcctatagatctagattgcagttctcaacacccaaagaggaggtcggggccaatcgccaagccattaacgcagccctcactcaggccactcggaccaccgtctacatcgtggatatccaggatattgacagcgctgctagggcgcggcctcacagctacctcgacgcctattttgtgtttcctaacggctcggcgctcaccttggacgagttgtcggttatgatccggaacgaccaggattctctgactcagctgctccagctgggcctggtggtgcttggaagccaagagtcccaggaatcagatttgagtaagcaactcatctcggtaatcattgggcttggggtggcccttctccttgttttggtgatcatgaccatggctttcgtttgtgttcgtaaatcttataaccgtaagctgcaggctatgaaagccgccaaggaagcgaggaaaacggctgcgggcgtcatgcctagcgctccagcaatcccgggcacaaatatgtacaataccgagcgcgctaaccctatgctgaatctgcccaacaaagatctaggcctcgagtacctaagcccctctaacgacctggacagtgtctccgtaaactcattagatgataactctgtggatgtggacaagaacagtcaggaaatcaaggagcaccgaccaccacacaccccacccgaaccggatccagagcccctgagcgtcgttctgctgggtaggcaagctggtgccagtggacagctggaagggccaagttacacaaacgccgggctcgacaccactgatctatag

SEQ ID NO: 24701 - DNA, 2658 bp, Artificial Sequence
  Description of Artificial Sequence: Synthetic coding sequence
atgcaggaggcgatcatcctcctagctttgttaggggctatgagcggcggcgaggccttgcatttaatattactcccagccactggcaacgtcgctgaaaattcaccaccagggacctcagttcataaattctcagttaaactgtccgcctctctgagtcccgtgatacccggttttcctcagatcgttaattcgaatccactgactgaggccttcagagtcaactggttaagcggcacatactttgaggtggtgactactggcatggaacagttggacttcgaaacgggtccgaatatattcgaccttcagatttacgtgaaagacgaggttggcgtcaccgatcttcaggtgctgacggtacaggtcacagacgtgaatgagcctcctcagttccagggtaacctagctgaaggcctgcatctgtacatcgtcgaacgcgcaaaccctggtttcatctatcaggtcgaggctttcgaccccgaggacacttctcgtaacatccctttgtcctactttctgatctcacctcctaagagcttccgtatgtcggcaaatggcactcttttttccacaaccgaactcgatttcgaagctggacataggtcttttcacctcatcgtggaagtgagggactctggcgggctcaaagcttccacagagcttcaggtgaacattgttaatctcaacgacgaagtgccccggttcacctcccccaccagggtgtataccgtcctggaggaactaagtcccgggactatcgtggcaaatattactgccgaagacccagatgatgagggttttccctcccaccttctctattccattacaaccgtctcaaagtatttcatgatcaatcagcttacggggacgatccaggtggcacagaggatcgatagagacgcgggagagttgagacagaaccccaccatcagtttagaagtgctcgtgaaagataggccttatggagggcaagagaaccgcatccaaattacattcatagtagaggatgtgaacgacaatcctgctacctgtcagaaattcacattctcaataatggtgccagagcgcaccgcgaaaggcacactactattagacttgaacaagttctgttttgatgatgattctgaggcacccaacaataggttcaatttcacgatgccctctggagtggggtccgggagtagattcctgcaagacccagccggcagtgggaagattgtcctgataggcgaccttgactatgaaaacccaagtaatctggccgctggtaacaaatacactgttatcattcaggtgcaggacgtggcacctccgtactataagaataatgtttacgtgtatatcctgacctctccggaaaacgagttccctcttatattcgaccggccttcttacgttttcgacgtgagtgaaaggcgaccggctagaacaagagttggacaagttagagcaacagacaaggacctccctcagagcagcttgctctattctatttccacgggcggtgcctccttgcaatatcctaacgtgttttggatcaatcctaaaaccggagagctgcagttagttactaaagtcgactgcgaaaccactcccatttacatcctccgcatccaggctacaaataacgaagataccagcagtgtgacagtgacagtgaatatcttagaggaaaacgacgagaagcccatctgcaccccaaactcctatttcttagcccttcccgtcgatctgaaggtgggtacaaatatacaaaacttcaagctaacttgtacagacctggactcgagtccccggtcattccggtatagtatcggcccaggtaatgtcaataatcatttcactttctcgcctaatgccggctccaacgtcacccggctcctgctgacttcccggttcgactatgccggaggttttgacaaaatttgggattataagctcctcgtctacgttaccgacgacaatctaatgagtgatcggaagaaagccgaggccttggtggaaaccggaaccgtgaccctgtcaatcaaggtgataccccatccgacgacaattattaccaccactccaagaccccgcgtaacataccaggtattaaggaaaaacgtttatagtcctagcgcctggtatgtgccgtttgtgataactttgggtagcatccttctgctgggcttgctcgtgtacttggtagttctgctcgccaaagccatccacagacattgcccttgcaagaccggcaaaaacaaagagccactgacaaagaaaggggaaacaaagacagccgaacgcgacgtggtagtcgagacaattcaaatgaacactatcttcgatggggaggctattgatccagtgacaggcgagacctacgagtttaacagtaagactggagcgaggaaatggaaggatcccctgacacaaatgcctaagtggaaagagtcgagtcatcagggcgccgcaccccgacgagtcacggcgggcgaaggcatgggatccctcagaagtgccaattgggaggaggatgaactgagtgggaaggcttgggctgaggacgctggtcttggatcacgaaatgaaggcggaaagctgggcaacccaaagaaccgtaaccctgcttttatgaaccgggcctatcccaagcctcacccgggcaagtag

SEQ ID NO: 24702 - DNA, 600 bp, Artificial Sequence
  Description of Artificial Sequence: Synthetic coding sequence
atggtcctgctgaggctgcttgtatttctgttcgcccctgtggtcagcgacctgtgctctttgccgtgcttcatcaatgtcagcgagagccagggtcctggtacagtcctgcaattcttgagtttcaattgtagtagctatacacctactcctacattggaactgctcaacgtacagccccctacaacattctttaaccctcccagcctggctagatggcaagggacgtacgtgggcaagctgaccctttcttcctctgcccagctggatgcactaatggtaaatcattacaaggtacagctgaagttcacctgcgggaaccatgttatggaggggagcttatctgtggacgttcaacgtgacctgagtcacatccagtgcgcgggtcagttcgcaagtcccggcgaagctcgcggatccaggcaggggggaggacgtcatggattatccagaagttcacttacctctacattagcttcatggggcaacgattcaggcgcccgcgatagccacacctggggatccgccgtgcattccgcaccgccccgaccgaggacgccccgatccgcaggtaagcccaggacatgggatgggggatag

SEQ ID NO: 24703 - DNA, 2367 bp, Artificial Sequence
  Description of Artificial Sequence: Synthetic coding sequence
atggtattacttagattgcttgtctttctgtttgctcctgtcgtttccgatctgtgcagtctgccttgctttatcaacgttagcgagagccagggtccaggcacggtgcttcagttcctttcctttaattgctcgtcatataccccaacaccaacgctggaactcctgaatgtgcagccacccacaaccttcttcaatccaccctctcttgcccgatggcaggggacctacgtcggaaagttgacattgagcagcagcgcacagctggatgccctaatggtgaatcactacaaggtgcagctcaagtttacttgtgggaaccacgtgatggagggaagtctttcggttgatgtgcaacgcgatctgagccacatccagtgcgctgggcagtttgcctcacccgccggcgagatgatccaggtccccgagactgttacacctggagcgagactatatactctgttgctaccaggcctggaactccatggagcgcagatgtccataatctctgcacaggacctgccacattttcctgggccgtttagtattaacgaacagggttggctgcaagccccctcacaaggcttgttgggccaggctcagaaggtgtttcagttgcagatttcagtctccttcgggcagagacaaagttgtcagggcatggttatagtaaaagtgctccccgtaccttcttctcaggtttccttcctggagcaggcccagaacatcacgatacctgagaatctcgcccctggttctgaggtcgtgcaggtccaggccagaggagtcgatctccggtacgaaattctgtctccggttcccagccccctgttctctattgggagagctgatggtgttgtcagaactaccacgcctctggaactggccagaacttctggaactgccgtgtctcgcctgcaagtgaaagcctttgagcagggccagctgtgggcaagtgccaagttaaatcttactatgaatgtccagctggtcaatctttggcctcccagatgtctacccgctctgttggttagtcaaatcccggagaccgcccctgtggggacagtgctcaacactctgacatgtgaggatcccgactccgttggcgcaactttagattataaactgtggttcagatcctcttccaatccagcaagcctctgcctttacgatcgagtcctagaagtgaacgccactcttgattgtgacactcccggagcatgtttccaacatgccgccagtatcctcgtgctcgatggtggacagccacagatgacaactgaagttccagtgttggtgatggtgacccctattaatgaattttcaccagcgtgtgccccacggacctttagggtgcaggaggacgcagcgccacacacgctgctcgggagcgtggtcggcactgacatggattatcctcacgataacatcgaatattacacttctgggggccccaccacttttgccgtggacaggctgagtggcgaagtgcacctgctcggcccactagactacgaacagcagcggctgtacagactcacagtgctggtgatcgatcacggacaggatcagaatcccaaccaccatttaagtggttcttgcacaatcaccatagaggtggaggacgtgaacgaccacgcacctgagtgcgagccccccttccaagaactgactatatacgcgcctcttgggcgctccgtggaagtgacaaaaatgagttgccaaatccctcaagagcctcaacgcttaatctatagctatagtatcgtgggtgggaatagccagaacagattcatcctgcagggcgccatactggtccactctgatctagtgctgggccctttttggccagagcagccaaggacttatgagctgctgatctgcgtggcagatgccggaccgagcactccgcacttatctaccaccgcaactatcattgtgcacctggttcctaggcgagcctctactgtggctaccagcactcacaggacaaccgttccctccacaatgaccccgatgctggtgacagataccgaggctttttggcagccacagccctggtttgtggtcgtactgactgcaaccggagcattgctactgctggcgctgggctggctgctaggccggctcctgcagggactggcacaactgctgcaagcaccaagcaaacccgcccaggccctacttttgaacagtatccagggaaccgagggcagtattgaggggtttttggaggcccccaagatggagatgagccaggctccctcctctgtgatgtcgcttcattttgatgggagagcccaggacagccggaccgggagagactatctcttcaacactcacacaggggctcggcgatggctatag

SEQ ID NO: 24704 - DNA, 684 bp, Artificial Sequence
  Description of Artificial Sequence: Synthetic coding sequence
atgggcaattgcgttaagtatcccctccggaatctctctagaaagatgtgccaggaggagcaaacctcttacatggtcgttcaaaccagcgaagaggggttggccgccgatgccgaactgcccggcccactcctgatgcttgctcagaactgtgctgttatgcacaatctgctcgggcccgcttgtattttcctgcgaaagggtttcgccgagaatcggcagcccgacagatctctgaggcccgaggagatcgaggaattgcgcgaagcctttcgcgagtttgacaaggacaaggacggatatattaattgtagggatctcgggaactgtatgaggaccatggggtacatgcccacggagatggaactaatcgaattgtcacagcagattaacatgaacctcggcggacacgtcgactttgacgattttgtcgaattgatgggccccaagctcctcgccgaaaccgccgatatgattggagttaaagaattgagagatgctttccgcgaatttgacacaaatggagacggagagatctccacaagcgaacttcgagaggccatgagaaaattgctcggtcaccaggtgggccacagggacattgaggaaatcatcagagatgtggacttaaatggggacggccgtgttgacttcgaagaattcgtaagaatgatgtctaggtag

SEQ ID NO: 24705 - DNA, 1113 bp, Artificial Sequence
  Description of Artificial Sequence: Synthetic coding sequence
atgggtggcggcgatggcgccgctttcaagcggcctggcgacggagcaaggctacagcgcgtactgggactcggcagcagacgggaacctcgatcactgcctgccgggggacctgcgccccgtagaacagcaccccctcctcctggccatgctagcgccggtcccgctgctatgagctctcatattgccaaatccgaatcaaagacatccctgctgaaggcggcagcagcagctgccagtggaggaagcagggcacctcgacatggtccggcccgggatcctggattgccaagcaggcggctgcccgggagttgtccggccacgcctcagagctcgggcgacccatcttctcggagaccactttgccggccggcgcccagggaggagggggcacgcgggtcgcagcgtgtgctgccgcaagcacattgccgaccaagggaggcgctccctgcagccgcctcaaggccaagtcccagcagccctctgccacccgctagaggaagagatggagaagaacgcgggctctcgcctgccttagggctccggggttcacttagggccaggggtagaggtgatagtgttccggcagctgctagtgaagcagacccatttctccataggctgaggcctatgctgtccagtgcattcggccaggaccggagcctgcggcccgaggagatagaagaactgagggaggcattcagagagtttgataaggataaagatgggtatatcaactgccgcgaccttggaaattgcatgcgaacgatgggctacatgcccacggagatggagctaatcgaactgtcgcaacagatcaacatgaacctgggcgggcatgtcgacttcgacgactttgtggaacttatgggacctaaactgcttgccgaaactgccgatatgatcggcgtaaaggagctccgcgacgccttcagggagtttgatactaacggtgatggagagatctctactagtgaattaagagaagccatgcggaagctgttgggtcatcaggttgggcaccgggacatagaggaaatcatcagagatgtggacttgaatggagacggacgggtcgacttcgaggagtttgttagaatgatgagtcgatag

SEQ ID NO: 24706 - DNA, 504 bp, Artificial Sequence
  Description of Artificial Sequence: Synthetic coding sequence
atggggaactgtgttaagtaccctctccgcaacctttccagaaaggatcgttccctgcggccagaggagatagaggaactgagagaagcctttcgtgaattcgataaagacaaggatggttacattaattgtcgcgatctcggcaattgcatgaggaccatgggatatatgcccactgagatggaattgatcgaactttcgcagcagataaatatgaacctgggtggccatgtggattttgatgacttcgtagagctgatgggacctaaacttctggcagagaccgctgacatgatcggcgtgaaggagctgcgagacgccttccgagagtttgataccaacggcgatggggagatatccacttcggagctgcgcgaagcaatgaggaagctgctaggccaccaggtcggacatcgggacatcgaagagatcatccgggacgttgatctaaacggggatggcagggtggacttcgaggaatttgttcgtatgatgtctcgatag

SEQ ID NO: 24707 - DNA, 1266 bp, Artificial Sequence
  Description of Artificial Sequence: Synthetic coding sequence
atggtggagatgctcccaaccgcaattctgctcgtgctagcagtatcagttgtggcgaaggataatgcaacgtgcgatgggccatgtggattaaggttcagacagaatccccaaggaggcgtccgcatcgtgggcggcaaggccgcccagcatggagcctggccctggatggtgtcccttcagattttcacctacaatagtcatcgataccacacatgcggcggttctctactaaattcccgatgggtactcacagcagcacactgcttcgttggcaaaaacaacgtacatgactggcgcttggtgttcggcgcgaaggagatcacttacgggaataacaaacccgttaaagcccccctccaggaacggtatgtagaaaagattatcatccatgagaagtacaatagcgctaccgaaggaaacgacattgctctagtcgaaatcacacccccaatctcttgtggtcgatttatagggcctggatgtttaccccattttaaagctgggcttccccggggttctcagagctgctgggtcgcaggttggggctatattgaggaaaaagctccacgcccttcctctatcctcatggaggctcgggtggacctcatcgatttagacctttgcaactcgacccagtggtataacgggcgtgtgcaacccactaatgtctgcgccggatatcccgttggcaaaatagacacttgtcaaggcgactccggcggaccgctaatgtgtaaagacagcaaggaaagcgcctacgtcgttgtcggcattacgtcttggggagtaggttgtgctcgcgcaaaacgacccggcatttacacagcaacctggccgtatctcaattggatagccagcaaaataggctccaatgccctccgcatgattcagtccgccacaccccctcctccaaccacccggcctccccccatccggccgccgttttctcaccctattagtgctcatctgccatggtattttcagcccccaccgcgccccctgcccccgcgcccgccagccgcccagcccagacctccacccagcccaccgccccccccgccaccacctgctagcccattgcctcccccaccccctccaccccccccaacaccaagctccacaacaaagctgccacagggactctcttttgctaaacgtcttcagcagttgattgaggtcctgaaagggaagacatatagtgatgggaagaaccattacgacatggagactaccgagttgcccgaactgacaagcacatcatag

SEQ ID NO: 24708 - DNA, 3333 bp, Artificial Sequence
  Description of Artificial Sequence: Synthetic coding sequence
atggccgccgggtgcctgctggctctgacactgaccctcttccagtccctgttaattggcccctcaagcgaggaacctttcccgtccgccgtcacgatcaagtcgtgggtggacaagatgcaagaagacctcgttacactagctaaaacagctagcggcgtcaatcagctggtggacatttacgagaagtatcaggatctgtatactgtcgaacccaataacgcccgtcagttagttgagatcgcggctcgcgatatcgaaaaactgttaagtaataggtccaaggctctggtacggctcgccttggaggcagagaaagtccaagccgcacatcaatggagggaggacttcgccagcaatgaggtggtttactataacgccaaagatgacctggatcccgagaagaacgattctgaacccggctcccagaggattaaaccagtgtttatcgaagacgcaaacttcggccggcagatctcatatcagcacgctgctgtgcacatacccacggatatctatgaaggaagcacgattgtgctgaacgagctcaactggacatccgcactggatgaagtgttcaagaagaatagggaagaggaccctagcttgctgtggcaggtgtttgggtccgctacggggctcgcccgttattacccagcatccccctgggtggacaattctcgaactccgaataagatcgatctgtatgacgtacgccggcgcccctggtatatccaaggtgcggcctcaccaaaggatatgctgattttggtggatgtctccgggtccgtgtcagggctgacgctgaagcttattcggacctcagtttccgagatgttagagacactgtccgacgacgatttcgtgaatgtggccagcttcaacagtaacgcgcaggatgtgtcttgcttccagcatctcgtccaggcaaatgtgcgcaacaaaaaagtattaaaagatgctgttaataacattaccgccaagggtattacagactacaagaagggtttcagtttcgcattcgagcagctgctaaactacaacgtgtctcgagccaattgtaataaaattattatgcttttcactgacggcggcgaagagcgcgcacaggagatttttaataaatataataaagacaaaaaggtgagggtcttcaccttttctgtgggccaacacaattatgataggggtccaatccagtggatggcgtgcgagaataagggctactactatgagatcccatccatcggggcaattcggattaatacgcaggaatatctggacgttctgggaagacccatggtgttggcaggggacaaagcaaagcaggtacagtggacaaacgtgtaccttgatgccctggaattgggtctggtgatcaccggcacactgccagtatttaatattactggccaattcgagaacaagacaaatctgaagaatcaactcatcctgggggtcatgggggtggatgtgtccttggaggacattaagaggttaaccccacgatttaccctgtgtccaaatgggtactattttgctattgaccctaacggatatgtgttgttgcatcccaacctgcaaccgaagcctatcggcgttgggatccctactataaacctgagaaagaggcgacccaatatccagaatcccaagtcccaggaacctgttaccctggattttctggatgccgaacttgaaaacgacattaaggtggagatcagaaacaagatgattgacggcgagtctggtgagaaaacctttagaaccctggtcaaatcgcaagatgaacggtacattgacaaaggtaaccggacctatacctggactccagttaatgggacagattattccttggccctcgtgctacccacttactccttttactatatcaaggcaaaactcgaggaaacaataacgcaggcacgatgcaaatattgtgaacggagcgatagcgaaacactgaagcccgacaatttcgaggagagtggatacacctttattgccccgagagattactgcaatgacctgaagatcagtgacaataacactgaattcctgctgaattttaatgaattcatcgatcggaagactccgaataacccctcctgcaacgctgatttaatcaacagggttctgttggacgcgggcttcacgaatgagttggtccagaattattggagtaagcagaaaaatattaaaggggtgaaggcacggtttgttgtcactgatggagggatcaccagggtgtatccaaaggaggccggagagaattggcaggaaaatcccgaaacctatgaagactccttttataagaggtcccttgacaacgataattatgtgttcactgcaccctatttcaataaatccggcccaggcgcatacgaaagcggaattatggtgagcaaggcagttgagatatatatccagggcaaacttctaaaaccagccgttgtgggcatcaagattgacgtgaattcctggatcgagaacttcacaaagacatctatcagggatccctgcgcaggaccggtgtgcgactgtaagagaaactctgacgttatggactgcgtcattctggacgatggaggctttttattgatggctaatcacgacgactataccaatcagatagggaggtttttcggcgagatagaccctagcctgatgcgacacctcgttaacatcagcgtatatgccttcaataagtcatacgactaccagagcgtgtgcgagccaggcgccgcgccaaagcagggtgctggccaccggtccgcctatgtcccttccgtggcggacatactgcagattgggtggtgggctaccgctgctgcctggtctatcctgcaacaattccttctgtctctgacattcccgcgcttgcttgaagccgtcgaaatggaggatgacgactttacagcgtctctaagcaagcagagctgcatcactgagcagacgcagtatttctttgataacgattctaagtcgtttagcggcgtgttggactgcggaaactgcagtcgcatcttccacggcgagaagttgatgaatacaaacctgatttttataatggttgagtccaagggaacctgtccctgcgacacacgcctgttaatacaggctgaacagacttctgatggaccaaatccctgtgatatggtgaaacaaccccgctatcgcaagggacctgacgtttgctttgacaataatgtgctcgaggactatacggattgcgggggtgttagcgggctcaatccttccttgtggtatataattgggattcaatttctgctcctctggctggtaagcgggagtacacacagactgctgtag

SEQ ID NO: 24709 - DNA, 3312 bp, Artificial Sequence
  Description of Artificial Sequence: Synthetic coding sequence
atggcagctgggtgcttgctggccctgacgttaactctgtttcaaagcctcctgattggacccagttcggaggaacctttcccatccgcagtgactatcaagagttgggtggacaaaatgcaggaggacttagtgaccctggccaaaacagcaagcggggtgaaccaacttgtggacatctacgaaaagtatcaggacctgtatacggttgagcctaataatgcgcgccagctcgttgaaatcgccgccagggatattgaaaaattgttgagcaatagatccaaagccctagtcaggttagctttggaagctgagaaggtccaagctgcccaccagtggagggaggactttgccagtaacgaagtggtatactacaacgcgaaggacgatctggacccggagaagaacgattcggagccaggatctcaacggatcaagccagtcttcattgaagacgcgaactttggtagacaaatttcatatcagcatgccgccgtgcatatacctacagatatttacgaagggagcactatcgttctcaatgaactcaattggaccagcgctcttgacgaggtgtttaagaagaaccgagaggaggacccttcgctcctatggcaggttttcggctccgccactgggctggccagatattacccggcaagcccatgggtcgacaactccagaaccccgaacaagatcgacttatacgacgtccggcgtcgaccatggtatatacaaggggcagcaagccctaaggacatgctgattctggtcgacgtgagcggcagtgtaagcggactcactctcaaattaatccgcacttccgtgtcagaaatgctggagacactatcagacgacgatttcgtgaacgtggctagctttaactccaacgcgcaggacgtatcgtgctttcagcatctggtccaggccaacgtccgaaataagaaggtgctgaaagacgctgtcaacaatattacagccaagggcatcacagactataagaaaggctttagctttgcttttgagcaacttctgaactacaatgtaagccgagccaattgtaacaaaattattatgctgtttaccgatgggggggaagaacgcgcccaggaaatttttaacaagtataacaaagataagaaggtgcgcgtctttaccttcagcgtcggccagcacaattacgatcggggacccatccaatggatggcttgcgagaataaagggtattattatgagattccctcaattggtgcaatcaggataaacactcaggaatacctagatgttcttggacgtcctatggtgctggccggcgacaaagccaagcaagtgcaatggactaacgtgtacctggacgcactggagcttggtctggtaataactgggaccctgccagtatttaacatcacagggcagtttgagaacaagacaaatctcaagaatcagctaatcctgggcgtgatgggcgttgacgtaagtttggaggatataaaacgactcacgcccaggttcacgttgtgccctaatggatactattttgctattgacccgaacggatatgttttgctccatccgaacctacagccaaaacccatcggagtggggatcccgactattaatttacgaaaaagaaggcccaatatacagaatcccaaatctcaagagcccgtcacactcgatttcttagacgctgagttagaaaatgacatcaaggtcgaaatcagaaataaaatgattgatggagaatcgggggaaaaaacgtttcggacactggtaaagtcacaggacgagcgatacattgataaggggaaccgtacttacacttggacgcccgttaacggcaccgactatagtttggctttggtgctgccaacatatagtttttactacatcaaagccaaactggaggagactatcacacaggcaagatattcagaaactctcaagccagataatttcgaagaatctgggtacacctttattgccccccgtgactactgtaacgacttgaagatcagcgacaacaatacagagtttttactcaacttcaacgagttcatagatcgcaagacacctaataaccccagttgtaatgcggacctgatcaatcgtgttctcctggacgccggcttcaccaacgagcttgttcagaattattggtcaaagcagaaaaacatcaaaggcgtaaaagcgcggtttgtggttacagatggcggcataacccgggtttatccaaaggaagccggagaaaattggcaggaaaatcccgagacatacgaggacagcttctataagcggtctctcgacaacgacaactatgtttttaccgctccatacttcaacaagtcaggccctggtgcatatgagagcggcattatggtgtccaaggctgtggagatctacatccaggggaaacttctcaagccagccgtagtgggaatcaagattgatgtcaatagctggatcgaaaactttaccaagacaagtatcagagacccatgcgccggacctgtgtgtgattgtaagcgcaactctgacgtaatggattgcgtgattcttgacgacggggggttcctacttatggcgaatcacgacgactacacgaatcagattggccggttcttcggtgaaatcgacccctcactgatgaggcatctggtgaatatctctgtttatgcctttaataagtcctatgactaccagagtgtgtgtgagccaggtgccgccccaaaacaaggggccggccacaggagcgcttacgtgcctagcgtagctgacatcctccagattggatggtgggctacagcagccgcctggtctatattgcaacaattccttctgtcacttaccttcccacgactgttagaagccgttgagatggaagacgatgacttcaccgctagcttgtcaaagcagtcttgtattaccgagcagacccaatatttcttcgataatgatagtaagtccttcagtggggtgctggactgtggtaattgttctaggattttccatggcgaaaaactcatgaacacaaatctgattttcattatggtggagtccaagggcacctgcccatgtgatacccgattactgatccaggctgagcaaacgtccgatggaccaaacccttgtgatatggtgaagcaaccacgctacaggaagggccctgatgtttgcttcgacaataatgttctcgaagactacacagattgcggtggtgtgagcgggttgaatccgagtttgtggtacattatcggcatccagttcctgctgctgtggttagtgtctgggagcacccatcgccttttgtag

SEQ ID NO: 24710 - DNA, 3276 bp, Artificial Sequence
  Description of Artificial Sequence: Synthetic coding sequence
atggccgccggatgtctgctcgcgttgacccttaccctgttccaatcattgctgattggaccatcctccgaggagccattcccatccgccgtgaccatcaagtcatgggtggataagatgcaagaggatctggtcacactcgccaaaacagcttcaggcgtcaaccagctagtggatatttatgaaaaataccaggatctgtacacggtcgagcccaacaatgcacgccagctggttgaaattgcagctagagatattgaaaagcttttgagtaacagaagcaaagctctggtgcgattggcactggaggcagaaaaggtccaggccgcacaccagtggcgggaagacttcgccagcaacgaagttgtctactataacgctaaggacgaccttgacccagagaagaatgatagcgagccaggatcccagcgtatcaagccagtttttattgaagatgccaattttggccgtcagataagctaccagcacgcggccgtgcacattcccacggatatttatgagggttcgactatagtgctgaatgagctcaattggacaagtgcactggacgaagttttcaagaaaaatcgggaggaggacccttccctgctttggcaggtgttcggatcagcaactggattagctagatactatccggcctccccgtgggtcgataactcacggactccaaataaaattgatctgtatgacgtacggcgccggccttggtatatccagggcgcagcgagccctaaggatatgctgatcctggtggatgtctcgggaagtgtgtctggtttgacactaaagcttatacgcacttctgtgtcagagatgctggagacgttgagcgacgacgatttcgtgaacgtggcgtcattcaatagtaacgcccaggatgtaagctgttttcagcacctggtgcaagcgaatgtaaggaataagaaggtactgaaggatgccgtaaacaatattaccgccaagggaatcacggattataagaaaggattctcttttgcctttgagcagctgctaaactataacgtgtctagggccaattgtaacaaaattattatgctttttaccgacggtggagaggaacgagctcaggagatcttcaacaagtataataaggataaaaaagtaagggtatttaccttctcagtcgggcaacacaattatgatcggggtcctatccaatggatggcctgtgaaaacaaggggtattactatgaaattccgtcgatcggcgcgatccgcattaatacgcaagagtatttagatgtcttgggccgccccatggtgctagccggggacaaggccaagcaggtgcagtggaccaatgtttacctggatgcactggagctagggctggtgatcaccggaactctgccagtgtttaacatcacaggacagtttgaaaataagacaaatttgaagaaccagctgatcctgggcgtgatgggcgtggacgtgtctctagaggatatcaagagactcaccccacgttttaccctgtgccccaacggttattattttgccatcgacccaaacggctatgttctgctgcacccgaatctgcagcccaagaaccccaagagccaggagcctgttacactcgacttccttgatgcagaattagagaacgacatcaaggttgaaatccggaataagatgatcgatggcgaaagtggagagaaaacatttcggaccctagtcaagtcgcaagatgaacggtatatagataaaggcaatagaacatatacatggactcccgtgaacgggaccgactactcgttggctctcgttctgccgacttactccttctactatattaaggctaagctcgaggaaacaattacccaagcgcgctctaaaaaggggaaaatgaaggattccgaaaccctgaaaccggacaattttgaggaatcgggatacacttttatcgcacctcgggactattgcaacgacctgaagatctctgataacaataccgagttcctgctgaactttaatgagttcatcgaccgaaagacccctaacaatcccagctgtaacgcagacctgatcaacagggtactgctagatgccggcttcaccaatgaattagttcagaattattggtccaaacagaaaaatatcaagggcgtaaaggctcgcttcgtggtgacagacggcggaattacaagggtttatcctaaagaggctggagagaattggcaggagaaccctgagacatacgaggacagcttttataagcgttccttagacaacgataattatgtgttcacagcgccatatttcaataagtctggcccaggcgcctacgaaagtggcattatggtcagcaaggccgttgaaatttatatccagggaaaactgttaaaacctgcagtggtgggcataaaaattgatgttaatagctggatcgagaattttacaaaaacctctattagagacccatgcgcagggcctgtgtgcgactgtaaacggaactccgatgtgatggattgtgtgattctagacgacggaggtttcctcttaatggctaaccacgatgactacacaaatcagataggacgcttctttggcgaaatcgacccatcactgatgaggcatctggtaaatatctctgtgtatgcctttaataagagctacgattatcagtcagtgtgtgaacccggagccgctccgaaacagggcgctgggcacaggtctgcttacgtcccatccgtggctgacattctgcagatcggatggtgggctacagccgccgcttggtccatcttacagcagtttctgttatccctgacatttcctaggttattagaggctgtagagatggaagacgacgatttcacagcttctctgagtaaacaatcctgcattaccgaacagacccagtatttcttcgacaatgactctaaaagttttagcggggttctggactgcgggaactgcagcagaatctttcacggggagaaactgatgaatacaaacctcattttcattatggttgagtctaaaggaacctgcccatgtgatacgcggctgttgatccaggctgaacaaacttcggacggcccgaacccttgcgacatggtgaaacagcctcgctaccgaaaggggccagacgtttgctttgataacaatgttctcgaggattacaccgattgtggaggggtgagcggattgaatccaagtctttggtacattatcggcatccaattcctcctactatggctggtgagcggttctacgcaccggctcctgtag

SEQ ID NO: 24711 - DNA, 912 bp, Artificial Sequence
  Description of Artificial Sequence: Synthetic coding sequence
atggtcggactccctgagtttatcccaaaaatcgtgggcatcaagattgatgtcaacagctggatagaaaattttacgaagacatctatccgagatccctgcgccggtcctgtttgtgattgtaagaggaatagcgacgtgatggattgcgtgatcctagacgacggcggcttcctccttatggcaaaccacgacgactacactaaccagataggtcgattttttggtgaaatcgacccgtccctaatgcgccacctggtgaacatatctgtgtacgccttcaataagtcatatgattaccagtctgtatgcgagcctggtgctgctcccaagcagggtgctggacatagatcggcttacgttccctccgtcgccgacattttgcagattggatggtgggctactgcagccgcctggagtatcttgcagcagtttctgctgtctctcacctttcccagactactggaggctgtggaaatggaggatgacgacttcaccgccagccttagcaagcaaagctgtattacagagcaaacccagtattttttcgataatgattctaagagcttctcaggggttctggattgtggcaattgctcacgcatttttcacggggagaaacttatgaataccaacctgatcttcataatggttgagtccaagggaacctgtccatgcgatacgcggctgttaattcaggcagagcagacctccgacggccctaacccgtgcgatatggttaagcagccgaggtaccggaaagggccagatgtgtgcttcgataataatgtgctcgaagactataccgactgtgggggggtgtcaggactgaatccctcactttggtacatcataggcattcagttcctgctgctttggcttgtatctggaagtacccacaggctgctttag

SEQ ID NO: 24712 - DNA, 984 bp, Artificial Sequence
  Description of Artificial Sequence: Synthetic coding sequence
atggtccggtgtgaccggggccttcaaatgttgcttacgactgccggagccttcgccgccttctccctcatggctatcgccatcggcaccgattactggctgtattcgagtgctcacatatgtaacggcaccaatctgaccatggatgatggaccccccccacggagagctaggggggatctgacccatagcggattgtggcgtgtgtgttgcatcgaggggatctataagggtcactgtttcaggatcaaccactttcctgaggacaacgactacgaccacgactcctcagaatacctgcttaggatcgtacgggccagtagcgtttttccgatcctctcaaccatccttctcctgctgggcggcttatgcattggcgcggggcgaatttactccagaaagaataacattgtgctgtctgccggaattctgtttgtggcagctgggctttccaacattatcggcatcatcgtatacataagcagtaacaccggtgatccaagtgataagcgagacgaggacaagaaaaaccattacaactacggatggtccttctactttggagctctgtctttcatcgttgcagagacggttggcgtgttagccgtgaatatctacatcgagaagaacaaagagcttcggtttaaaactaaacgggagttcttaaaggcttcctcctccagcccgtacgcacgcatgcccagctacaggtacaggcggcggcgctcccgctcgtcctccagatctacagaagcgtctccttccagagacgtctctccaatgggtctgaagatcacaggagctatccctatgggcgagctttcgatgtatacgctttcgagagaaccactcaaggtaactacagcagctagctattcacccgaccaagaagccagtttcctccaagtacatgacttctttcagcaagacctgaaggaagggttccacgtttctatgctcaatcggaggactactccagtttag

SEQ ID NO: 24713 - DNA, 6120 bp, Artificial Sequence
  Description of Artificial Sequence: Synthetic coding sequence
gagagggttgaatacctgttcctgatcatcttcaccgtagaagcctttctgaaagtgatagcatacgggctgttgttccaccctaatgcttatctcaggaacggatggaatctattggacttcatcatagtggtggtggggctgttctcagctattcttgagcaggcgactaaggccgacggtgctaacgcactgggcggcaaaggggctggttttgacgtgaaggctctgagggcctttcgagtccttcgtccgctgcgccttgttagtggggtcccttctttgcaggtggtgctgaacagcatcatcaaagccatggtgcccctcctccacattgctctattggtgctgtttgttattataatctatgccattatcggcttagagttgtttatggggaagatgcacaaaacctgctacaaccaggaaggcattgccgacgtgcctgccgaagacgacccctcaccgtgtgcactcgaaacaggtcacgggaggcagtgtcagaacggcacagtgtgcaagcctgggtgggatggccccaagcacggtatcactaacttcgataacttcgcattcgctatgctgaccgtgttccagtgtatcacaatggaggggtggaccgacgttctttattggatgcaggacgccatggggtacgaactgccatgggtctattttgtgtcgctcgtgatcttcgggtccttcttcgtgcttaacctcgtactcggggttctctcaggcgaattcagcaaggaacgcgaaaaagccaaagctcgtggcgattttcagaagttgagagagaaacagcaactggaggaagacctgaaaggatatcttgactggataacacaggcagaggacatagatccggagaacgaagacgaaggcatggatgaggaaaagcctcggaacatgtcgatgcccacatctgagactgaatccgttaacactgagaatgtggcaggaggcgacatcgagggtgagaattgtggagctcgcttggcacatcgtatttcaaagtccaaattctccaggtattggagacgttggaaccgcttttgccgacggaaatgtcgcgcagcagttaaaagtaacgttttctattggctggtgatctttctcgtctttctgaacaccctgactattgctagcgagcactataaccagcccaactggctgaccgaggtccaagatactgctaacaaggctttgctagccttgtttaccgcagagatgctcttaaagatgtatagccttggtcttcaggcctattttgtctcactgtttaacagattcgattgtttcgtggtgtgtggtggtattttggaaaccatcttggtggagacgaagattatgtcccccctcggcatctcggtcctaagatgcgtacggctccttcgtattttcaaaatcacaagatactggaattcactatccaatcttgtggcctcgctgctgaacagcgtgagatccatcgcctcactccttctgctgctgttcctgtttatcatcatattctcattgctgggaatgcaactcttcggagggaaatttaacttcgatgagatgcaaactcggagatcaaccttcgataattttccacaatccctcttgaccgtcttccagatcctgacaggtgaagactggaattcggtgatgtacgatggtataatggcttacggaggaccatcctttcctggcatgcttgtctgtatctatttcataatcctcttcatatgcggcaattacattctattgaacgtgtttttggctatcgccgtggacaacctcgctgacgcggagagcctgacctcagcacagaaggaggaagaggaggaaaaagagcggaaaaaactagctcggacagccagtcccgagaagaagcaggagctcgtcgaaaagcccgccgtgggcgagtcaaaagaggagaaaattgagctcaagtctatcacagccgatggtgagagccccccggcgactaagattaatatggatgatcttcagccaaacgaaaacgaggataagtctccctaccccaatccggaaactaccggtgaagaggatgaagaagagcccgagatgcctgtaggccctaggcctagacccctcagcgagctacacctgaaggaaaaggccgtgcccatgccggaggcgagcgcctttttcatattttcctcaaacaaccgcttccggcttcagtgccacagaatcgtgaacgatacgatcttcactaatttgattctgttctttatcctccttagctctatttccctcgccgctgaagatcccgtccagcatacctcatttcggaaccacattcttttttactttgacatcgtcttcacaaccatcttcaccatagagattgctcttaagatgacggcttatggggcctttctacacaaagggtcattttgtcgcaattatttcaacatcctcgatctcttggtggtgtcagtgtcccttatatccttcgggattcagtcgtctgcgataaatgttgtgaagatcctgagagtcctgcgtgttcttcggccgctgagggccattaatcgggcgaagggcttaaaacacgttgtgcagtgtgtttttgtggccattcgcaccatcggcaatatagtgatagttactactcttctccaattcatgtttgcttgcatcggggtccagctgttcaaggggaagctgtatacctgttctgattcatctaagcagaccgaggccgaatgcaaagggaattacataacatacaaggatggagaggttgatcatcctatcatccagcctcggagttgggagaatagtaaattcgactttgacaacgtgctggcggctatgatggccctattcacagtatcaacatttgagggctggcctgaacttctatataggtcaatcgacagtcacaccgaggataagggtcccatctacaattaccgagttgaaatcagcatcttcttcattatttacataatcattattgctttcttcatgatgaacatctttgtgggtttcgtgatcgtaaccttccaagagcagggggaacaggagtacaagaattgcgagctggacaaaaaccagaggcagtgcgtggaatacgccctgaaggcccgaccattgagacgttacatacctaagaaccaacaccagtacaaggtctggtacgtcgtgaattcaacctatttcgaatatttgatgttcgtcctcatattgctgaatactatctgtctcgccatgcaacactacggccagagctgtttgttcaaaatcgctatgaatatcctgaacatgctttttacaggcctgtttaccgtagagatgatcctaaagcttatagcattcaagcccaaacattatttttgcgacgcttggaacaccttcgatgcattgatcgtagtgggcagcatcgttgatatcgccataactgaggtcaataatgccgaggaaaacagcaggatcagtatcacatttttccgactgttccgagtcatgaggcttgtgaaactgctgtccaggggggagggaattcgcaccctgctctggacgtttattaaaagcttccaggctttgccttatgtggcactgctcatcgtgatgctgtttttcatatacgcagtgataggcatgcaggtcttcgggaaaatagcattgaacgacactactgaaatcaacaggaataataacttccagacctttccccaggctgttttgttgctcttccggtgtgccaccggggaggcttggcaggatattatgcttgcctgcatgcctggaaagaagtgtgctcctgaatcagagccttctaacagcacagaaggggagactccttgcggatcctccttcgctgtcttttatttcatctcattctacatgctttgcgcatttctcatcattaatctcttcgtggccgttatcatggataattttgactacctaaccagggattggtccattcttggcccacatcatttggatgagttcaagagaatttgggccgaatatgatccagaggccaaaggacgaatcaaacatctcgatgtggttactctgctacgcaggatacaacctcccttgggcttcgggaaactctgcccccaccgagtggcctgcaagcgtctggtttccatgaatatgccgctgaattcggacggtaccgtcatgtttaacgccacactctttgcactcgtcaggactgcactcagaatcaaaaccgagggtaatttggaacaggcgaacgaggagctgcgggccattatcaaaaagatctggaaaagaacctcaatgaagctcctggatcaggtcgtccccccggcaggggacgacgaggtcaccgtggggaagttctatgctaccttcctgattcaagagtacttcaggaagttcaagaagaggaaagagcagggtctcgtgggcaagccttctcagcgaaacgccttgagtctgcaggccggtttacgaactttgcacgatataggcccagagatcagacgagcgatttcaggcgacctgaccgccgaagaggagctagacaaggccatgaaggaagcggtgtccgcggcctcagaggacgacattttccgcagggccggggggttgtttggtaaccatgtctcatactaccagtcagatggcagatcagcctttcctcagacattcacgacgcagaggccactgcacattaacaaggccgggtcctcgcagggtgacacggagtccccctctcatgaaaagctcgtcgattctaccttcactccttcgtcctactctagcacaggcagcaatgcaaacattaataatgcgaacaacacagcactgggccgcttgccaagacctgccggctatcccagtactgtctcaactgttgaaggacatgggcccccactgagcccagccatcagagtgcaggaagtggcctggaaactaagttccaatcgcatgcattgttgtgatatgctggatggaggcaccttcccgccagccctggggcctcggcgcgctcccccatgtctacaccagcagctgcagggctctctggctggtctgagggaggacactccctgcatcgtaccaggccacgcttctctctgttgcagcagcagagtaggggaatggttgcccgccggttgtaccgccccccaacatgcaagatgccattcgagggaaagccaggccgctatggccggacaggaggagacttcacaggatgagacatacgaagtaaaaatgaatcacgacacagaagcttgttccgaacccagcctgctgtcaaccgaaatgctctcctaccaggatgacgagaacagacagctgactttaccagaagaggataagagggacatccgccagtctcccaaaagagggttcctgcggagcgcttccctgggacggagggcatcattccatttagagtgtttaaagagacagaaagacagaggcggggatatcagccagaaaaccgtgttgccactgcatctcgtacaccaccaagcactggctgttgcagggctatcccccctcctgcaacgtagtcattcacctgcgagcttcccccgaccttttgctacacctcccgccactccaggctctagaggctggccaccacagccagtgccaacactccgcctagagggagtggaaagtagcgagaagttaaatagttccttcccttcaatccactgcggcagctgggctgagactacccctgggggcgggggctcatccgctgcccgccgcgtacgccccgtgtccctgatggtgcctagtcaagctggcgctccgggaagacagttccatggatccgctagtagtctcgtggaggcagtactcatttcagagggcctggggcaatttgcacaggatccaaaatttatcgaggttaccactcaagaactggccgatgcctgcgatatgaccatcgaagagatggaaagcgccgcggataatatcctgtctggcggcgcaccccagagccccaacggagccctcctgccctttgtgaactgccgcgacgcaggccaggatagagcaggaggggaagaggatgctgggtgcgttagagcccggggcaggccttccgaggaggagctgcaggattcccgagtatacgtgtcttccctttag

SEQ ID NO: 24714 - DNA, 6522 bp, Artificial Sequence
  Description of Artificial Sequence: Synthetic coding sequence
atggtcaacgaaaacacccgtatgtacatacctgaggagaaccaccagggcagcaattacgggtctccgagaccagcacacgcaaacatgaacgccaacgcggccgctggtttagcccctgagcacatccctacacccggcgctgctttgtcgtggcaagccgccatcgatgccgctcgccaggccaaactgatgggttccgccggtaacgccactatctctacagtctcgtcgacacagcgtaagcgccagcagtacggcaaacccaagaagcaggggtccaccacagccactcggcctccaagggctctgctatgtttgaccctgaagaacccgatacgccgagcctgtatcagtatagttgagtggaagccatttgaaataattattctgctaaccattttcgctaattgcgtggcacttgccatttacattccattccctgaagacgactctaatgcgaccaattctaacttggagagagtggaatacctgtttctcatcatattcacagtggaggccttcctgaaggtgattgcatatgggctattatttcacccaaacgcttacttgcggaatggctggaatttactggatttcatcattgtcgtggtggggctgttctcagcgatcctcgaacaggcaaccaaggccgacggagctaacgctttgggcgggaaaggagctggattcgatgtgaaggcgttacgagcctttagggtgcttcggccgcttcggctggtgtccggcgtgccttcgctgcaggtcgtcctgaacagcatcatcaaagctatggtccctctgttacatatcgccctcctggtgttattcgtcatcattatttacgcaatcatcggactggaactcttcatgggaaagatgcataagacatgttataaccaggagggcatcgccgacgtgcctgccgaggacgatccctccccatgtgcgctggagactggtcatggaaggcaatgccagaatggtaccgtctgcaaacccggctgggatggccccaaacatggaatcactaatttcgataactttgcgttcgccatgttgaccgtttttcaatgtataacgatggaaggttggaccgacgttttatactgggtaaacgatgctgtaggacgcgattggccttggatatattttgtgacacttatcattatcggctccttcttcgtcctgaaccttgttttaggcgtactgagcggtgagttttccaaggagcgcgaaaaagcgaaggcgcgtggcgatttccagaagcttcgagaaaagcaacaactagaggaggacctaaaggggtatctggactggattacacaagccgaagacatcgatcccgaaaatgaagacgaaggaatggatgaagagaaaccgcgtaacatgtccatgccgacatcagaaaccgagtcggtgaacaccgaaaatgtggctgggggtgacattgagggagagaactgcggtgcacgccttgcacacagaatcagtaaatcaaagttttccagatactggcggagatggaaccgtttctgccgaaggaaatgcagagcagcagtaaagtcaaacgtgttttactggcttgtgatctttcttgtttttttgaacaccctgacaattgcctcagagcattataatcaacccaactggctgacggaagttcaagacaccgcaaataaggcgttgcttgcattgttcacagctgaaatgctgttaaaaatgtatagcctcggactgcaggcatacttcgtgagcctgttcaataggtttgattgtttcgtcgtgtgtggcggtatccttgagacaattctggtggaaacaaagatcatgtcaccactcggcatcagcgtcttgcggtgtgtgcggctgctcaggatctttaagataactagatattggaactctctgagcaatctggttgctagcctcttaaattctgtccggtctatcgctagcttgctgctgctcctcttcctgtttataattattttttcactactaggcatgcagctctttgggggcaagtttaactttgacgaaatgcagacacggagaagtacctttgataactttccccagagcctgctcactgtcttccagatcctcaccggagaagactggaactccgtgatgtatgatggaatcatggcctatggtggaccgtccttccctggaatgctcgtttgtatatatttcatcattcttttcatttgtggcaactacatccttctaaatgtcttcctagcaatcgccgtggacaacttagctgatgctgaatcactcaccagcgcccaaaaagaggaagaagaagagaaagagcgcaagaaactcgccaggacagccagtcctgaaaagaaacaagagctggttgaaaaaccagctgttggtgagagtaaagaggagaagatcgagctaaagagcataacggctgacggggagtccccacccgcgactaaaattaatatggacgacctccagccaaacgagaacgaggacaagtccccgtaccctaatcccgaaacaaccggtgaagaggatgaggaggagcctgagatgcctgtcgggcctagacccagacccttgtccgaactccatcttaaggaaaaagctgttcccatgccggaggcttccgcctttttcatcttcagctctaataatcgcttccgtctgcagtgccatagaatcgttaacgacaccatcttcacaaatctgatactcttttttatactcctgtctagcatctccctggcggcagaggatccagtacagcacacttctttcaggaaccatatcctggggaatgccgactacgtgttcaccagcattttcaccctggagataatactgaaaatgacagcttacggggcttttcttcataaggggagcttctgccgaaattactttaatatcctggatctgctggtggtttccgtgtccttgatttctttcggtatccagtccagcgcaatcaacgtggtaaagatcctccgggtgttgcgcgtgctccggccccttcgggccattaaccgggccaagggactcaagcacgtcgtgcagtgtgtgttcgttgctataaggacaatcggcaatatcgtgatcgtcaccaccctactccaatttatgtttgcttgcatcggagtccagttgttcaagggcaagctctacacttgctccgacagctctaagcagacagaggctgagtgcaagggcaactacattacgtacaaagatggggaagtcgaccatcccatcatccagccccgcagttgggagaacagcaaattcgatttcgataacgtgctggccgccatgatggccctgttcaccgtttctacatttgagggctggccagaactgctgtatagaagcattgacagtcataccgaagataaaggaccgatctacaattaccgcgtcgagatcagtatattcttcatcatttatattatcattattgcttttttcatgatgaatatttttgtgggctttgtgatcgtgacctttcaggagcaaggtgagcaggagtacaaaaactgcgaactcgacaaaaatcaacggcaatgcgtcgagtacgcgctgaaggcacgacccctccgccgatatatcccgaaaaatcagcaccagtataaagtttggtacgttgttaatagcacatatttcgagtaccttatgttcgtgttaatcctactaaatactatatgcctcgctatgcagcactatggccagtcttgtctcttcaaaatcgcaatgaatatattgaatatgctgtttaccggcttatttactgtggaaatgatcctgaaactgatagctttcaaaccaaaacactacttctgcgacgcatggaacactttcgacgccttgatcgttgtgggctctatcgttgacatcgctattacagaggtgaaccctgccgagcacacacagtgctccccttcaatgaatgctgaagagaatagcagaatttccattacgttcttccggctgtttcgtgtgatgaggttggtgaaactactctcacggggagaaggaattaggaccctcctgtggacatttatcaaatctttccaggccttaccatacgtcgcactgcttatcgtcatgctattcttcatctatgctgtaatcggcatgcaggtctttggcaagatagctcttaacgataccactgaaattaatagaaacaataatttccaaaccttcccgcaggcggtccttctgctgtttcggtgcgccacgggcgaggcttggcaggacatcatgttagcctgtatgcccggcaaaaagtgcgccccggagagcgagccatctaactccacagaaggcgaaaccccgtgtggaagttcctttgccgtcttttactttatcagcttttacatgctttgcgcgttcctcattataaacttgttcgtggctgtgatcatggataatttcgattacctcactcgggactggtctattcttggtccacaccatttggacgaatttaagcgtatatgggccgagtacgatccagaggcaaaggggagaattaagcacttggatgttgtcacactgctacggcgcatccagccgcccctcggattcggaaaactttgtccacacagggtggcctgtaagcggctcgtctcaatgaatatgcccctgaattctgacggcacggtcatgtttaatgcgaccctttttgcgcttgtcagaaccgcccttcgtatcaagacagaagggaatctcgagcaggcaaatgaggagctccgggccatcattaaaaagatctggaagcggacatcgatgaagttgctggaccaggttgttcctcccgctggcgacgatgaggtgaccgtcgggaagttttacgcaacctttttgattcaggaatatttcagaaagtttaaaaagcggaaggaacagggcctagttggtaaaccgtcccagcggaatgctctaagcttgcaagcaggtctcaggactctgcacgatatcgggccagagattaggagggccatctccggagacctcacagccgaggaagagcttgacaaggccatgaaggaggctgtgtcagcagctagtgaagacgatattttccggagggcgggcggactgtttggcaatcatgtgagctactatcagagcgatggaaggagtgcctttcctcagacttttaccacccagagacccctccacatcaataaggccgggagttcacagggagatactgaatccccatctcatgagaaactggtagattcgacctttaccccaagtagctattcgtctaccggctcaaacgccaatattaacaacgctaacaacacagctctcgggagattacctcggccagcggggtatccaagtacagtttctacggttgaggggcatggacctccattatcccccgctatccgcgtccaggaggtggcctggaagctgagctctaatcgcgagagacatgtgccaatgtgcgaggacctcgaactcaggagagactcgggctctgccggtactcaggcacactgtctgctgctgcggaaagccaatccgtccagatgccactcacgtgaaagccaggcagccatggccgggcaggaggaaacctctcaggatgagacctacgaggtaaaaatgaatcacgacactgaagcctgctctgaacccagcctattgtctactgagatgctttcttatcaagacgacgagaaccgccagcttactttacctgaggaggacaagagagacattaggcagagtcctaaaaggggatttctccgaagtgcctccctgggtcggcgagcatcttttcatctagaatgcttgaagaggcagaaagacagggggggagatatcagccagaagaccgtcctgcccctccaccttgtgcaccatcaagctctggccgtggccggcctgtccccacttctgcagcgcagccactctcctgctagctttccaagaccattcgcgacgcccccagctaccccagggtctagaggatggcctcctcagcctgtccctaccctacgacttgagggggtagaaagtagcgagaaattaaattccagcttcccaagcattcattgcggctcatgggcagaaaccacacccgggggtggcggatcctccgcggcccggagagttcgtccagtgagcctgatggtgccgtcccaggccggagcacctgggagacagtttcacgggtccgcatcaagcttggtcgaggctgtcctgatttccgaggggttgggacagtttgctcaagatcccaaattcatagaggttacaacacaagagcttgccgatgcctgtgacatgaccatagaggaaatggagtctgccgccgataacattctgagcggcggagcacctcaaagccccaacggcgcactcctgccttttgtcaactgtagggatgccggacaagatagagccggaggggaagaggatgcggggtgtgtgcgtgctcggggcaggcctagcgaggaggagttacaggattcgcgagtttacgtatctagcctttag

SEQ ID NO: 24715 - DNA, 6492 bp, Artificial Sequence
  Description of Artificial Sequence: Synthetic coding sequence
atggttaacgaaaacactcgcatgtacatacctgaggagaatcatcaggggagcaattacgggtcaccaaggccagctcatgctaatatgaacgccaacgccgctgccggtctggctcctgagcatatcccaacacccggggcagcactgtcttggcaagcagccattgatgcggcccgtcaagccaagttgatgggttcggcaggcaacgcaaccatttccacagtatcaagtactcagaggaagcgacagcagtacggcaagcccaaaaaacagggctcaacaaccgccacccgacctcctagagctctgctctgcctgaccttgaagaaccctatccgtagagcttgtatcagcatcgtggagtggaaaccttttgaaattattattctgttgacaatatttgctaactgcgtcgctctggccatttatataccatttcccgaagatgatagcaacgctactaattcaaatcttgagagagtggaatacctctttctcattatctttaccgtcgaggcatttctgaaagtgattgcctacggactgttgtttcatcccaacgcctacttgcgaaatggatggaatctcctcgactttatcattgtggttgtgggactgtttagcgccatcctggagcaagctactaaggctgatggcgcgaacgcattgggaggtaaaggcgccggctttgacgtgaaggctttaagagccttccgagtcctgcggcccctgaggctggtgtctggtgtcccatctctgcaggtcgtgttgaatagcatcatcaaagctatggtgcccctactccacatcgcattgctcgtgctcttcgtgataatcatctacgcgatcattgggctggaattatttatggggaagatgcataaaacgtgctataatcaggagggaatcgcagatgttcctgctgaggatgaccctagtccctgtgcgctagagaccggccatggacgccagtgtcagaacggaacagtatgtaaacccggatgggatggccctaaacacggcatcaccaacttcgataacttcgcttttgcgatgctgactgtcttccagtgcattactatggaagggtggaccgatgtgctctactgggtcaacgatgccgtcgggagagattggccatggatttattttgttaccttgattataattggcagcttttttgttctgaatctggtgctgggcgtgctctcaggagaatttagtaaagagcgtgagaaagccaaggctagaggggacttccaaaaactaagggaaaaacagcagctcgaggaggacctgaaggggtacctcgactggatcacccaggccgaggatatcgatcccgagaacgaggacgaaggtatggatgaggagaaacccaggaacagggggacaccggcagggatgctcgatcaaaagaagggcaagtttgcctggtttagccattctactgagacccatgtctccatgcctactagcgaaacagaatccgtgaacaccgaaaatgttgccggcggcgacatagagggagagaactgtggtgcccgcctggcgcaccgcatcagtaagtcaaagttttctaggtactggagacgatggaacaggttctgtcgtcgcaaatgcagggcagcggttaaatctaatgtcttttactggctagttatctttctagtgttcctgaatactttgaccattgcctctgaacattataatcagccaaactggctgactgaggtgcaggacaccgcaaacaaggccctgctggcccttttcaccgccgagatgctgctgaagatgtattctctgggactgcaggcctactttgtatcgctgttcaataggttcgactgcttcgtggtgtgcggagggatcctggaaactatactcgtcgaaacgaagatcatgtcccctttaggtattagcgtgttgcggtgtgtccgcttactgaggatctttaagattacgcgttattggaactctttaagcaacttggtagccagtcttttgaattcagttcgcagcatagctagtctgttactgcttttgttcctatttatcattattttctccctcctgggcatgcagctttttggcggaaaattcaactttgacgagatgcagacccgaagatctacatttgacaatttcccgcagtcactccttacggtattccagattctgaccggagaggactggaattcagtgatgtatgacggtattatggcttacgggggcccctcctttccgggaatgctcgtgtgcatttactttataattcttttcatttgtggtaactatatcttattgaatgtgtttttagccatcgctgtagataacctggccgatgccgagtcattgaccagcgcacaaaaagaagaggaagaggaaaaagagaggaaaaaacttgcccgcaccgccagtcccgagaaaaagcaggagctggtcgagaaaccagctgtgggcgaatccaaagaagagaagatcgagctgaagtccatcacggcggatggggaatccccgccagcaaccaaaattaacatggatgacctgcagcccaatgagaacgaagacaaaagtccataccctaatcccgagactaccggggaggaagacgaggaagaacctgaaatgccagttggtccacgacccaggccattgagcgagcttcacctgaaggagaaggccgtgccaatgccagaggccagcgccttcttcatcttttccagcaataaccggttcagacttcagtgtcaccgaatcgtcaacgacacgatttttaccaatctgatcttattttttatccttctatcctcgatctctctcgctgccgaggaccctgtgcaacacactagctttagaaaccacattctcttttatttcgacatcgtgttcacgacaatcttcacaattgagatcgccctcaaaatgacggcctacggtgccttcctgcataagggctcgttctgcaggaactactttaatatcttggatctgctcgtggtttccgtttctcttatcagcttcggaattcagtcgtctgccatcaatgtggtgaaaatcctcagagttctgcgtgtgctccggccgctgcgcgccattaaccgagcaaaaggcctgaagcatgttgtacagtgcgtatttgtggcgattcgcacgatcggcaatatagtgattgtgaccactctcctgcagttcatgttcgcctgtataggtgtgcagcttttcaaaggcaagctatacacttgttctgattccagcaagcagacagaagccgagtgtaagggcaactatatcacatataaagacggcgaagtggatcacccgatcatccagccacgcagctgggaaaactcaaagttcgatttcgacaacgtcttggccgcaatgatggcactattcaccgtctcaaccttcgagggatggccggagctgctgtacagatccattgactcacatactgaggacaagggcccgatctataactacagagtagaaatttccatatttttcattatctatatcatcattatagctttctttatgatgaacattttcgtaggcttcgtgatcgtgaccttccaggagcagggcgagcaagaatataagaattgtgaattagacaaaaaccagagacaatgtgttgaatatgctttaaaagcaagacccctgcggcggtacatcccgaagaaccagcaccagtataaagtgtggtatgtcgtaaactcaacctatttcgaatatctgatgtttgttctcattcttctgaacaccatctgccttgccatgcagcactacggtcagtcttgcctctttaagatcgccatgaatatactcaacatgctatttaccggcttgttcaccgtcgagatgatcttgaaactgatcgcgttcaagccaaaacactacttttgcgacgcatggaacacattcgatgccctgatcgtagttgggtctatcgtggacatagccatcaccgaggtgaacccagcggagcatacccaatgctccccctcaatgaacgctgaggaaaatagcagaattagtattaccttttttcggctgtttagagttatgaggctggtaaagctactcagtaggggcgaaggcattcgcacattgctctggacctttattaagtcctttcaggcactaccttatgtagccctgctcatcgtaatgctgttcttcatatacgctgtcattggtatgcaggtcttcgggaaaattgctttgaatgacacgacagaaatcaaccgtaataacaatttccagaccttcccacaggcggtgttgttactgttcagatgcgccactggagaggcatggcaggatattatgctggcatgtatgccaggcaagaagtgcgctcccgagagcgaacccagcaactccaccgaaggcgagacaccttgtggatcttctttcgccgttttctacttcatcagtttttacatgctctgtgcctttctgatcatcaacctgttcgtcgcagtgattatggacaactttgactacttaacacgtgactggtcaattttggggccacaccacttggacgaatttaagaggatttgggcagaatacgacccggaggccaagggcagaattaaacatctggatgtcgtcacactgcttcgtagaattcagcctcctctcgggtttgggaaactgtgtcctcatagagtggcttgcaagcgcttggtaagcatgaacatgcccctcaacagcgatgggacagtcatgttcaatgctacactcttcgcactggtgagaaccgcacttcgcataaaaacagagggaaaccttgaacaggccaacgaagaactgagggcaattatcaaaaagatctggaaacgcacaagtatgaagctcctggaccaggtggtgcctcctgccggtgatgacgaggtgactgttggaaagttctacgccacctttcttatccaggaatactttcgtaaattcaaaaaaagaaaggagcagggcctcgtcgggaagcctagtcagcggaacgcgctcagcctgcaggcaggtctgaggactctccatgacatcgggcctgaaattcgccgggctatttccggcgacctcactgcggaggaggagctcgataaagcgatgaaagaagccgtctccgcagcatccgaggacgacatcttcagacgtgcaggcgggctgtttggcaaccatgtgtcttactaccagtcggatgggaggagcgctttcccacagacttttacaacccagcgcccgcttcatattaataaagccgggagttcccagggcgacaccgagagtccttcacacgagaaactggtggatagcacttttaccccatcttcatatagctctacaggctccaacgccaacatcaacaatgcaaataacaccgctctcggcaggctgcctagacccgccgggtacccctccacagtgagcaccgtagaaggccacggtcccccccttagtcccgctatacgggttcaggaggtagcttggaagctgtcaagcaatagatgccactcaagggagagccaggcagccatggctggacaggaggagacttcccaggacgaaacctacgaggtgaagatgaaccatgacaccgaggcatgcagcgagcctagtttgctgtctaccgagatgttgtcataccaggatgatgaaaaccgtcaattgactctgccggaagaggacaaaagagatatccggcagagcccgaagagaggttttttaagaagcgccagtctgggacgaagggcttcttttcacttagagtgccttaaacgtcaaaaagacagaggaggcgatattagtcagaaaactgtattacctttgcatttggtccaccatcaggcgcttgcagtggccgggctcagtccgcttctacagaggagccactcacccgccagcttcccacgccctttcgccacccccccggcgactcctgggagccggggatggccaccacagccggtccccacactccggctcgagggcgtggagagctcagagaagcttaactcctcattcccatccattcactgcggatcttgggccgagactactcctggaggcggcggtagctcagccgctcgtagagttagacccgtgagcctcatggtcccttcgcaagccggtgctcccgggcgacagtttcacggaagtgcttcttcactggttgaagcagtgctgattagcgagggactggggcaattcgctcaggaccccaagttcatcgaagtcacaacccaggagctggcagatgcctgcgatatgaccatcgaagagatggaaagcgctgcagataacattttgagcgggggtgcaccacagtcccctaatggtgccctccttcctttcgtgaattgtagagatgccggtcaggatcgggcgggcggagaggaagacgccggctgtgtgcgggcgcgtgggagaccgagtgaggaagagctgcaagactcccgagtgtacgtatccagtttgtag

SEQ ID NO: 24716 - DNA, 6753 bp, Artificial Sequence
  Description of Artificial Sequence: Synthetic coding sequence
atggacgaagaggaagatggggcaggcgctgaggaatctggtcaacctcgcagtttcatgcggctgaacgatctatccggagcaggaggacgccctggtcccggcagtgccgaaaaggacccaggctccgccgatagtgaagcggaaggcctgccttaccctgccctcgctcccgtggtcttcttctacttgtcccaagattctcgtcctcggtcttggtgtctcaggactgtgtgtaatccatggtttgagagaatttccatgcttgtcatcttgctcaactgcgtgacactgggcatgtttaggccttgcgaagacatcgcctgcgatagccagcggtgcaggattcttcaggcctttgatgattttatattcgcgttttttgctgtggaaatggtggtgaagatggtggccttggggatatttgggaagaaatgctacctgggcgacacatggaacagattagacttcttcatcgtaattgccggcatgctggagtacagccttgacttacagaatgtgtcttttagcgctgtgagaacagtgagagtgctgcgcccactcagggctatcaatagagttccttccatgaggatcttggtcaccctgctgcttgacaccttaccaatgctggggaacgttctactgttgtgcttctttgtattctttatttttggcattgtgggtgtccagttgtgggctgggttgctgcgtaataggtgtttccttcccgaaaacttctctcttccactgtcggtggatctggaaagatactaccagactgagaacgaggatgaaagcccctttatctgcagccagcctagagagaacggtatgcgcagctgcagatccgtgccgacccttcgaggggatgggggaggaggacctccatgcggtctcgactatgaagcatataattcttcctcaaatactacatgtgtcaactggaatcagtattataccaactgcagcgctggagaacacaacccctttaaaggggccataaacttcgacaatatcggatacgcctggatcgctattttccaagtcataaccttggagggatgggtggacattatgtacttcgtcatggatgcccactccttttacaatttcatatacttcatccttttgattatcgtcggtagtttctttatgattaatctgtgccttgtggtgatcgctactcagtttagcgagactaaacagcgcgaaagccagctgatgcgagagcagcgtgttcgctttctgagcaatgcttctacactggcctccttcagcgaacctgggagctgttatgaggaactgctgaaatatttggtgtacatcctgcgaaaggcagcccggagactggcccaggtttccagggctgctggggtccgagtgggcttactgtccagccctgcccccctcgggggccaggaaacccagccttcttccagttgctcccggtcacatcggagactgtcggtacaccacctagtccatcaccatcaccaccatcaccatcattatcaccttggtaacggaaccctgcgtgcccccagggccagccccgagattcaggacagggacgcaaacggcagtcgtaggctgatgctaccaccaccctccacccctgccttatcaggggctccgccaggcggcgcggaatcagtccatagtttctatcacgctgattgtcacctcgagcctgttcgctgccaagcccccccacctcggagtccaagcgaagccagtgggcgcaccgtcggctccggaaaggtctatcccacggtccacacctccccccctccagagaccctcaaggagaaggctctcgtcgaagtggctgcctcctccggaccccctactctgacatcactgaacataccaccgggtccgtacagctccatgcacaaacttctagaaacacagtccacgggtgcctgtcagagttcttgcaaaatatcctctccatgcttaaaggccgacagcggggcatgcggccctgacagttgtccttattgtgccagagccggagcaggggaggtggagctcgccgatcgtgagatgcctgactctgactcagaagcagtttatgaattcactcaggacgcccagcactccgacctgcgggatccccactctagaagacagcgcagcctgggacccgacgcggaaccctccagcgtgctggccttttggcgcttgatctgtgatacttttcgtaagatcgtggactctaagtattttggtcggggcatcatgatcgccatcttggtgaatacacttagtatgggaatcgagtatcacgaacagcctgaggaactgaccaacgcactggagatctcaaatatcgtctttacgagcctgtttgccctcgaaatgctgctaaaacttctggtttatgggccatttggctatataaagaacccctataatatcttcgacggtgtcattgtcgtcatctcggtttgggagatcgtaggtcagcaaggcggaggcttaagcgtcctgcggacctttcgccttatgagagttcttaaactagtcaggtttctgcccgcgcttcagcggcagctagtggtgctaatgaaaaccatggacaacgtcgcgaccttttgcatgttgctgatgctgtttatattcatcttcagcatcctaggcatgcacctgttcggatgcaaattcgcatcagagcgggatggcgacaccctaccggataggaagaacttcgacagcctgctgtgggctatcgtgaccgtgttccagatcctcacacaggaagattggaataaagtgctttataacggaatggcctcaactagttcttgggcggcactgtacttcatcgctcttatgactttcggcaactacgtactgttcaatctgcttgtggccatcctggtcgagggattccaggccgagggtgatgctaataagagcgagtccgagcccgatttcttcagtccttccctggacggcgatggagaccgtaaaaagtgcctcgccctggtgagtctcggtgagcacccagagttgcgcaagagcctgctcccaccgctgatcatacatactgctgctaccccgatgtccctgcccaagagcacctccaccggccttggcgaagccctgggcccggccagtcggcgcacatcctcttctggttcggccgagccaggcgccgcacatgaaatgaagagcccaccctccgcacgaagtagcccacactccccttggtctgccgcctctagctggaccagccgtcgcagctccaggaactccctaggacgggcgccatccctgaaaaggagatcgccctctggtgagcgtaggagcctgctttccggagaaggacaggagtcccaggacgaagaggaaagttcggaagaggaacgagcatcgccagccggaagcgatcaccgccaccgagggtccctggaaagggaagctaagtcttcatttgacctgccagacacactccaggtgccaggccttcatagaaccgcatctggcaggggctctgcttctgagcatcaggattgtaacggtaaatccgcctcaggtcggctggcccgtgccctacgcccggatgaccccccgcttgacggggatgacgccgatgatgaggggaatctctcaaaaggcgaaagagtgagagcctggattcgcgcaagactgcctgcctgctgcctcgagcgcgattcgtggagcgcctatatattcccaccccagtcccgcttcagattactatgtcacaggatcatcacccacaagatgttcgaccacgtggtcctcgttataatctttcttaactgtattacaatagccatggaaagacctaagatagacccccatagcgccgagcgcatcttcctgacactatccaattatatcttcaccgccgtttttttggctgagatgacagtaaaggtggttgccctcggatggtgcttcggagagcaagcctatcttcggagttcttggaatgtcctagatggtctgttggtgttgatttccgtgattgatatcctcgtctctatggtttcggactcaggcacaaagatccttggcatgctgagggtcctgcgcttactgaggacactcagaccgctaagagtgattagtagggctcagggactgaagctcgtggttgagactttgatgtcatctctgaagccaatcggaaatatagtcgtgatatgttgcgccttcttcattatctttgggattttaggcgtgcagctgtttaaaggcaagttcttcgtatgccaaggagaggacaccaggaacattacaaataagagtgactgcgctgaggcctcttaccgctgggtgagacataagtacaatttcgacaatctcggccaagctttgatgtctctgtttgtattggccagtaaggacggatgggtggatattatgtatgatggtctggacgctgttggagtggaccagcagcctatcatgaatcacaacccttggatgctgctttacttcatttcgtttctacttatagtcgctttctttgtgttaaatatgtttgtgggcgtggtcgtggagaattttcataagtgcaggcaacatcaggaggaggaagaggcccggcggagagaagagaagcgattgagacgcctcgaaaagaaacggaggtccaaggaaaaacagatggctgaagcccagtgcaaaccgtattattctgactacagtcggtttcggctcttggtacatcacctgtgcacatcccactatcttgatctgttcattactggtgtcatagggttgaacgtggttacgatggctatggagcactatcagcagccacagatcctggatgaggctctgaaaatctgtaactacatttttacagtgattttcgttctggagtctgtgttcaagctggtcgcatttggctttcgaagattctttcaggataggtggaaccagctggacctggccattgtcctcctttcaattatgggaataacccttgaagagatagaagtgaacgcctcgctgccaattaaccccacaatcatccgcatcatgcgagtattgcggattgccagagtcctcaagctgctcaaaatggcggtgggtatgcgagccctgctcgatacagtcatgcaggctctgcctcaggtgggcaacctcggacttctgtttatgctgctatttttcattttcgcagccctgggcgttgaactgtttggggacctggaatgcgacgaaacacacccctgcgaggggctcggtcggcatgctaccttccgtaactttgggatggcatttttgaccctgttccgagtatcgaccggcgacaattggaacggtataatgaaagataccctgagagactgtgatcaggagtccacctgttacaacaccgtgatttctcctatttattttgtgtcctttgtcctgacagcacagtttgtactggttaatgtcgttattgctgtgctgatgaagcaccttgaggagagcaataaagaggccaaggaggaagccgaactcgaggcagagttggagctggaaatgaaaacactttctccacagcctcactctccccttggtagcccgttcttgtggcccggcgtggagggaccagactctcctgactctcctaagccaggtgcactgcaccctgctgcccacgcgcgaagcgctagtcatttttcactggaacacccaactatgcagccccatcccactgagctacctgggcctgacctgcttactgtgaggaagtcaggggtgagtagaacgcactctctgcctaacgatagctacatgtgccgccacggtagcaccgccgaaggaccactgggtcatagaggctggggtcttccgaaggcccagagtggttctgtgctgtcagtccactcccagcctgcggacacttcgtatattctgcagttgcctaaggacgcccctcacttacttcagccccatagcgcgcctacatgggggacaatccctaaactgccaccccctggccgctccccgcttgcacagaggccattacggcgacaggcggcaataagaacagactcattggatgtacaggggcttgggtcccgggaggatctcctcgctgaggtgagcggtccatcacctcctctggctagagcctactctttttgggggcaaagttccacccaagcacagcaacacagtcgatcacatagtaagatttcgaagcacatgacacctccagctccatgtccagggcctgaacctaattgggggaaggggccacccgagacccggagttccctcgagctggatacagagttgagctggatttccggggatcttctgccccctgggggacaagaggaacccccaagccctagagatttgaaaaagtgttacagcgtggaggcccaaagctgtcagaggaggccgaccagttggctagacgagcagcgccgccacagtatcgcagtgtcctgtctggactcggggtcacagccccacctcgggactgatcccagcaacttaggaggacaacccctggggggtcccggtagtcggccaaaaaaaaagttgagcccgcctagcattacgattgacccacccgagtcccaggggcctaggactcctccatctcccggcatttgtctgcgacgcagggcaccgagttctgactccaaggatccactagcttcgggccctccagattcaatggccgcgtccccttctcctaaaaaggatgttttatctctgtcggggctctcatcagacccagccgacctcgacccatag

SEQ ID NO: 24717 - DNA, 7032 bp, Artificial Sequence
  Description of Artificial Sequence: Synthetic coding sequence
atggacgaggaagaggacggagccggcgccgaggaaagcggccagcctcgcagtttcatgcggctgaacgatttgtccggagccggggggcggccgggccccggttcagcggaaaaggacccggggagcgccgacagtgaggcagaagggctcccctatcccgccttggctcccgttgtgttcttttacctctcccaggatagtcggccgaggtcatggtgcctccgaaccgtttgcaacccgtggttcgaacgaattagtatgctcgtcatcttgctcaactgtgtcactctaggaatgttcaggccctgcgaggacattgcatgtgatagccagcgctgccgaattctccaggcatttgacgactttatattcgcttttttcgcggtggaaatggttgttaaaatggtagctctaggaatttttggcaaaaagtgctaccttggcgacacatggaacagattggattttttcatcgtcatcgctggcatgctggagtacagtctcgatctccaaaacgtgtccttctccgcggttaggacggtgcgagtcctacgcccactgcgtgcaatcaaccgagtgccctcaatgcggattctcgttacactgctgttggataccttgccaatgctggggaatgtactccttctctgcttctttgtcttttttatcttcggtatcgtgggcgtccagctgtgggccggactgctgcggaatagatgttttctgccagagaacttctctttaccacttagtgttgacctggagcggtactatcaaactgagaacgaagacgaaagcccctttatctgcagccagcccagagaaaacgggatgcgctcctgtcggtccgtcccaacactccggggcgatggcgggggtggccccccttgtggcctcgactatgaagcgtataattctagctccaacactacttgcgtgaattggaatcagtattacactaactgtagtgcgggggagcataacccctttaagggcgccatcaacttcgacaacattgggtacgcctggattgccattttccaagtgatcacactggagggctgggtggatatcatgtacttcgtaatggacgctcatagcttttataatttcatctacttcattctgctgattattgtgggttccttttttatgatcaatctttgtcttgtagtgattgcaacccagttttccgaaactaagcagcgggaaagtcaactgatgcgggaacagcgcgtccgatttctgtcgaacgcctcaacattagcatcgttttctgaaccaggttcgtgttacgaggaactgctcaaatatctggtgtacatccttcggaaagcagctcggcgcttggcgcaagtctccagagccgcgggcgtgcgcgtcggcctgctgagcagtcctgctccgcttgggggacaggaaactcagccctcctcctcctgctctagatcacataggcggctctccgttcaccacctggtgcatcatcaccaccatcatcaccaccattaccacctgggaaacggcactctgagggcccctagggcatccccagaaattcaggacagagacgcaaacggaagtcggagactgatgttgccaccccctagtacacccgcgctttctggagccccaccaggtggggccgagtccgtgcactctttctaccatgccgactgccatctcgaacctgtgcgctgtcaggctccaccgcctcgcagtccaagcgaggcttccggacggactgttggatcagggaaggtctacccaacagtgcacaccagcccaccacccgaaacgctgaaagagaaggcactggtcgaagtggccgcaagtagtggccctcccacactgacatcactcaatataccccccgggccttactcttccatgcacaaactgctggaaacccagtccacaggcgcttgccagtcatcatgcaaaatctcatctccctgtctaaaagctgatagtggcgcttgtggacccgacagctgcccctattgcgccagggccggggccggcgaggtggaactggctgacagggagatgccagactctgatagcgaagcagtgtacgagttcacacaggacgcacagcatagtgaccttagggacccacatagccggagacaacgttctttgggccccgacgcagagccatcatcagttttggcgttctggcgcctgatttgcgacaccttccgcaaaattgtcgactccaagtactttgggaggggcattatgattgcaatcctggtcaacacgcttagcatgggaattgaataccacgaacagcccgaggagcttaccaacgcacttgaaatttctaatatcgtattcacgagcctgttcgcattggagatgctgctgaaactgctggtgtacggcccctttggatacattaaaaatccatataacatttttgacggagtaattgtagtgatttctgtctgggaaatcgttggtcagcagggcgggggcctcagcgttctccgtacatttcggctgatgagggttctaaaactggtgagatttctgccagcccttcaacgtcaactggttgtactgatgaagactatggacaatgtagctaccttctgcatgctcctgatgttgttcatctttatcttctccattctgggcatgcatctctttggttgcaagttcgcttctgagagagatggcgacactttgccagataggaagaatttcgactcactgctgtgggctatcgtgaccgtattccaaattctgacccaggaggactggaacaaggttctatacaacgggatggcgtctacctcatcttgggctgccctgtacttcatcgctctgatgaccttcggcaactatgtattatttaacctgctggtggctatcctggtcgaaggatttcaggccgagggcgacgccaataagtctgaaagcgagcccgacttcttttccccaagcctagacggagacggcgatcgcaagaaatgtctggctctggtcagcctaggagagcatcctgaactaaggaaaagcctactgccccctctgattatacatacagccgccactccgatgagtctgccaaaatcaaccagtaccggcctaggagaagccctaggtccggcgtctcgccgaactagcagttccggatcagcggagcctggtgccgcacacgaaatgaagtccccgccttcagccaggagcagtccacactccccctggtctgctgcttcgtcctggacgtctagaagaagcagcaggaatagtctggggcgtgcccccagtttaaaacggaggtcccctagcggcgagcgacgttctctgctatctggggagggacaagagagtcaggacgaggaggagtcatccgaggaggagagggcctccccagccggaagcgatcatcgccatcgtggtagcttagaacgtgaggccaaatccagcttcgacctccccgacactctgcaggtgcctggtctccacagaacggcctccggaagagggagcgcctcagaacaccaagattgcaacggcaagtcagctagcggcaggttagcacgagctttgagaccagacgaccccccgctggatggagacgacgctgacgatgaaggaaatttgtctaaaggtgagcgcgtccgcgcctggattcgggccagactgcccgcatgttgcttagagcgggattcttggtctgcttatatattcccaccacagagccgattcagactattatgccatcggatcattacacacaaaatgttcgaccatgttgtgctcgtgatcattttcttaaattgtatcacaatcgccatggagcggcccaaaatcgatccccatagcgccgagcggatatttttaactctgtccaactatatcttcactgccgtattcctagcggaaatgacagtgaaggttgtggcactcggctggtgttttggagagcaggcctacctgagaagttcttggaatgttctggatggattgcttgtcctgataagcgtgatcgacattctagtgagtatggtgagtgattctggaactaagattctcggaatgctgagagtgcttcgattgttgcgaaccttgcggccattgcgtgttatctcaagggcacagggcttgaaactagttgtagagacacttatgagtagtttaaaaccaattggtaacattgtggttatatgttgtgcatttttcattatcttcggaattctgggtgtccaactgttcaaaggcaagttttttgtatgtcagggggaagacactaggaacattaccaacaagagtgattgcgctgaggcctcatacagatgggtaaggcacaagtacaacttcgataacttgggacaggctctcatgtccctgtttgtgctggcgtccaaggatgggtgggtggacatcatgtacgatggcttggatgctgtaggagttgaccagcagcccattatgaaccacaacccatggatgcttttgtacttcattagttttcttcttatcgtggcctttttcgtcctgaatatgtttgtaggggtagtggtggaaaactttcataaatgcaggcagcatcaagaagaagaggaggccaggcggcgcgaagagaagaggctacggcggctggagaagaagagaaggagtaaagagaagcaaatggctgaagcccagtgtaaaccctattattcagactatagcaggtttagacttcttgtacaccatttatgtacttcgcactatctggacctgttcattacaggagtaatcggcctgaatgttgtgaccatggctatggagcactaccagcaacctcagatcttggatgaggctctgaagatatgcaattacatctttaccgtcatcttcgttttagaatcagtattcaagctggtagccttcggatttaggcgcttttttcaagaccggtggaaccaacttgacctggcaatcgtgttactatcaatcatggggatcacactggaagaaatcgaagtgaacgcttccctgccaatcaaccctaccattattcgtatcatgagagtcctacgcatagccagagttttgaagcttttgaagatggcagtgggcatgcgagcccttttggacacagtcatgcaagcattgccgcaggtgggcaatctgggcctgctattcatgctgctcttttttatttttgccgctctgggtgtggaactgtttggagacctggaatgtgatgagacacacccttgcgaggggctggggaggcacgcaaccttccgcaattttggaatggccttcctgactctctttagggtcagcactggcgacaattggaatgggattatgaaagacacactgcgagactgcgaccaagaaagcacgtgctacaatactgtgatatcaccaatttacttcgtttctttcgtactgacagcacagtttgtgcttgtcaacgtggtgattgccgtgctgatgaagcacctcgaggagagtaacaaggaggctaaagaggaggctgaactcgaagccgagttggagttggagatgaagactctctctccgcagccacactctccactgggctccccgtttctctggcctggtgtagagggcccagattcacccgatagtccaaagcccggagcgcttcacccggccgcccacgctaggagcgcctcccacttttctctggaacaccccacagatcgccagctgttcgacacgatatccctcttaattcaaggctccctcgagtgggaacttaaattaatggacgagctagctggtccgggcggacaaccatctgcctttccatctgcaccgtcactgggcggtagtgacccccagattccactcgcggaaatggaagccctgtcactgacctctgaaatcgtgtcagagcccagttgttcactcgccctgacagatgacagccttccagatgacatgcatacgctcctcctcagtgctctggagtctaacatgcaaccccaccccacagaactgcctggccctgatctcctgactgtgaggaagtcaggcgtctcccgcactcattcactgcctaatgattcatacatgtgtaggcatgggtcaacagctgaaggccctctgggccaccgcgggtggggcctgccgaaggcgcagtccggctctgtgctgtccgtgcactcccagccagccgacacttcatatatccttcagctgccaaaggacgcaccacacctcctgcagccgcactccgcacctacctggggaacaatacccaagctgccgcctcccggacgcagccccttggcccagagacctctgagacgccaagccgccatccgaactgattcactcgacgtccagggcctgggatctcgggaagatctcctcgccgaggtgagcggacctagccccccactggcaagagcatacagcttctggggccagtcatctactcaagcccaacagcacagcagatctcactccaaaatcagcaagcatatgaccccacccgcgccctgtcctgggccagagccaaattggggtaaaggccccccagagacgaggagctcacttgagttagatactgagctttcctggatatcgggtgatttgcttcctcctggaggtcaggaagagcctccatcccctagggacctaaagaagtgctacagcgtcgaggcccagagttgtcagagaagacccaccagttggttggacgaacagagacgacattccattgccgtgtcgtgcctggactccggctctcaaccccatctcggaaccgacccctccaatcttggggggcaacctctgggcggaccaggatctcgacctaaaaaaaaactgagtcctcctagtattacaatagatccccctgagtcccaggggccacgaaccccaccaagtcctgggatctgtctgagaagaagggctccttctagcgacagtaaggatcccctcgctagtgggccacctgattcaatggccgcttcgccctcaccgaagaaggacgtcttgtcattaagcggcctgtcttcagaccccgccgacctcgatccatag

SEQ ID NO: 24718 - DNA, 6516 bp, Artificial Sequence
  Description of Artificial Sequence: Synthetic coding sequence
atggatgaggaggaggatggcgccggcgctgaggagtcgggtcagccaagatcattcatgaggctgaatgacctcagtggagctggggggagacccggacccggtagcgccgagaaggaccctggatctgctgatagtgaggcagaagggcttccttatcccgccctggctcctgtcgtgttcttctatctgtcccaggatagcaggccaagatcctggtgcttaaggaccgtgtgcaatccctggtttgagcggatctccatgctggtgatactcctaaactgcgtcaccttggggatgtttcgaccttgtgaggacatcgcttgtgattcccagcgatgccggatactgcaggcgttcgacgatttcatcttcgctttttttgctgtggaaatggttgtcaagatggtcgctctgggcatctttgggaaaaaatgttaccttggggacacatggaacagactggactttttcatcgtgatcgcagggatgcttgagtacagcctagacctacagaacgtcagcttcagcgcagtgcggacggtgagagtattacgacctttacgtgctattaaccgggtcccgtctatgcgcatcctcgtcaccttgctgctggatacactccctatgctgggaaatgtcctgctgttgtgctttttcgtatttttcattttcgggatcgttggggtacagctctgggccggtctcctcagaaatcgatgtttccttcctgagaactttagtctgccgctcagcgtggatctagaaagatactatcaaacagaaaatgaggacgagtcacctttcatctgttctcagccgcgcgaaaacggaatgcggagctgcagatctgtgcccaccctcagaggagacggcggcggcggaccaccatgtggcctcgattatgaggcttacaacagctccagcaacacaacttgcgttaactggaatcagtactataccaactgttcggctggggaacataacccattcaaaggagcaatcaactttgataacatcggctacgcctggatagctatcttccaagtgataacgctcgaaggttgggtcgatatcatgtatttcgtgatggacgcacacagtttttataactttatctatttcatcctactcatcatcgtggggtctttttttatgatcaacctctgcttagtggtaatcgccacacagtttagcgagactaagcagcgagagagccaactgatgcgcgaacagagggttagattcctgagcaatgcgtcgaccctagcaagcttttccgaacctggcagctgctacgaagagctcctgaaatatctggtttatattttgagaaaggctgccaggagactcgcgcaagtgtcaagagcagctggcgtgcgcgtcggcctgctttctagcccggccccacttgggggtcaagagacccagccgagctccagctgttcgcgcagccaccgccgcctatccgtacaccacctcgtacaccaccaccaccatcatcatcaccattatcatctcggtaacgggaccctccgagcaccccgggctagcccagaaatccaagacagagatgcaaacggttcccggagactcatgctgccccctcctagtacacctgctctgagcggtgcaccccctggtggggccgagtcagtccactcgttctatcacgccgactgtcacctggaaccagtgcgatgtcaggcccctccgcccagaagcccctctgaggcgagtggacggactgtgggctcggggaaagtgtaccccacagtgcacacaagtccacctccagaaaccctcaaggaaaaagcccttgtggaagttgctgcctcctccggtccacccacgctcacttccctgaacattcccccgggtccatatagctcaatgcacaaactgttggagacccagtccactggggcctgccagtcttcttgcaaaatcagcagtccatgcctgaaggcagacagcggcgcgtgtggccctgacagctgtccttattgtgcgcgcgcaggagcaggcgaagtcgagctagcagaccgagaaatgcccgactcggattccgaggccgtgtatgagttcacccaggacgctcagcactccgaccttcgagacccacactccagaaggcagaggagccttggtcctgatgccgagccatccagcgtgctcgccttctggagactgatctgtgacaccttccgaaagattgtggactcaaaatactttggcagggggatcatgatagctatcctcgtaaatactctgtccatgggcatcgagtatcacgagcagcccgaggaattgactaatgccctggagatttctaacattgtattcacttctctcttcgcacttgaaatgctcctgaagcttcttgtttacgggccattcggctatatcaaaaacccttacaatatcttcgatggggtgatcgttgtgatctccgtttgggagattgtcgggcagcagggcggggggttgagtgtgctgagaactttcagattgatgcgggtcctgaagctggtcagattccttccggcgctgcaaagacagctagtcgttctgatgaagacaatggataacgtggccaccttttgcatgctgttgatgctttttatctttatattctcgatcttgggaatgcatctcttcggctgtaaattcgcgagcgaacgggacggagacacactgccagaccggaagaatttcgattcactgttgtgggcaattgtcaccgtgttccagattttgacccaggaggattggaacaaggttctgtataatggcatggcttccacttcctcctgggccgctttatattttattgccctgatgacgttcggaaattatgtgttgttcaatctactggtcgcaattctcgtggagggttttcaggcagagggagacgccaataagtctgaaagtgagccggactttttctcgccaagcttggacggtgatggtgaccgaaagaaatgcttggctctggtgagtctcggcgaacaccccgaattgcggaagagtctactgccccccttgattattcacaccgcagcaaccccaatgtccctgccgaaatcaacttcgactggtctgggcgaggcattgggccccgctagccggcgaacaagctccagcggttctgccgagccaggggcagcccacgaaatgaagtctccaccgtccgcgagatcttctccccactctccctggtcagccgcctcctcctggacatccagacgaagctcacggaactcgctgggacgtgcgccctccctgaaaaggcgcagtccctctggtgagaggcgttcccttctgtctggtgagggccaagaatctcaggacgaagaagagtcttcagaggaggagagagcctcgcccgccggctctgatcataggcataggggctcactggagcgagaggcgaaatcgagcttcgacctgcctgatactctgcaggtgcccgggcttcaccgcactgccagtggacgtgggtccgcgagtgagcaccaggattgtaacgggaagtcagcatctggccgcttggctagagccctccgaccagatgaccctcctctagacggcgatgacgcggacgacgaaggcaatctgtcaaaaggagaaagggtccgagcttggattcgggcgaggctgccagcttgctgtcttgagcgcgacagttggtccgcgtacattttccctccgcagagtagatttagacttctgtgtcatcgtatcattacgcataagatgttcgaccatgtggtactggtcatcatatttctcaattgtattactatcgccatggaacggcctaagatcgatcctcattccgctgaaagaatttttctcacactgtccaactatatttttactgctgttttcctggcagaaatgactgtcaaagtggtcgccttggggtggtgcttcggcgagcaggcctacctgcgaagcagctggaacgtcctggatggcctactggtactgatatctgtgattgatattctggtgtccatggtgagcgattccggaacaaagattctagggatgctccgcgtgcttcgtctgctacggacactcagacctcttcgagtaatctctagggcccagggcctgaaattagtagttgagacgttgatgtcatccctgaagcccatcggcaatatcgtggtgatctgttgcgcattctttataatcttcggcatcctgggggtgcagctgttcaaaggcaagtttttcgtatgtcagggcgaagatacacgcaacattacaaacaagtctgactgtgccgaagccagttacaggtgggtacgccacaaatacaattttgacaatttaggacaagcactgatgtcactgttcgttttagcttctaaagatggatgggtggacattatgtacgatggcctcgatgcggtaggagtcgatcagcagcccataatgaatcacaacccatggatgctgctgtattttatctccttcttgctgattgtagccttttttgtactgaatatgttcgtgggcgtggtcgtagaaaattttcacaaatgtcggcaacatcaggaggaggaagaagctaggcggagggaggagaagcgtttgaggcgactggagaaaaagagaagaagtaaggagaaacagatggccgaagcgcagtgcaaaccatattattcagattattctcgttttcgcctgctggtccatcacctgtgtacatcccattacctggatttgtttataaccggagttatcggactcaatgtggtgacaatggcaatggagcactatcagcagccgcagatcctggacgaggcactgaagatttgtaactacatcttcaccgttatattcgtccttgagtctgttttcaagttagtcgccttcggatttcgcaggtttttccaggatagatggaatcagctggatctggcaatcgtgttgctcagcatcatggggattacacttgaagagatcgaagtgaacgcaagtctgcccataaatcccactattattagaatcatgcgagtcctgcgtatcgcacgggtgctgaagcttctgaagatggcagttgggatgagggcccttttagatacagttatgcaggcactgcctcaggtgggaaatctgggactgctcttcatgctgttgtttttcatattcgccgccctgggggtggaactattcggcgatctggagtgtgatgagacacatccgtgcgaggggctggggcggcacgcgacatttcgcaacttcggcatggcctttctaactctgttcagagtttctactggggacaattggaatggcataatgaaggatacgcttagggactgcgaccaggaatctacctgctacaacaccgttatctcccccatctactttgtttcatttgtgttgactgctcagttcgttcttgtgaacgtggtgattgcagtgctgatgaaacatctcgaagagtccaataaagaggctaaggaagaggccgaacttgaggctgaactggagctggaaatgaaaaccctctccccccagccacattcgcccctggggagtccattcctgtggcccggggtcgagggcccggattcgccagatagccctaagccgggagcgctacatcccgccgcgcatgcaagatcggcgagccacttttctctggagcaccccacgatgcaacctcaccctaccgagctccctggaccggatctactcaccgttcgcaaaagcggcgtgtctagaactcacagccttccaaatgacagctacatgtgcaggcacggaagcaccgccgaaggtcctctgggtcacagggggtgggggctgccgaaggcacaaagcggcagtgtgctgtcagtgcacagtcagcctgccgacaccagctatatcctgcagttgcccaaagacgccccccatctgctgcagcctcactcggctccaacgtggggaactattccaaagctgcctcctcctggccgcagccccctcgcccaaagacctctgagacggcaggcggcaatcaggactgattctctcgacgtgcagggcttagggagcagggaggacctgctggccgaggaagagccaccgagccccagagacttgaaaaagtgctattccgtagaggcacagtcctgtcaacgaaggcctacctcttggctggacgagcagcgcaggcattccattgccgtttcctgcttggactcaggctcgcagccacatctcggaacggacccctctaacctgggcggccagcccttgggcggcccagggtctaggcctaaaaaaaagcttagtcccccttctattacgatcgacccgccagagtcccaaggcccacggacaccccccagccccgggatttgcctgaggcgtcgggcaccctctagcgattcaaaggatcccctcgctagcggccccccagattccatggcggcttccccatcccccaaaaaagacgtgctatctctgagtggtctctcgtccgaccctgcagacctggatccgtag

SEQ ID NO: 24719 - DNA, 7134 bp, Artificial Sequence
  Description of Artificial Sequence: Synthetic coding sequence
atggacgaggaagaagatggcgctggagccgaagagtctggacaacctcggtcgtttatgcgtctgaatgacttgtccggcgctggcgggcgtccgggacccggcagcgctgagaaagaccccgggagtgcagattcagaggccgagggattaccttacccagccctcgcacctgtggtattcttctacctaagccaggacagtcgcccacggtcttggtgcctccgtaccgtgtgcaacccctggttcgaaagaatctccatgctcgtcatccttctgaactgcgttacacttgggatgttcagaccctgtgaggacattgcctgtgactcgcagcggtgtcgcattctccaggcgttcgatgacttcatttttgctttttttgctgtggagatggtggtaaaaatggttgcactgggtatttttggtaaaaaatgttacctgggcgacacttggaaccgattagatttcttcattgtgattgccggaatgctggagtattccctggacctccagaatgtctctttctcggcagtgcgtacagtgcgagtcctgcgtcccctgagggccatcaaccgtgtcccttcaatgcgcatccttgttacattactccttgatacgttgccgatgttaggcaacgtgttacttctttgtttcttcgtattttttattttcggtatagtgggcgtgcagttatgggccggactgttgcgaaataggtgcttcttaccagaaaatttttcactgcctctgagcgtcgatttggagcgctactaccaaactgaaaacgaggatgagtcgcctttcatatgttcacagcccagagaaaatggcatgaggagctgcaggagtgtgccgacccttaggggagacggcgggggaggtcccccctgtggactggactacgaagcctacaattcctcaagtaatacaacgtgcgtgaattggaatcaatattatacaaactgttcagcgggcgagcataatccatttaagggggctataaattttgataacattggctacgcctggatcgccatctttcaggtaattacactggagggctgggtggatataatgtatttcgtaatggatgcccattccttttataatttcatctacttcattctcctcatcatcgtaggaagctttttcatgattaacctgtgcctggtggttattgctacacaattctcggagacaaagcaacgcgaaagccagctgatgcgtgaacagcgtgtgaggtttcttagcaacgcgtcgaccttagcttccttcagcgagcccggaagctgttacgaagagttgctgaaatacctggtctatattctccggaaagcagctaggcgacttgcccaggtatccagggccgccggagtccgcgtcggactgttgtcatctcctgccccgttgggcggccaggagacccagccaagctcaagctgctctcggtcccatcggcgactgtctgttcatcatctggtgcaccaccatcaccaccatcaccatcactatcatctgggcaatggtaccctgagggccccacgcgcatctcctgaaatccaagacagagatgccaacggctcccgaaggctgatgctccctcctccctctacgccggccctgtccggcgcaccacctggaggagccgaatctgtccactcattctaccacgccgactgtcatttagagccagtccgctgtcaagcccctccaccaagaagtccttctgaagcaagtgggcgcacggtcgggtctggcaaggtgtaccctacagtgcatacatcacccccgccagagactttgaaggaaaaagccctggtggaagttgcagctagttccggccctcccacactgacctcactgaacatcccaccagggccgtactcaagcatgcataaactgctggagactcagtctacgggggcctgtcaaagttcatgcaaaataagttcaccctgccttaaagcggattccggcgcatgcggtcctgacagttgcccttattgcgcacgggccggggctggggaagttgagctcgcagacagagagatgccagactcagatagtgaagccgtctatgagttcacccaggacgcacaacactctgacctacgggatcctcattctaggcggcagaggtcactcgggcctgacgcggagccgtctagcgttcttgcgttctggcgcctgatctgtgacactttcagaaaaatcgtcgactcaaaatacttcggacgcgggatcatgatagcaatcctcgtgaatacgttaagcatggggattgagtatcatgagcaacctgaggaactgacaaacgcccttgaaatcagtaatatcgtgtttaccagcctcttcgctcttgaaatgctccttaagctgctcgtgtatgggccttttggatatattaaaaacccctataatatctttgacggagtcatcgtcgtgatttcagtctgggaaatcgtggggcagcagggagggggtttgtccgtgctgagaaccttccgtcttatgagggtacttaaactggtgagattcttgccagcactccagaggcagcttgttgtcctgatgaaaaccatggataacgtggctacgttctgtatgctcttaatgttgttcatattcatattcagtatactgggcatgcacctgttcgggtgcaaattcgcctccgagagggatggtgacaccctcccagaccggaaaaacttcgatagtttactgtgggccatcgtgaccgtgtttcagatcttaactcaggaagattggaacaaagtgctctataatggtatggcttccacatcttcttgggccgccttatattttatcgccctgatgacattcggcaattacgtgttgtttaaccttctggtcgctattctcgtcgaaggctttcaggccgaagagatctctaaacgtgaagatgcaagtggacagctgtcctgcatccagctcccagtcgatagccagggcggagatgcgaacaagtctgagtccgaacctgatttcttctctccctccttggacggcgatggggatcgaaaaaaatgcctggcccttgtctctctgggagagcacccggaattgaggaaatctcttctgcctcccctaatcattcacacagccgctaccccaatgtcattgcctaagtccacctccacagggttaggcgaagctctcggccccgcgtcacgccggacgtcttcatcaggctcagcagaaccaggcgctgcacacgaaatgaaatcgcctcccagcgccagaagcagtccccactctccatggtccgctgccagttcctggacaagcagaaggtccagcagaaacagcctagggagggccccgtccctgaaacgcaggtcacccagtggagaacgcagatccctcctctcaggcgagggtcaggagagtcaggatgaggaagaaagcagtgaggaagagcgcgcctcccccgccgggagcgaccaccgtcaccggggaagcctggagagagaggcaaagagtagtttcgacctacccgacaccttacaggtgcctgggctccacagaaccgcctccggtcggggtagtgcatccgagcaccaggattgtaacgggaagagtgcctccggaaggcttgctcgggctctccgccccgacgatccaccattggatggagacgatgcagacgacgaaggaaatctcagcaaaggggagagagttcgggcctggatccgcgcccgtcttccggcttgctgtttggaacgggacagctggtccgcatatatcttcccgccacagtccagattccggctactttgccataggataataactcacaagatgttcgatcacgtggtactggtgatcatcttcctgaactgcatcacaattgccatggagaggccaaagatcgatccccactcagccgagcggatctttctgaccctgtctaactacatcttcacagctgttttcctcgcggaaatgaccgtgaaggtggtcgctttgggatggtgctttggggaacaagcatacctcagatcctcctggaacgtgctggacggcctgttggtcctgatctctgtgattgacatcctcgtcagtatggtgtcagactcaggcacgaagattctgggcatgctgagagtactgcgtttactacggacactgaggccgctgcgagtgatcagtagagctcaggggctgaaacttgtggtcgaaacactgatgtcaagtctgaaacctattggcaatatcgttgtaatctgctgcgccttctttatcatcttcggaatactgggcgttcagcttttcaagggcaagttttttgtatgccaaggggaagatacccgcaacattaccaataagagcgattgtgccgaagcaagttataggtgggtgagacataagtacaatttcgacaatcttggccaggcactgatgtcactgtttgtgttggccagtaaggacggttgggttgacataatgtatgatgggctggacgctgttggagtagaccaacagcctataatgaaccataatccctggatgctgctttacttcatttccttcttgctgatcgttgccttcttcgtgctgaacatgttcgtcggagttgtagtggagaacttccataagtgtcgccagcaccaggaagaagaggaggctcggcgcagggaagaaaagaggctgaggcgtctcgagaagaaaaggagaaacctgatgctggacgacgtgatcgcttccgggtcctctgcaagtgcggcatctgaggcacagtgtaagccttactattctgactactctaggttccgactgttggtgcaccacctgtgtacttctcattacctcgacctgttcattacaggggttatcgggttaaacgtggtgactatggctatggagcactaccaacagccccagatccttgatgaagcactcaagatttgcaattatatcttcaccgtgattttcgtactcgaatccgtgtttaaactggtcgcatttggatttaggagattcttccaggatcgctggaatcagttggatctagccatcgttttgctctccattatgggaatcactttggaggaaatagaggtgaatgccagcctaccgatcaatccaactatcatcagaattatgcgagtcctgcgaatcgccagagtattaaaactcctcaagatggccgtgggcatgcgggcactgctcgatacggtgatgcaggcattgccacaggttgggaacttgggtctgctttttatgctcctcttttttatcttcgccgcactgggtgtcgagttattcggtgacctcgagtgtgacgaaacccacccttgtgaggggcttggccgccatgccacatttagaaattttggtatggcttttctgacccttttccgggtttctacgggagataattggaatggaataatgaaggataccctgcgtgactgtgatcaggaaagtacttgttacaacaccgttatcagcccaatttattttgtgagttttgtgctgaccgctcagttcgtcctggttaacgtggttatagctgtgctgatgaaacaccttgaagaatctaacaaggaggccaaagaagaggccgaattggaagccgagctagagctcgagatgaaaaccctttcgccacagccacactctcccctaggaagtccatttttgtggcccggcgtggaaggaccagacagcccagactctccgaagcctggggcactccatccggctgcccacgcccggagcgccagtcatttcagtctcgaacatcctacagatcgacaactgtttgatactataagcctcctcattcagggaagtctggagtgggagctcaagctcatggacgaacttgcgggcccaggaggccaacctagcgccttcccctccgccccctcgttaggaggctccgatcctcagattcctcttgcggagatggaggccctgagcctaaccagtgagattgtctcggaaccgagctgttccctcgccctaaccgacgattctttgcccgatgacatgcataccctgcttctgagcgctctggagagcaacatgcagccacatcctaccgagctgcccgggcctgacctgttgacagtacgtaagtccggggtttcccggactcactccctcccaaacgactcatatatgtgccgacatggtagcaccgccgaggggcctctcggacatagaggttggggcttacctaaagcgcagagtggctccgttttgtctgtgcacagtcaacctgctgataccagttatatcttgcagctgcccaaggatgcaccccatttactccagcctcattctgccccaacatggggtacaattcccaaactcccaccaccaggccgctcccccctggcgcagcggccccttcgccgacaggccgctattcggactgattctctcgatgtgcaagggctgggcagtcgcgaggatttgctggccgaggtgtcaggcccctccccgccacttgcacgtgcatactctttttggggacaatcatctacccaggcccaacagcactctcgctcccactctaaaatctcaaagcacatgacaccaccggctccttgtcctggccctgaacccaattgggggaaaggccccccagagacgaggtccagcttggagctcgatactgagctgtcctggattagcggggacctgcttcctccggggggccaagaggagccacctagccccagggacctgaaaaagtgttatagcgtggaagcacaatcttgccagcgcagacccacctcgtggttggatgagcaacggaggcattcaattgccgtgagctgcttagactcagggtcccaacctcatcttggaacggacccatcaaacctcgggggccagccattgggcggccccggcagccgcccaaagaaaaaattaagtcccccttccattactattgatcccccagagtcacagggaccccgaacccccccatcacctggtatctgcctacgacgcagggccccttcatccgactcaaaagacccattggccagtgggcccccagactccatggctgcctcccctagtcctaaaaaggatgtgctttctctttccggcctgtcatcagatcccgcggatttagatccctag

SEQ ID NO: 24720 - DNA, 6786 bp, Artificial Sequence
  Description of Artificial Sequence: Synthetic coding sequence
atggatgaggaggaagatggagcgggggccgaggaatccggtcagccgcgcagcttcatgagacttaacgacctgagtggagccggaggtcgcccaggtccgggctcggccgagaaagacccagggtccgcagactcagaagccgaggggctgccttaccccgccctggcaccagtagtgtttttttacctctcacaagatagtcgtccacgatcttggtgtctgcgcactgtgtgcaatccctggtttgaacgtataagcatgctagtgatattgctcaactgtgtaacactgggaatgtttaggccatgcgaagacatcgcatgtgattcccagcgatgccgtattctccaggcatttgacgatttcatcttcgcattcttcgcggtggagatggtggtaaaaatggtggctctgggaatcttcgggaaaaaatgttacctcggcgacacatggaaccgcctcgactttttcattgtgattgccggaatgttggagtacagcctggatctgcagaacgtatcattctccgcggtgcgcactgtgcgggtcctgcggcccctgagggccattaaccgcgtgccatccatgcggatcctggtgaccttgctgcttgacacgctgcccatgttgggaaacgtgcttttgctctgtttcttcgtgttctttattttcgggatcgttggggtccagctctgggcagggctgctgcgcaatcgctgcttccttccagagaacttttctttgcctctctccgtggatctggagcggtactaccagactgagaatgaagatgagtctcctttcatctgcagccagccaagagaaaacggcatgcgaagctgtcggagcgttcctaccctgagaggagatggtggcgggggccctccctgcggcctcgactacgaggcttacaacagctcatcaaatacgacatgtgtgaattggaaccagtactacacaaattgttccgccggggaacacaaccctttcaaaggcgccattaacttcgacaatatagggtatgcttggattgccatcttccaagtgatcacattggagggttgggtcgatatcatgtactttgtgatggacgctcacagtttctataactttatctacttcatactgctaatcattgtgggctcttttttcatgattaacctttgcctcgtggtcatcgccacccagtttagcgaaaccaagcagagggagtctcagttaatgagagagcagcgcgtgcgctttttgtccaacgctagtaccctggccagtttttccgagcctggatcctgctacgaggagcttctcaagtatctcgtttatatactcagaaaagccgcgaggcgactcgctcaggtatcacgggccgctggcgtgcgcgttggcctcctttcctcaccagcgcccctggggggccaagaaacgcagccatcttcctcttgtagccggtcacatagacggctatctgtgcatcatctggtgcatcaccaccaccaccatcaccatcattaccacttaggtaacggcaccttaagagccccacgcgcgtcacccgagatccaggacagggacgcgaacggttctcggcgtctcatgttgccaccacctagcactcccgcactgtcaggcgctcctcctggaggtgccgaaagcgtgcattccttctatcacgcagattgccacttggagccggtaagatgccaggctcctcctcctcggtctccgtccgaagcaagtggcagaactgtggggagtggaaaggtgtaccccaccgtacacactagtcctccccccgagactctaaaagaaaaagccctcgttgaggttgccgctagcagcggtccacccaccctgacctcccttaatatccctcctggaccttattccagcatgcataaactgctggagacccagtctaccggcgcatgccaaagctcttgtaagatatccagtccatgtctgaaagccgattctggagcctgtggcccagattcatgtccctactgcgctcgcgcaggtgcaggggaggtggaactcgccgacagggaaatgcccgacagcgactcagaagcggtttatgagtttacccaagatgcgcagcatagcgacctgcgggaccctcattcacgtagacaacggtccctcggacccgacgcggagcccagttccgtgctggccttctggaggctcatatgcgatacttttcgtaagatcgtcgacagcaagtacttcggtcggggcatcatgatcgccatacttgtcaacacattgtctatgggaatcgaatatcatgaacaaccggaggagctgactaatgcattagagatctctaatatagttttcaccagtttgttcgcactcgaaatgctcctgaaacttttagtttacgggccttttggctacatcaagaatccgtataatatttttgatggtgtgatcgtggtcatcagcgtttgggagatcgttggtcagcaggggggggggctgagcgttctgcggaccttcaggttaatgagagtcctgaagctggtccgcttcctaccagccctccagaggcagctggtggttctgatgaagacaatggataacgtggccacattttgtatgttgctgatgctctttatttttattttttctatcctaggcatgcaccttttcggatgtaagttcgcttccgagcgcgacggcgatacactgccagacagaaagaattttgacagcctgttgtgggctatcgtgaccgtgtttcagattctgacccaagaggactggaacaaggtactatataacggaatggcgagtaccagcagttgggctgctctttatttcattgcactcatgacattcggtaattacgtgctgtttaaccttttggtggccattctggttgaaggctttcaggccgagggcgacgctaacaagtctgagtcagagcccgatttcttcagtccaagcctggacggggacggcgacaggaaaaaatgtctcgccctagtgtcccttggggaacaccccgagttacgcaagagcctgctgcccccattaatcattcataccgccgctactcctatgtctttgcccaagagtactagcaccggactgggtgaggccctgggacccgccagtaggagaacctccagttctggctcggctgaacccggggcagcacacgagatgaagtcccccccctcggctcgctcttctccacactctccttggtcagccgcctcatcctggacctcaaggaggagctcccgtaatagcttggggagggctccgtccctcaagcgaaggagtccgagtggagagagaaggagccttctcagcggggaggggcaggagagccaagacgaggaggagagtagcgaagaggaacgtgcttcaccggcaggaagtgatcacagacaccgcggatcactcgaacgcgaggccaaaagttcatttgatttgcccgacaccttacaggtgcctggcctgcacaggacggcctccggccggggttccgcgagtgagcatcaggattgcaatggaaaaagtgccagcggaagactcgcacgggccctacgccctgatgatccaccactagacggggatgatgctgacgacgaggggaacctctcaaagggcgagcgcgtcagggcctggatcagagcacggcttcctgcatgttgcctggagcgcgattcatggagcgcatatatctttcccccccagtcccgtttccgcctcctgtgtcataggataatcacacataagatgttcgaccatgttgtgctggtcattatttttctcaactgcataacaattgccatggagcgcccaaaaatcgaccctcactccgctgaaaggatattcctcacactgtcaaactacatttttaccgctgtcttcttggcagagatgaccgttaaggtcgtggctcttggttggtgttttggagagcaggcttaccttcggtcttcctggaacgtgctggatggcctcctggtgctcatcagcgtgattgatatactcgtgagtatggtcagcgactcagggaccaaaatccttgggatgctgagggttctgagactcttgcgaactcttaggcctttgagagtgattagtcgggcccagggcctgaagctcgtggttgaaaccctcatgagctctttaaaacctattggcaacatcgtggtgatttgttgtgcgtttttcatcattttcgggatcctcggggtccagctgtttaaaggaaagttcttcgtttgtcagggagaggacacaagaaatattacaaataagagcgactgtgccgaagcctcatacagatgggttcgtcataaatacaatttcgataatctcgggcaggcccttatgtctttgtttgtgctcgcctccaaagacggttgggtggatatcatgtatgatggtctcgatgctgtaggtgtggaccaacagccaattatgaatcacaacccttggatgcttctttattttatatccttcctgttgatagttgcttttttcgttttgaacatgtttgtgggggttgtcgtggaaaacttccacaagtgccggcagcatcaagaagaagaagaagctagacggcgagaggagaagagactccggcggctggagaaaaagagaagaaatctcatgctggatgacgtgatcgccagtggttcatccgccagcgcggccagtgaggcccagtgcaagccatattattccgactattcgaggtttcggctgcttgttcaccatctttgtacttctcactacttagacctcttcattactggggtaattgggctaaacgtggttactatggccatggaacactatcaacagccgcagatccttgacgaggctctcaagatttgtaactatatcttcactgtgatttttgtcctggaaagtgtattcaaactcgtggcctttggattccggcggtttttccaagacaggtggaaccagctggaccttgctatcgtgttgctgtcaatcatgggaattaccttagaggagattgaggtgaacgccagcttgccaatcaaccctactattattcggatcatgcgggtgctcaggatcgctagagttttgaagctccttaaaatggctgtaggaatgagggccctactcgatactgtgatgcaggcgttgccgcaagtgggcaaccttggacttttattcatgctgctgttctttatctttgccgccctgggcgtggagctctttggggatttggagtgtgacgaaacacatccttgcgaaggactcggaaggcatgccacctttagaaacttcggcatggccttcctgactctattccgcgtaagcaccggcgacaattggaacggcatcatgaaagataccctccgggattgtgaccaggaatccacatgctacaataccgtgatttccccgatttactttgtgagtttcgtgctgacagcacagttcgtcctcgtgaatgtcgtgattgcagtgctcatgaagcacttggaagagagcaacaaagaggctaaagaagaagccgagctggaagccgaacttgagctggaaatgaaaaccctgagtccacagccgcactcacctctcggttcccccttcctttggcccggcgtggaggggccagactcccctgacagcccaaagcctggtgccctacaccctgccgcccacgctcggtctgcaagtcatttctcactcgaacaccctacaatgcaaccccacccaactgagctccctggcccagacctgctgactgtgcgtaaatccggggtgtctcgcacacactccttgccgaatgactcatatatgtgccgtcacggctcaacagcggaggggcccttaggccacaggggctgggggttacctaaggcgcagagtggatcagtgctgtccgtgcattcgcaacccgccgacacctcctacatcctgcagctgcctaaagacgcccctcatctgttacagccacattcggctccaacctggggaaccatcccgaagctgccaccacccggcagatcccctctggctcagaggccattgcgcaggcaggccgcaatccgcacagactccctagatgtacagggcctgggttccagggaagatctgctggccgaggtgagtggcccaagtcctccactcgccagagcttattcgttttgggggcagagttcaacacaggcccagcagcactcaaggtctcattccaagattagtaaacacatgacccctcctgccccctgccctggaccagagccgaattggggcaagggccccccggagactcgcagtagcctggagctggataccgaactttcctggatctccggagacctgttgccgcctggaggccaggaagagcccccgagcccgagagacttaaaaaagtgttactctgtggaggcccagtcatgtcagagaagacccacgtcttggcttgacgagcagcgtaggcatagtatcgccgtgtcttgtctagactcaggcagccagccccacctggggactgatccctccaatctgggaggccaaccgctgggcggaccaggctcccgacccaaaaagaaactttcacctccctcaatcaccatcgatccccctgagagccagggacccaggacccctccttcacctggaatttgtttacgcagaagggcacctagcagtgactcaaaggatccccttgcatcaggtccaccagactctatggctgctagtccatcccccaaaaaagatgttctgtctcttagcggactttcgtccgaccctgcggacctggatccttag

SEQ ID NO: 24721 - DNA, 4668 bp, Artificial Sequence
  Description of Artificial Sequence: Synthetic coding sequence
atggacgaggaagaagacggtgcaggcgccgaagagagcggccagccacgaagcttcatgaggcttaatgatctttccggcgccggcggccggccggggcctggctcagcagaaaaggacccaggcagcgccgactccgaggcggagggcctgccatatcctgccctcgcacccgtagtctttttttatctgtcacaggactcaaggcccagatcatggtgcctgagaactgtctgtaacccttggtttgaacggatatccatgttggttatactgctaaactgtgtaactctcgggatgtttaggccgtgcgaagatatagcctgtgattcacagagatgcagaatcctccaagccttcgatgacttcatcttcgcattcttcgccgtggaaatggtcgtgaaaatggtcgccctcgggatttttggcaagaagtgttacctcggagacacctggaacaggctggatttctttatagtcatcgccgggatgctcgaatatagcctagacctgcagaacgtttcattttcagccgtcagaaccgttcgcgtcctgcggcccctgagggcaattaaccgtgtgcccagcatgcgcatcctagttacactgttgctggacaccctgccaatgcttggcaatgtgctgttactatgcttcttcgtgttttttatcttcggtatcgtgggcgtgcagttatgggcagggctgctccgcaaccgttgttttctcccagaaaatttcagcctgccactttctgttgacttagaacggtattatcagacagagaatgaggatgagagcccattcatatgtagccagccccgagaaaatggaatgcgttcttgcagatccgtcccaacactgcgtggcgacggtggggggggccccccctgcggtttggattacgaggcgtacaacagtagctccaataccacatgcgtcaactggaaccagtactatactaattgcagtgcaggagaacataacccattcaagggcgctatcaatttcgacaatataggctacgcctggatcgctatcttccaggtcatcacccttgagggctgggtggacattatgtacttcgtcatggacgcccattcattttataactttatttatttcattctgttaatcatcgtggggagtttcttcatgatcaatttgtgtcttgtcgtaatcgccacccagttcagtgaaacgaaacagcgggaatctcagctcatgcgcgaacagcgcgtccgcttcctaagcaatgcatcgactctggcttctttctcagagccggggagctgttacgaggagctgcttaagtacctcgtgtacattttgcgaaaggccgctcgacgtttagcacaggtctctcgggctgctggcgtgcgggtcggcctcctaagctcccctgcccccctgggcggacaagaaacacagccctcatccagctgtagccggtcacaccgccgcctgagtgtccaccatctggtccatcaccaccaccaccaccatcaccattatcatttaggtaacggaaccctgagggctccgcgggcgtcgcccgaaatccaggacagggatgcgaacggctccagacggttaatgctgccacccccttctacacccgcgctctctggcgcccctcctggaggcgctgaaagtgtgcactccttttaccacgcagactgtcacttggagcccgttaggtgccaggcccccccgccccgttcaccaagtgaagcctcaggacggacggttggttcaggcaaagtgtatcctacagtgcacacttctcctcctccggagaccctgaaggagaaggcattggtcgaggtggctgctagttcaggcccaccaacactcacgtctctcaatatccccccgggaccctattcgtccatgcataagttgctcgagacccagtctaccggcgcttgtcagagttcatgtaaaatcagtagcccttgtttgaaggcagattcaggcgcctgcgggccagattcatgcccctactgtgctagagctggcgccggcgaggttgagctggcagatcgggaaatgccagatagcgacagtgaggctgtgtatgaattcacacaagacgctcagcactccgacctgcgagacccgcactccaggcgacagcgttctctgggccctgatgcggaaccgtctagtgtcctggctttctggagactgatttgcgatacatttaggaaaatcgtggactccaaatacttcggtagaggtatcatgatcgcaatcctggttaatacactgagtatgggcatcgaataccacgaacagccagaggaattgaccaacgccctggaaattagcaatatagtgtttaccagtctgttcgcactcgagatgctactgaaactgctcgtctatggcccttttggctacatcaagaacccctataacatttttgatggcgtgatcgttgtcatcagcgtctgggagattgtagggcagcaaggcgggggcctaagcgtgctgcggacgtttcgcctcatgcgcgtcctcaaactcgtgaggtttctgcccgccctgcaaaggcagttagttgtcctgatgaaaactatggacaacgtggcaaccttttgtatgcttctcatgctcttcatattcattttttctatcctgggcatgcaccttttcggctgtaagttcgcctctgagcgagatggagatacactgcccgatagaaaaaacttcgatagtctcctatgggcaattgtgacagtctttcagatcctgacccaggaagactggaacaaagttctctacaacggcatggcttcaacatcttcctgggccgcactgtacttcattgccctgatgacattcggaaactacgtgttattcaatctactggtcgccatcttggtcgaggggttccaggccgaggagatcagcaagagggaggatgcatctgggcagttgtcatgcatccaactgccagttgattcccagggaggagatgcaaacaaaagcgaaagcgaaccagacttcttcagccctagtttggatggtgacggagaccgaaagaagtgtcttgccctggtgagcctgggtgagcaccccgagctgagaaagagtttattgcccccccttatcatccacactgcagcaaccccaatgagtctgcccaagagcacgagcacagggctgggagaagcactaggcccagcgtccaggcgaaccagttcatctggtagcgctgaaccgggtgccgcacatgaaatgaagtcgccccccagcgctcgcagctccccccattccccttggtcggcagcaagcagctggactagtcgacgctcgtcaaggaattccctggggcgggctccttcattaaagaggcgcagtccaagcggagagagacgctcattgctgtcaggcgaggggcaagaaagtcaagacgaagaggagtccagtgaggaggaacgcgcaagccccgcaggctccgatcatagacatcgtggctctctcgagagggaagcaaaatcaagtttcgatctccccgacacactacaggtgcccgggcttcacaggacagcttcagggaggggatctgcatccgaacaccaggactgtaatggaaagtcagccagtgggcggctagctcgagccctgcgacctgatgatccccccctggatggtgatgacgccgatgacgagggtaacctgtcaaagggtgagcgagttagagcttggatcagggcgcgcctgccagcctgctgtttggaacgtgacagctggtcagcatacatctttcctcctcagtctcgctttcggctgctgtgccacaggattatcacccacaaaatgtttgaccatgtggttctcgtgattatttttctcaactgcatcaccattgcgatggaacgacccaagattgaccctcacagtgctgagcgcatctttcttacactcagcaattacattttcaccgcagtttttctcgcagaaatgactgtgaaagtggtggctctgggatggtgcttcggcgagcaagcctacctgcgatcatcatggaatgtgctggatggactgcttgtgctcatttcagttattgacattcttgtgagtatggtgtccgactccggcacaaaaattctgggaatgctcagggttctccgacttttgcgaaccctgaggcctctcagggtaatttctcgcgcccagggtctcaagctggtggtggagactttgatgtcctccctgaagcctattggcaatatcgtcgtcatctgctgcgctttctttatcatattcgggatattgggagtgcagctttttaaagggaaattcttcgtctgccagggtgaagacacaagaaatatcacgaacaagtccgactgcgccgaggcttcataccgatgggtgcgccacaagtacaattttgacaatttgggccaggtcagtccaaggcttcgcgggggtgccgtggtgaaagaagcagggggtggcacagggccatgtctcgttattcctgcagacagcgggggaggggggctccacgaggaaatttcaccctcccatccactgctctcgaaccatcagcatgtggccaaaccatctccaagtcatagtgcaccaaaaagcggcccaatgggcagcctggctgtgttgaaagatgaggagactgaggcccagcgggggtag

SEQ ID NO: 24722 - DNA, 6801 bp, Artificial Sequence
  Description of Artificial Sequence: Synthetic coding sequence
atggatgaggaggaggacggcgccggcgcagaggaatctggacagccacgtagctttatgcgcctcaacgacctgagtggcgctggaggcaggccaggtcctggctcggccgagaaggaccccggctcagcggactccgaggctgaaggcttaccctatcctgctctggctccagtagtgtttttttatttatcacaagattcccggccaaggagttggtgtctgagaaccgtgtgcaatccttggttcgagcgtatttcgatgctcgtcattctactcaattgtgttacattgggaatgtttcggccgtgcgaagatattgcctgtgactctcagaggtgcagaattttgcaggccttcgacgattttatatttgctttcttcgccgtggagatggtcgttaagatggtggctctcggaatctttgggaagaagtgttacctcggggatacctggaatcggctggatttcttcatagtgatagccggcatgctcgagtatagtctagatttgcagaacgtttccttctcagcagtgaggacagtgcgagtgctcagaccgctgagagccattaaccgggtcccttcaatgcggatcctggtcacactgctcttggacaccctgcctatgctcggcaacgtacttctgttatgtttttttgtgtttttcatattcggcatcgtgggtgttcagctgtgggccggtcttcttaggaatcgctgtttcttgccagagaatttctcccttccgttaagtgtagatctcgagagatactaccagaccgagaatgaggatgaatctccgtttatttgtagtcagcctagggagaacggtatgcgctcttgcagatccgttcccaccctaaggggagatggtgggggaggaccaccctgtggactagactatgaggcatacaatagctctagcaataccacatgtgtgaattggaaccagtactacaccaactgctctgccggagaacacaacccattcaaaggggctattaacttcgacaatatagggtacgcttggattgcaattttccaggtgataacactggaggggtgggtggatatcatgtatttcgtcatggatgcccactccttttataatttcatttactttatattgctcattattgtgggctccttctttatgataaacctgtgcctggtcgttatcgcgactcagttcagcgagactaagcagagagagagccagctgatgcgcgagcagcgggtcagatttctctccaatgcctctactctggccagtttcagtgagccgggctcctgttatgaggagctactcaagtacctagtgtatatattgagaaaagcagcccgacggctggcacaagtctcgcgcgcggccggtgtgcgcgtgggcctgctgtccagtcccgccccattgggtggacaggagacgcagccaagctcatcatgttcacggagtcaccgtcggcttagcgttcaccatctggttcaccaccatcaccatcaccatcaccattatcatttgggcaacggtactcttcgggcccctcgagcctcacctgaaatccaggacagagatgcaaatggatcccgaaggttgatgctgccaccgccctctactcccgccctgtccggcgcacccccaggaggcgccgagagcgtgcacagcttctaccacgcagattgccacttggaacctgtgcgttgtcaggcccccccccccagaagtccaagcgaggcatccggtcggaccgtagggtcgggcaaagtgtacccaactgtgcatacctctcctcccccagaaaccctcaaagaaaaagcactggtcgaggtagccgcttcaagtggtcctcccactcttacctctctgaatatcccccccggtccatacagttcaatgcacaagctcttggagactcagagtacgggcgcatgtcagagcagttgtaagatatcaagcccttgtttgaaagccgattctggcgcctgtggacctgacagctgtccatattgcgccagagccggcgcaggagaagtggagctggcagacagagagatgcctgattccgatagtgaggccgtgtacgaatttacacaggatgcgcaacattccgatcttcgagacccacattcgcgccgacagaggagcctggggcctgacgcggaaccctctagtgtgctcgcgttctggagactgatctgtgacactttccgtaagatagtcgactctaaatattttggtcgagggatcatgatagcgatactggtgaatacactctccatgggaattgaatatcatgagcagccagaggagctgaccaacgccctggagatctccaacatagtgttcaccagtctgtttgcactcgagatgctcctgaaactgctggtgtacgggccgttcggctacattaaaaacccatataacatcttcgatggtgtcattgtggtgatcagcgtgtgggagatcgtggggcagcaggggggaggactctctgtgctccgaaccttcaggctcatgcgggttttaaagctggtgcgttttttaccagccctacaacgccagttagtggtgcttatgaaaaccatggataacgtggccacattctgtatgctcctcatgctttttattttcattttttctatcctgggcatgcatcttttcgggtgtaagttcgcttcagagagggacggcgatacgctgcctgacagaaaaaattttgacagtctgctgtgggctatcgttaccgtgttccagatcctcacccaggaggactggaataaggtattatacaacggcatggcttctacttcctcctgggccgccctgtatttcatcgcccttatgacgtttggcaactacgtgctgttcaatcttctggtggcaattctagtggaggggtttcaggccgaggagatcagtaagagagaagacgcctcaggccagctgtcatgcatacagctgcccgttgacagccagggcggagacgctaataaatctgagagcgagccggatttcttctctccgagtctggatggcgatggggatagaaagaaatgcctggcactagtttctcttggtgaacacccagaactcaggaagagcctgctgcctcccctgatcatccacacagcggcaacccccatgagcctaccaaaatccacaagcacaggactcggcgaagcactgggccctgcctcccggcgaacatcctcctcaggatccgccgagcctggcgccgcgcacgagatgaagagccccccatccgctagaagttcacctcatagtccgtggagcgcagctagttcgtggacttctcgccgtagctcacggaacagccttggccgtgcccccagtcttaaaagaaggtctccaagtggggagcggaggagcctgcttagtggagaaggacaagagagtcaagatgaggaagagtccagtgaggaggagagggcgtcgcctgccggttccgaccatcggcatcgggggtcgctagagcgcgaggccaaaagttcctttgacctgccggacactctgcaagtgccggggcttcatcggactgcaagtggtcgaggatctgcctcggaacaccaggattgtaatggcaaatcggcaagcggcagactggcccgcgcgttacgtcccgatgatcccccgttggacggggacgacgcggatgatgagggtaacctgtcgaaaggagagcgcgtccgcgcttggataagagcacgcctccctgcctgctgccttgagcgagattcgtggagcgcttacatcttccctccccagagtagatttaggcttctctgccatcgcatcattacccataaaatgtttgaccacgtggtcctagtaatcattttcctcaattgtattactatcgctatggagcgccccaagatcgatcctcacagtgccgaacggatttttttgaccttatccaactacatttttacggcagtcttcttggcagaaatgacagtgaaggtggtcgcgctgggctggtgtttcggcgaacaagcatacctgaggtcttcgtggaacgtcttggacgggctgctggtgttgattagcgttatagacatcctggtgtctatggtgagtgattcaggcacaaaaattctcggaatgctgcgcgtcctccggcttctaaggacactgcgccccctacgggtcatttcccgcgcccagggccttaagctggttgtggagaccctgatgagctcactgaagccgattggaaacattgtggttatctgctgtgcctttttcattattttcgggatcttgggtgtccagctgttcaaagggaagttcttcgtgtgtcaaggcgaggacacccggaatatcacaaacaaatccgactgcgcagaggcctcctaccggtgggtgaggcataagtataacttcgataacttgggccaggctttaatgtctctttttgtactggcttccaaagatgggtgggtcgatataatgtatgacggtctcgatgctgtgggcgtcgaccagcagccaattatgaaccacaatccttggatgctactgtactttatcagtttcctcttaatcgtggcattctttgtcctcaacatgtttgtgggcgtggtcgtggaaaatttccacaagtgcaggcagcatcaggaggaggaggaagcccgcagaagggaggaaaaacgcttgaggcgcctggagaagaagcgccgtaaagcccagtgtaaaccctactactcagattatagccgcttcaggctcctggttcatcacctctgtactagtcattacttggatctcttcatcacaggagtaataggactaaacgttgtgacaatggctatggagcactaccagcagccccaaatcctggacgaagcccttaagatctgtaactatatcttcactgtgatcttcgtactggagtcggtgttcaaattggtggcctttggtttcagacgatttttccaggacaggtggaatcaactggacctggctattgtactcctgtctataatgggcattactctcgaagaaatcgaagtgaatgcgtccctgccaatcaaccccactattatccgaattatgcgcgtgctgaggatcgcccgggtactgaagctgctgaagatggccgttggtatgcgagcacttctagataccgtgatgcaggcgctgccgcaagtggggaacctgggcttgctctttatgctgctgttcttcatctttgccgccctcggcgttgagttattcggtgatctcgaatgcgacgagacacatccttgcgaaggactgggaagacacgcaacattccgcaactttggtatggcattcctcaccctttttagggtgagcacaggagacaactggaacggaattatgaaagatacactgcgggactgcgaccaggaatccacctgttataacactgtcatttcccccatttacttcgttagcttcgtcctgacagcgcagttcgtcctggtaaacgtggtgatagctgttctcatgaagcacctggaggagagtaataaagaagctaaggaagaagctgagctcgaggccgagctggagttagagatgaagactctgagcccgcagcctcatagtcccctcggctctcccttcctgtggcctggcgtggaagggccagattctcctgacagccctaaacccggagccctccaccctgcggcacacgcccggagtgcctctcatttttcactggagcacccaactatgcagccccatccgactgaacttcccggcccagacctgctgactgtgcgcaaatcaggggtgtcacggacccactccctccccaacgacagctatatgtgtcgccatgggagcacggcagagggaccactgggacataggggttggggcctccctaaggcacagtcgggaagcgtgctgagtgtgcattctcagcctgcggacacttcatatatcctgcaattaccaaaagacgcacctcatctcctgcaacctcactccgctcccacctgggggaccattcccaagctcccacctcccggcaggtctccgctagcccaaaggccactgaggcggcaggccgctataaggacagactctctcgatgtccaagggcttggaagtcgtgaggatcttctggcagaggtatccggtcccagtcctcccctggcgagagcctattccttctggggacagtcttccacccaggctcagcagcactccagaagccactcaaagatctccaagcacatgacccctcctgcaccttgccctgggcccgagccaaactgggggaagggtcctcctgagactcgaagcagtctggagctcgataccgaactttcatggatttccggggatctgttgcctccaggcgggcaggaggaaccacctagtccccgggatttgaaaaaatgttacagtgttgaggcgcagtcgtgtcagcggaggccaactagctggttggacgaacagcgcagacattccattgccgtctcctgcctggattccggctctcaaccccacctcggtacagacccgtcgaatctgggagggcaaccgctgggggggccaggatctagacccaaaaaaaagctgagccccccgagcattaccattgatcctcctgaaagccagggccctcggacacctccttcacctggcatctgcctgcggcggcgggctccttctagcgatagcaaagaccccctcgcctccggaccgcccgattccatggctgccagcccctctcccaagaaagacgtcctgtctctttccggccttagtagtgatccagctgatctagacccttag

SEQ ID NO: 24723 - DNA, 6732 bp, Artificial Sequence
  Description of Artificial Sequence: Synthetic coding sequence
atggacgaagaggaagacggggcaggggccgaggaatccgggcagcccaggagtttcatgaggctgaacgatctgagcggggcagggggacggcctggcccgggatctgccgagaaagatcccggctccgctgattcggaggctgagggattgccttaccccgcactggctcctgtcgtgtttttttacctgtcccaggactcccgtccacggtcatggtgtctacgaactgtgtgcaacccttggtttgagcggatcagcatgcttgtaatccttctgaactgtgtgaccttgggcatgttccgtccctgcgaagacatcgcctgcgattctcagcgatgtcgtatattacaagcgttcgacgactttatttttgctttctttgccgtggagatggtagtgaaaatggtcgctctcgggatcttcggcaaaaagtgttatctgggggacacatggaatcgactggacttcttcatcgtgatcgccggcatgctcgaatattccctggatctccagaacgtcagtttcagcgccgtcagaaccgtgcgggtccttcgtccccttcgcgcaattaaccgtgtgccctctatgcgaatcctcgtcacactgttactggataccctgcctatgctcggcaatgtccttttactgtgcttcttcgtgttttttattttcgggatcgtgggggtccaactctgggctgggctccttcggaataggtgctttttgccagagaacttttccttaccactgtctgtggacctggagcgttactatcagaccgaaaatgaggacgagtcccccttcatatgcagccagccaagagaaaacgggatgagatcttgccgctctgtccctacacttcggggcgacggtgggggagggccgccttgtggcttggattacgaggcctacaatagctcttccaataccacctgcgtaaattggaaccagtattacacaaattgtagcgctggggagcacaaccccttcaagggtgcgattaacttcgacaacatcggttacgcctggattgcgatattccaggtcatcaccttggaaggatgggtcgatattatgtattttgtgatggacgctcacagtttttacaattttatttactttattctgttgattattgtggggtcctttttcatgatcaatctttgcctggtggtcatcgcaactcagttcagtgagaccaagcagcgtgagtcccaactcatgagggaacagagggtgcgttttctctcaaatgcgagcacactcgcatctttttctgagccaggttcttgttacgaggagcttttaaaatatttagtgtatatcttgaggaaggccgcccggaggctggcacaagtgtccagggctgccggagtaagagtgggcctgttgtccagcccagcgccactgggtggtcaggagacacagccttccagctcctgctcaaggagccacaggcgactgtccgtgcatcatctcgtgcaccaccatcatcatcaccatcatcattaccatctcggaaatgggaccttacgagccccaagggcctcacctgaaatccaagatagagacgccaatggttcaagaagactgatgctgccacctccttcaaccccggccctttcaggcgccccgccaggcggggccgaaagcgtccactcgttttatcatgctgattgccacctggaacccgtgagatgtcaagcacctcccccaaggagtccatctgaagcttccggccgcactgtggggtcagggaaggtgtacccaacagtgcatacgtctccccctcccgagaccttaaaagagaaagcgctggtggaggtggcagcgtcctccggccctccaacactgacaagcctcaatatccctcctggcccatacagcagcatgcataagctgctagaaacacagtccaccggcgcttgtcagagcagctgtaagattagttctccctgccttaaggcagactcgggggcatgtggacccgactcatgtccttactgtgcccgggcaggggctggagaagtcgaattggcagatcgagagatgcctgactcggattccgaagcggtgtatgagttcacccaggacgcccagcactctgatctaagggaccctcattctagacgccagaggtcactgggcccggatgctgagccttcaagcgtgctggcattttggaggttgatctgtgacacctttcggaaaatcgttgattccaagtactttggacgagggatcatgatcgccattctggtgaacaccctgagcatgggtatcgaataccacgaacagccagaagagctgaccaatgccctggaaatctccaacattgtattcacctctttgttcgcactagagatgctactgaaactgctggtgtacggaccgtttggctatataaaaaacccatataatattttcgatggggtcatcgtcgtcatcagcgtgtgggagattgtgggccaacagggcgggggcctcagcgtccttagaaccttcaggcttatgagagttctcaagttggtgcgctttctacccgctctgcagagacagctggtagtcctgatgaagacaatggacaatgtggcaactttttgcatgctgctgatgctgtttatcttcatattctctatcctcggcatgcatctttttggctgtaaattcgccagcgaaagggatggtgacactctccctgatcggaaaaatttcgattcacttctatgggccatcgttacagtgttccaaatacttacacaggaagattggaacaaagttctgtacaacggaatggccagcacctcttcttgggctgcactgtatttcattgcactcatgacctttggtaattacgtcctctttaacctgttggtggcaatcctggtagaggggtttcaggctgaaggcgacgcaaataagagcgaaagtgaaccagacttctttagccccagcctggacggcgacggcgataggaagaaatgcctggcactagtttcacttggagaacatccagaacttaggaagtccctactgccacccctcatcattcatacggcagcaacaccgatgtccctcccaaagagcacttctacaggactgggcgaggcgctcggaccagcctctcgcaggacctccagctcagggtccgcagaacccggagccgcccacgagatgaaaagccctccgtccgcccggagttcaccccatagcccttggtccgctgccagctcctggacctctagacgcagcagcagaaattccctgggacgtgctcctagtttgaagaggagaagtccatctggtgaaaggagatcgctgttgtccggggaaggtcaggagagccaggatgaagaagagtcaagcgaagaagaacgcgcctcccctgctgggtcggaccatagacaccggggaagtctggagcgagaggcaaagtcttcattcgacttgcccgacacactccaggtgcctgggctgcaccgcaccgcctcagggagaggtagcgcgagcgagcatcaggattgtaacggcaaaagtgctagcggcagactggcgcgcgccctgcgacccgacgatcctcctcttgatggagacgacgcggacgacgaaggtaacctcagtaaaggtgaaagggtcagggcttggattcgagcgaggctccctgcctgctgtctggagagagactcctggtccgcctatatctttccaccccaatcacggttccgtctgctgtgccataggattatcactcataagatgtttgaccacgtggtgctggtgatcatctttctgaattgcatcacgatagctatggaaagacctaagattgacccccatagtgccgagagaatttttctgacactgagcaactacatatttacagccgtgttcctggccgaaatgacagtgaaggtggtggccttgggctggtgctttggcgagcaagcctaccttcgctcttcctggaatgtgctggatgggctcctcgtgctcatctcagtgattgacattttggtctctatggtttctgacagtggtacaaaaatactgggaatgcttcgggtgcttagactgctgcgaacgctgagaccgctccgggtgatcagccgggcgcagggactcaaactggtcgtggaaaccctgatgagctcccttaagcccatcggaaatatcgtggtgatctgctgcgccttcttcatcattttcggaatcctcggcgttcagctgtttaaaggaaagttcttcgtctgccagggggaggatactagaaacattaccaataaaagtgactgcgccgaggcttcgtacaggtgggtgcgccacaagtataacttcgataacctgggccaggcgctgatgtccctatttgtacttgcttctaaggacggctgggtagacattatgtacgacggccttgacgccgttggtgttgatcaacagcccattatgaaccacaacccatggatgctattatacttcatctcgttcctgctcattgtcgctttcttcgtcctcaatatgttcgttggcgtcgtggttgaaaatttccacaagtgcagacagcaccaggaggaagaagaggcacggagacgggaggaaaaaaggttacgaaggttagaaaaaaaacggagaaaggctcagtgcaagccttactactctgactattctagattccggctcctagtccatcatttgtgtacttcccattatttagacctgtttattactggtgttatcggtctgaacgttgtcacaatggctatggagcactaccagcaaccacagatcctggacgaggcacttaagatctgtaactatatttttactgtgatcttcgtgctagagagtgtgttcaaactcgttgccttcggattccggcgctttttccaagataggtggaaccaactggacctggcaatcgtgctgctgagtattatgggcattacactggaagagatcgaagtgaatgccagcttgccaatcaatccaacaatcattcgaattatgcgtgtgctgagaattgctcgggtgctcaagctgctcaagatggctgtggggatgcgggccctgctcgacacagtgatgcaggcactgccgcaggtgggcaatctgggcctgctgtttatgctgctgttcttcatattcgccgccctgggtgtggagctgtttggcgacctagagtgtgatgagactcatccctgtgaaggcttgggtcggcacgctacattccggaatttcgggatggccttcttgactctgtttcgggtgtctactggggataactggaatggaatcatgaaggacacactccgcgattgtgatcaggaaagcacatgctacaacaccgtaatatccccaatatatttcgtttcattcgtgctaaccgcccagtttgtcctggtgaatgtggttattgctgtgttgatgaagcatctggaggaatccaacaaagaggcaaaggaggaagcagagcttgaagctgaattggaactggagatgaaaaccctctctccacagccccatagccccctgggaagcccatttctctggccgggcgtcgaggggcctgattcccccgattcccctaagcccggtgctctgcacccagcggctcacgcacgatctgctagtcatttttctctggagcatccaaccatgcaacctcacccaaccgagctgcccggcccagatttgctcaccgtgcggaagtccggagtctcacggactcatagcttaccaaatgactcctacatgtgtcggcacggctcgaccgctgagggccctctgggacacagggggtggggtctcccaaaagctcaatccgggtctgtcctgagcgtccatagccagccagctgacacatcctatatccttcagctcccaaaggacgcaccccacttgctgcagccccatagcgcccccacttggggaacaatccccaagctcccacctcctggccggtcccctctggcgcagaggcccttacgacggcaggcagccatacgcaccgacagcctggatgtgcagggcttggggagtagagaagacctgcttgcagaagtttctgggcccagtccacctctagcacgggcctactcattttggggccagagcagcacacaggctcaacagcacagccggtcccattctaaaatttccaaacatatgacaccccccgctccgtgccctggtccagagccgaactggggaaaaggcccaccggaaaccaggtcctcgctcgagcttgataccgagctgagctggatcagtggagatctgcttccccccggtggccaagaggagccaccctcacccagggacctgaagaagtgctacagcgtcgaagctcaaagttgccagcgacgaccaacaagttggcttgacgagcagcgccgccacagcatcgctgtcagttgtctagattctggttcccaaccccatctggggaccgatcctagtaacctgggcggccagccccttggaggacccggcagcaggccaaagaagaaactgtcccctccaagcatcacaatcgatccccccgagtctcagggccccaggacaccgccctcaccaggcatctgtcttagacggagagcaccgagttccgattcaaaggatcccctcgcgtctgggccccctgattccatggccgcctctccatcccccaagaaagacgtcctgtccctctcagggttaagttctgacccagccgacctggacccttag

SEQ ID NO: 24724 - DNA, 6921 bp, Artificial Sequence
  Description of Artificial Sequence: Synthetic coding sequence
atggatgaggaagaggatggcgccggtgcggaagagagtggtcagcctcgatcgttcatgagactaaatgacctttccggagccggggggcgtcctggtccaggctcagctgaaaaggaccctgggtctgccgattccgaggcagaaggcctcccctaccctgccctggcgcccgtcgtcttcttttatctcagtcaagacagccggcctaggtcttggtgcttgaggactgtttgcaacccctggtttgaaagaatctcaatgttggttatcctcctaaattgtgttactttgggaatgttccgaccatgtgaagacatcgcctgtgattcgcagcggtgtcggatccttcaggcatttgacgattttattttcgccttcttcgcggtggaaatggtggtgaagatggtcgccctggggatatttggaaagaagtgttacctcggagacacttggaaccgcctagattttttcatcgtcattgctgggatgctggaatactctttagacctccagaacgtttccttttccgccgtgagaaccgtgcgagtcctcaggcccctccgagctatcaatagggtcccttctatgcgaattttagtgactctcttattggatacgctcccaatgctagggaacgtcctgcttttatgtttttttgtctttttcatatttggtattgtgggcgtgcagctatgggctgggctgctgcggaatcggtgcttcctccccgaaaattttagcctgccactgagtgtggacttggagaggtattatcagacagagaatgaggatgagagcccttttatctgctcccagcccagggagaacggtatgcgaagctgccgcagtgtgccaactctgaggggtgatggagggggcgggcccccctgcggcctggactacgaggcttacaactcttcctctaatacaacttgcgtgaactggaaccagtattacaccaactgcagcgcgggagaacacaacccttttaaaggggcgattaattttgacaatatcggctacgcctggatagctatctttcaagtgattactctggaaggctgggtcgatatcatgtacttcgtgatggacgcccatagcttttataatttcatttacttcattctcctgatcattgtagggtcattcttcatgatcaatctgtgcttagtcgtgatcgcaacccagttttctgagacaaaacagcgcgagagccaactgatgagggagcaacgcgttcgctttctgagtaacgcgtctactctggcaagcttcagcgagcccgggagttgctatgaagaactactgaagtatctagtgtacattctgcgaaaggcagcgagaaggctagcacaggtcagtcgggccgccggtgttcgggttggactgctgtccagcccagcgccgctaggggggcaggagactcagccatcttcctcttgtagccgcagtcaccgccgcctctctgtccaccacctagtacaccaccaccatcaccatcatcatcactaccacctgggtaacgggaccctgcgcgctccacgtgcaagtccagagatccaggaccgtgatgcgaacggctctaggcgcttgatgctgcccccgccatcaactccagcattgtccggagccccacccggcggggcggagagcgttcatagcttctaccatgccgattgtcacctggagcccgttcgctgccaagcacctcccccgaggagtccatccgaagcctccggccggacagtggggtccggcaaggtgtaccctacagttcacaccagtcctccacctgagacacttaaagaaaaagctcttgtggaagttgccgcctcaagcggtcctccaacattaactagcttaaatattccaccgggtccctattcttcaatgcacaagctgttggagacacagagcactggagcttgccagtcctcttgcaagattagctccccctgcttgaaggccgattctggagcctgtggaccagacagctgcccctattgtgccagggccggcgccggtgaagtggaactagctgacagagagatgccagactcagactccgaggcagtgtatgaatttacccaggacgcgcagcacagcgacctgcgtgatccccattcgcggcgacagcgtagcttgggtcctgacgctgaaccgtcttcagtgttggcgttttggaggctgatttgtgatacctttaggaaaattgtggactctaaatacttcgggcggggaataatgattgccatcctggtgaacacattatccatggggatagagtatcacgagcaaccggaggaactcaccaatgctctggagatatccaatattgtattcactagcctttttgcactcgagatgctgctgaaattactggtgtatgggccttttggttacatcaaaaacccctacaacatttttgatggcgttattgtggtgatcagcgtgtgggaaattgtggggcagcaaggaggcggcctgtccgtgcttcgtacgttccgcctgatgcgggtgttaaagcttgtgcgcttcctccctgcactgcaacgccagctggttgtgctgatgaagaccatggataatgtggctacattttgtatgcttctaatgttatttatctttatcttctccatcctgggcatgcatctcttcggttgcaagtttgcttccgagcgggatggcgacactctgcccgatagaaagaacttcgatagcctgttatgggctatcgtgactgtgtttcagattttgacacaggaagattggaacaaagtgctgtacaacgggatggcctccacatcctcctgggctgctctctatttcattgccctgatgacctttggtaattatgtactgtttaatctgctcgttgctatactagtggagggtttccaagcagaaggtgatgctaacaagtcagagtctgagcctgatttttttagcccgtcccttgacggggacggagaccgcaagaagtgcctggcgctggtaagtctgggggaacaccccgagttgcggaagtccctgttgcctccacttattatccatacagctgcaacccccatgagtctgcccaagagtacaagcacaggactgggcgaggccctcggccccgcctctagacgtactagtagctccgggtctgccgagcctggtgccgcacacgagatgaagagcccgccatcagcccgtagctccccacacagtccatggagcgccgcttcaagctggacaagtcggagaagctcacgaaacagtctcggcagggcacctagcctcaagagaaggtcaccctctggtgaaaggcggtctctcctcagcggagagggccaggaatcacaggacgaggaagagagcagtgaggaagagagggcatccccagccgggagtgatcaccgacatagaggtagtcttgagcgggaggccaaatcgtcattcgatctccctgataccctgcaagtgcctgggctacacagaactgcaagcggacgtgggagcgcttcagagcatcaagattgtaatgggaaaagcgcatccggcagattggctcgcgccctccgaccagatgacccgccactcgatggcgacgacgccgacgacgagggtaatttgagtaaaggcgaacgcgtgcgagcctggatacgcgcacggctgcccgcttgttgcctggagcgcgactcctggtctgcctacatcttccccccccagagcagattcaggctattgtgtcatagaatcattacacacaagatgttcgaccatgttgtcctggttattattttcctgaattgcataacaattgccatggagaggccaaagattgatcctcactcagccgagcggattttcctcacactcagcaattacatattcacggcggttttcctcgccgaaatgacggtcaaggtggtggccttaggctggtgcttcggcgagcaggcatacctccgcagtagctggaacgtcctcgatggcttactggtcctgatcagcgtaatagatattctggtgagtatggtgtctgacagcggaacaaagatactggggatgttgagagtcctgcggctcttacgaacactccgcccccttcgcgttatttcccgggcccagggactgaagctggtggtcgagactctgatgagctcccttaaacccattggtaatatcgtcgtaatatgttgtgcattttttatcatctttggcatcctgggcgttcagcttttcaaaggaaaattcttcgtttgccaaggggaagacacgaggaacatcacaaataagtccgactgcgctgaggcatcgtaccggtgggtacgccacaaatacaactttgataaccttggacaggctttgatgtctttatttgtgttagcgagtaaggatggctgggtggacattatgtacgacggtctcgatgcagttggcgtggaccagcaaccaatcatgaaccataacccttggatgttgttatatttcatcagctttctgctcattgtggctttcttcgttctaaatatgttcgtaggcgtggtggttgagaatttccataaatgcagacaacatcaagaagaggaggaggcccgacggcgggaggagaagcgtctgagacggctcgagaaaaagcgccgcaatttgatgctggacgatgtgatcgcctcgggttccagtgcgagtgccgcctccgaagcgcagtgtaagccctattattcagactactctagatttaggttacttgttcaccacctgtgcaccagtcactatttggatctattcatcacgggtgtaattggattaaacgtcgtgaccatggctatggaacattaccagcagccgcagatcttagacgaggcactcaagatttgcaattacatctttaccgtgatcttcgtattggagtcggtgttcaaactggtggctttcggcttccgacggttctttcaggatcggtggaaccagctagatcttgcaatcgtgctgttgtctattatgggcattaccctagaggagatcgaggtgaacgcctccctgcccattaaccctactattattcggatcatgcgggttctgcgcatcgcgagggtactcaaattacttaagatggccgtcgggatgcgtgccttacttgataccgttatgcaggctctgcctcaggtcgggaatctggggcttctgtttatgctgctgttctttatctttgccgccctgggcgtggaactgtttggtgacctggagtgcgatgagacccatccctgtgagggtctagggaggcacgcgacctttagaaactttgggatggccttcttaaccctctttcgggtttctactggagataactggaacgggattatgaaggatacgctgagagattgtgatcaggaatccacttgctataacactgtgattagtcctatctatttcgtgagcttcgtgctgacagcccagttcgtactggtgaacgtcgttattgctgtgcttatgaagcatctggaggagagtaataaagaagcaaaagaggaggctgaactggaagctgagctagaactcgagatgaaaacgctgtccccccaacctcactccccattgggcagtcccttcctgtggcccggtgtcgagggccccgacagtccagactcccctaaacctggggccctgcatcctgcagctcatgctcgtagcgcctctcacttcagcctggaacaccccacaattcccctggcagagatggaggccctttctctgacctccgaaatcgttagtgagccaagttgctcattggcactgacagacgactcgctgcccgatgatatgcacacgttgcttttatcagccctggagagcaacatgcagccccaccccaccgagctacctggtcctgatctccttacagtgaggaagtcaggggtaagccgcactcattctctcccaaacgacagctacatgtgtcgccacggtagcactgcggaaggccctctagggcaccggggctggggtcttcctaaggcgcaaagcggctccgtgctgtcagtgcatagccagcccgccgatacatcctatattctacaacttcctaaggacgccccccacctccttcagccgcattctgcccccacctgggggaccatccccaagctacctccaccaggcagatcgcctcttgcacaaagaccactgagacgacaggcagcaattagaaccgattccctagatgtacaggggctgggctcgagggaggatctgcttgccgaagtatcaggcccctctcctccgctggcacgagcttattctttctggggtcagagttccacccaggcccagcagcactcaagatcccattctaaaatatcgaaacacatgactccgcctgcgccatgtccgggccctgaacctaactggggaaaagggccccctgagacccgcagttctctggagctggacaccgagcttagctggatttctggagatttactgccccctggcggacaggaagagcccccctcaccccgggatctgaagaagtgctactccgtcgaagcccaatcctgccaacgacgccccacatcctggttggacgagcaaaggagacactccatcgctgtctcttgtctggactctggttcccagccacatctggggacagacccatcaaatctgggcgggcagccgcttggcggacctggtagtcgcccaaagaagaagctgtccccaccgtccataactattgatcccccagagtctcagggccctcgcacacccccatcccctggcatctgtcttcgcaggagagccccctcaagtgactcaaaggacccactcgccagtggcccccccgactccatggccgcatcaccatcgccgaagaaagatgtgctctcgctgtctgggttatctagtgacccggccgacttggatccatag

SEQ ID NO: 24725 - DNA, 5262 bp, Artificial Sequence
  Description of Artificial Sequence: Synthetic coding sequence
atggacgaggaggaagatggtgcaggcgccgaagagtcaggacagccgaggtcttttatgaggctgaacgatcttagtggcgctggtggcaggccaggtcctggaagtgccgaaaaagacccagggagcgcggactcagaagctgaagggttgccttatccggcgctcgcccctgtggtgttcttctacctgtcccaggattcacgaccccgatcctggtgtctgcgcaccgtctgcaacccgtggtttgagcgtatttctatgctggtgattttactgaactgtgttacactcgggatgtttaggccatgcgaggacatcgcctgcgatagccagagatgccgtattttgcaggccttcgacgactttattttcgccttcttcgccgtggagatggtagtgaaaatggttgcgttaggaatattcggtaagaagtgctatttgggcgatacgtggaatagactggatttttttattgtgatcgcaggaatgcttgagtacagtctcgatctacaaaacgtgagcttcagtgcggttcgcacggtgcgggtactgcgtcctctaagggctataaaccgcgtaccttcaatgaggattctagtgaccctgctacttgacacactccctatgcttgggaatgtgctcctgctgtgcttcttcgttttcttcatcttcgggatagtcggcgtccaactctgggctggtttgttacggaaccgctgctttctcccggagaacttcagtctgccactctctgtcgacctggaacgttactaccagactgagaacgaagacgaaagccctttcatatgctcccagccgagagagaatggcatgcgctcgtgccgttccgttcctacccttcgcggggacggcggtgggggacccccatgcgggctggattacgaggcgtataactcttcgtctaatactacttgtgtaaattggaatcagtactatactaactgttcagcgggtgaacacaatccctttaagggtgctataaattttgacaacattggctacgcttggatagcaatcttccaggtcattacattggagggctgggttgacattatgtacttcgtgatggacgcccattcattttacaatttcatatacttcattctgctcattattgtcggcagttttttcatgataaatctttgtctggtcgtcatagccacccaattcagtgagaccaaacagagagagagccaactcatgagggagcaacgtgtgcgcttcctcagcaatgctagcacattagcgagcttctctgaaccaggaagttgctatgaggagctcctgaagtacctcgtctacattctgaggaaagccgccaggcgtctcgcacaagtgtccagagcagccggtgtccgcgtgggcttgctgtcctctccagcgcccctgggggggcaagagacccaaccctcctcttcatgttcccggtcccatcggcgattgagcgtccaccaccttgtccatcatcatcaccaccatcatcaccactaccatctgggcaacggcactctgagggcacccagagcatctcccgaaattcaggaccgcgacgccaacgggagccggcgactgatgctgccccctccgtctacgccagcactgtcaggtgccccccctggaggcgcggagtctgtgcattctttttatcatgccgactgccatctcgaacccgtgcgctgccaagcgccgccaccgaggtcaccttccgaagcaagcggacgaaccgtcggatcaggaaaagtctatcccaccgtgcacacaagtccaccacccgaaacgttaaaggaaaaagccctggttgaggtggccgccagcagcggccctccgacattgacctccctgaacataccacccgggccctattcctcaatgcacaaactcctggagactcagagcaccggggcttgccagagttcttgtaagatatcaagcccctgtctgaaagccgactccggtgcgtgcggtccagattcctgcccctactgtgcccgggctggcgctggtgaagtggagctcgctgaccgtgagatgcccgatagcgactctgaggccgtgtatgaatttacgcaggacgcacaacattcagatttgcgggatcctcactcgaggcgccagaggtcattaggcccagacgcagagccgagttctgtattagccttctggcggctgatctgtgacactttccgtaaaatagtcgacagtaaatatttcggacgaggaattatgattgctatcttggtaaacaccctcagtatgggaatcgaataccacgaacagccggaggagcttacaaacgctctggagatcagtaacatcgttttcacttctctcttcgcgctggagatgctgctaaagctgctggtctatggaccatttggctacattaagaatccttataacatctttgacggtgttatcgttgttatttccgtgtgggagatcgtgggccagcagggcggtgggctttccgtcctgagaactttccgactcatgagggttcttaagctggtgagatttctgcccgctcttcagcgccagctcgtggtcctgatgaaaacaatggacaacgtggccactttctgcatgctgttgatgctgttcatatttatttttagcatcctcggaatgcacctgttcggttgtaagttcgccagcgagagggacggggataccctgcctgatcgcaagaattttgactccctgctgtgggcgattgtcactgtgtttcagatcctgactcaggaggactggaataaagtgctttataacggcatggctagcacatctagctgggcggccttgtactttatcgctttgatgacatttggcaactatgtgctttttaatctgctcgtggccatcctcgtggaaggcttccaggcagaaggtgatgctaataagagtgagagcgagcccgatttcttcagcccgagccttgacggtgatggtgaccgaaagaaatgcttagccctggtaagcctgggggagcaccctgagctcagaaagagtctgcttccccccttgatcattcacaccgctgccacacctatgtccctgcccaaatccacctcaaccgggctcggagaagcacttgggccggcctcacggcggacatcaagctcaggaagtgctgagccgggtgccgctcacgagatgaaatctccaccttccgctaggtcctctccgcacagtccatggtctgcggctagctcttggacaagcagacgaagttcccgcaattctctgggcagggcaccctctctgaaaagacgtagcccctctggcgagaggcggtctctgctcagcggcgagggccaggagtcgcaagatgaggaggagtcctccgaggaagagagagcctcccccgcaggatcagaccatcggcatagggggtccctcgagcgtgaagctaaaagctcgttcgatctgcctgacaccctacaggttcccggcctccacaggaccgcttctgggcgcggatccgcgagcgagcatcaggactgtaacgggaagagtgcttctggacgcctcgcccgtgctcttcgaccggacgaccccccacttgatggcgatgacgcagatgacgaggggaatctatcaaaaggcgagcgggtcagagcctggataagagcccgcctccctgcatgctgtttggaacgcgatagttggtctgcctacattttccctccacagtctaggtttcgactactctgtcaccgtatcatcacgcacaaaatgttcgaccacgtggtgctagttatcattttcctcaattgcattacgatagcaatggaaagacccaaaattgatccacatagcgcagagaggatcttcctcacgttgtcaaactacatttttactgcagtctttctcgctgagatgaccgttaaggtggtggcccttgggtggtgcttcggagaacaggcttacttgcgttctagttggaatgtgcttgacggcctattggtactaattagcgtgatcgacattctggtgtcaatggtttccgatagcggtactaagatcctgggaatgctcagagtgttgagactgctgaggaccttacgcccactcagagttatcagcagagctcagggtctgaagttggtcgtggaaacattgatgtcttctcttaaacccatcggtaatatcgtcgtgatctgttgcgcgtttttcatcatattcggtattctgggtgttcaacttttcaagggaaagttcttcgtgtgccagggggaggatacacgtaacatcacgaacaagtcagactgcgccgaagcgagctataggtgggtgagacacaagtacaatttcgataacttgggacaggctcttatgtctctcttcgtactagcctccaaggatggttgggtcgacattatgtacgatggcctggacgccgtcggggtagaccaacaacctataatgaatcacaatccctggatgctattgtactttatatcgttcctgttgatcgtggcctttttcgtgctgaacatgttcgttggggtcgtagtagagaactttcacaagtgtaggcagcatcaggaggaggaggaagcaaggagacgggaggagaagcggcttcgccggctagagaagaagagacgcaatctgatgctggacgatgtcattgcatctggctctagcgcatcagcagcctccgaggctcagtgcaaaccatattacagcgattattcaaggttcaggctgcttgtgcaccatctgtgcacgtctcattacttggatctgtttatcactggagtcattggactgaatgtggttaccatggccatggagcactaccaacagccccagattctggacgaagcgctgaagatttgcaactacatctttacagtaatatttgtcttggaatccgtgttcaaacttgtggcgttcggcttcagaagatttttccaggataggtggaaccagctggatctggctatcgtcttgctgtccatcatggggatcacgctggaggaaatcgaggtcaatgcgtctctaccaatcaatccaacaataatcagaataatgagagtcctgcggattgctcgggtcctaaaattgttaaagatggcggttgggatgcgcgctctactagacactgtgatgcaggcactcccgcagctctgggcatggtcaagtttagagacctggagtgtgacacgccacacacccgtgcgtgcctgggccgtaatgcccccttttggtacgctcgcttggccttcatag

SEQ ID NO: 24726 - DNA, 6753 bp, Artificial Sequence
  Description of Artificial Sequence: Synthetic coding sequence
atggatgaagaggaggacggcgcaggcgccgaagagtctggtcagcctaggagtttcatgaggctgaatgacctgtctggcgctggtggccgacctggacccggtagcgctgagaaagatccgggctcagcagatagcgaagctgaggggcttccctatcccgccctggctccagtcgtcttcttttacctatcacaggactctcgacccaggagctggtgtctgcgcacggtctgcaatccttggtttgagagaattagcatgctggttatattgctgaactgtgtgacactgggaatgtttaggccgtgcgaggacattgcttgtgatagtcagcgttgcagaattctccaggctttcgatgacttcatttttgccttctttgctgtcgaaatggttgtcaaaatggtggccttggggattttcggaaagaagtgttacttgggagacacgtggaatcggctagatttttttatcgtcattgcgggtatgttggaatacagtttagacctgcaaaacgtgtcatttagcgccgtcagaaccgtgagggttcttcgcccccttagagctatcaacagggtgccaagcatgagaatcttagttaccttgcttttagacactttgcctatgttgggaaatgtgctcctactgtgtttttttgtgtttttcattttcggcatagttggcgtgcagctctgggccggtctgcttaggaataggtgtttcttgcctgagaactttagcttgcctctgagtgttgaccttgagcgatattaccaaacagaaaacgaagatgagagtccctttatttgtagccagcctcgtgaaaatggtatgagatcctgccgtagtgtgccgacactccggggcgacggcggcggcgggccgccatgcggtctggattacgaggcctataactcgtcttccaatacaacttgtgttaactggaatcaatattacacaaactgttcagctggtgagcataatccctttaaaggagccatcaattttgataatattggctacgcgtggattgctatctttcaggttattactctcgagggctgggtcgacattatgtatttcgtgatggacgcgcactctttctataacttcatatatttcattttacttatcatcgtggggtccttcttcatgataaacctctgtctggtagtcatcgcgacacagttcagcgagaccaaacagagagaatcccaactgatgagggaacagagagtgaggttcttgtcaaatgcctccacactggcttctttctctgagcccggctcctgttacgaagagctcctgaaataccttgtctatatcctgagaaaagctgcccgcaggctggctcaggtatcgagagcagccggcgttcgagtcggcctcctgagttccccagcccccctggggggccaagagacacaaccttcgtccagctgcagtcggtcacatcggcgcctgtctgttcaccacttggtgcaccaccaccatcatcaccaccatcactatcatctcggcaacgggacacttcgcgccccacgcgcctccccagaaattcaggatcgggacgccaacggatcacggagactgatgttgccccccccttctactcctgctctgtctggggctccccctggaggggcagagtcggttcacagcttttatcatgccgactgtcacctggagcccgtgcggtgccaggctccccctccaagaagcccaagcgaagcatcaggaaggaccgtcgggagtggcaaggtttatcccacggtacacacctcaccgcccccagaaaccctgaaggagaaggccctggtggaggttgctgcaagctctggtccaccaactctcacatctttgaacattcctccaggtccatattcttcgatgcacaaactgctggaaacgcagtctaccggcgcttgccagagcagctgcaagatatctagtccctgtttgaaggccgactctggtgcctgtggtccagatagctgtccatactgcgcgagggctggagccggcgaggtggaattggcagacagggagatgccagatagcgatagcgaggccgtgtacgagtttacccaggacgcacagcactccgacctccgcgatccccattccaggaggcagcgtagtctggggcccgatgctgagccttcttcggttctggctttctggcgtctcatttgtgacactttccgcaaaatagtggattcaaagtactttggacgtggaatcatgatcgcaatcctggtaaacacactgtcaatgggaattgagtatcacgaacagcccgaagaattgacgaatgctttggaaatcagtaacatagtctttactagcctatttgccttggagatgctcctcaagctgctcgtctacgggcccttcggatatatcaagaatccgtacaatatcttcgatggcgtgatcgtcgtgatcagcgtctgggagatcgttggccagcaaggtggcggtctctccgtcctgagaacatttcgcctcatgagggttctgaaacttgtgaggttcctgcccgctctgcagagacagcttgtggtgcttatgaagactatggacaatgtagccacattttgcatgctgttgatgctgttcatttttattttttctatattgggtatgcatctgttcggctgcaaatttgcctcagagcgagatggggacaccctgccagaccggaaaaacttcgactctttgctgtgggccattgtgacagtgttccagatactgacccaggaggactggaataaagtcttatataacggcatggcatcaacatctagttgggctgcactttatttcattgcactgatgacttttggcaactatgtcctgttcaacctgctcgtggctattctggtcgaaggtttccaagccgaggaaattagcaagagagaggacgcttcaggccaactctcctgcattcagttacctgtggatagtcagggcggagatgccaataagtccgagagtgaaccagatttttttagcccgagccttgacggtgacggcgatcgtaagaagtgcttggcattggtgtccttgggtgagcatcctgaactccggaagtctctactccctcccctgataatccacacagcggctactccaatgtccctgcccaagtctacgtccactggcctgggcgaggcactcgggcccgccagtagacgaacatccagttccggctctgccgaaccaggcgccgctcacgagatgaaaagcccaccctccgcaagatcatccccgcattccccttggtcagctgcctctagctggacttccaggaggagcagtcggaactcactggggagggccccctctttgaaacggaggtcacctagcggagagcgacgctccctgttatcaggtgaaggtcaggagagtcaagatgaagaggagagttctgaggaggagcgcgcaagcccggccggatccgaccatcgtcaccggggctcattggagagagaggcaaagtcttcatttgacctgcctgacacactgcaagtccccggccttcacaggaccgcaagcggacggggctctgctagcgagcaccaagactgcaatggcaagagtgcttcagggcgcctagcaagggccctgcgcccagacgatccacccctggacggagacgatgccgatgacgaaggcaatctttctaagggcgagagagtacgagcctggattcgcgcgaggctgcccgcttgctgtctagagcgagactcttggtccgcttatatctttcctcctcagtcaagatttaggctgctctgtcatcgtatcatcacacacaaaatgtttgaccacgtggtcctcgtgattatctttttgaactgtataacaattgccatggaacgtccaaagattgatccgcattcagccgaaagaatattccttaccttatcaaactatattttcaccgcggtatttctggcagaaatgacagtgaaggtggtggctctggggtggtgcttcggagagcaagcgtaccttcgttctagctggaatgtcctggatgggctactggtactgatttcagtcattgatatcttagtatccatggtgagtgattctggcacgaaaatcttaggcatgcttcgagttttgagacttctgaggaccctcagaccccttagagtgattagtcgcgcgcagggccttaagctcgtcgtagagacattaatgtcttccctcaagccaatcgggaacattgtggtgatttgctgcgctttcttcataatattcgggattctgggcgtccaactgttcaagggcaagtttttcgtgtgtcagggagaggataccagaaacataaccaacaaatccgattgcgccgaagctagttacaggtgggtgaggcacaaatacaatttcgacaatctcgggcaggcactgatgtccctgtttgtactcgccagcaaggatggctgggtagacatcatgtacgacggtcttgacgcagtaggcgtcgaccagcagaattttcataagtgtcgacaacatcaagaggaagaagaggccagacggcgggaagaaaaacggctgagacgcctggagaaaaagcgccggaacctgatgctcgacgatgtcattgctagcgggtctagcgcttctgccgccagtgaggcacaatgcaagccctattattctgattattctcggtttaggcttctggttcaccatctgtgcacctcccactacctcgatcttttcatcacgggggtgattggccttaacgttgttaccatggctatggaacactaccagcagccccagatcctagacgaggctttaaaaatctgcaattacatcttcaccgtaatttttgtcctcgaatctgttttcaagttggtcgctttcggctttcggcgcttctttcaggaccggtggaaccagttggatctagctatcgtgctgctgtccataatgggcatcactctggaagaaatcgaggtgaatgcttctctgcccatcaaccctaccattatcagaataatgagagttctgcggattgccagagtgctgaaactgttgaagatggcagtgggcatgagagctttactggacactgtgatgcaggcattaccacaggttgggaatctgggcctgctgtttatgctactgttctttatcttcgctgcccttggtgttgaactgttcggtgatctggagtgtgacgaaacccatccatgcgaaggcctgggacggcatgcgaccttcaggaactttgggatggccttcttaactctcttccgggtttccacaggggacaactggaacggtatcatgaaggacactctaagagactgcgatcaggagtctacatgttacaatactgtcatcagccccatttattttgtgagtttcgtactaacagcacagtttgttctggtgaacgtggtgatcgccgttctgatgaagcacctggaggagagtaacaaggaagccaaagaagaagcggagttggaagccgagctggagctcgaaatgaaaacattgagcccccagccacattctcctctgggttctccctttctttggccaggggttgaagggccggactcaccagactcgccaaagccgggagcgctgcaccccgccgcacacgctcgctctgcttctcatttttccctggaacaccctacgatgcagcctcaccccacagagctgccaggacccgatctgttaacagtgagaaagtccggagtctctaggacccatagcctccccaatgatagctacatgtgtcgccatgggagcacagcagaaggcccactaggacatagggggtggggactgccaaaagctcaatctgggagcgtactgtccgtccactctcagccagccgacacatcatatattttacaattacctaaggacgccccgcatttgctgcagccccattctgcccccacgtggggcaccattcctaagctgcctcctcctggtcgaagccccctggcccaaagacccttacggcggcaagctgcaatccgaactgacagcctagacgtgcagggcctgggcagtagggaggacctgctcgctgaagtgagcggcccttcccctcccctggctagagcctatagcttttggggccagtcctccactcaggctcagcaacattcccggtcacattccaagattagtaagcacatgactccgccagccccctgccccggccctgagccaaactggggcaaaggccctccagagacacgctcttccctcgaactagatacagagttatcctggatttctggggatctgctgccacctggcggccaagaggaacccccatccccaagggacctgaaaaaatgctacagcgtggaggcccagagctgccagcggcggccaacatcttggctcgatgagcagaggcgccattcaatcgctgtatcgtgcttggacagcggctctcagccgcacttggggaccgacccgagtaacctgggcggtcagcctcttgggggccctggcagtagaccgaagaagaagctctcccccccaagtatcaccatcgaccccccggagtctcagggccctcggaccccaccatccccaggcatttgcttgaggcgtcgcgctcctagttctgactcaaaagacccattagcctcgggtccgccggactctatggccgctagtccctcccctaagaaagatgttcttagcctttctgggctgtcctccgaccccgcggacctggacccctag

SEQ ID NO: 24727 - DNA, 5208 bp, Artificial Sequence
  Description of Artificial Sequence: Synthetic coding sequence
atggatgaggaagaggatggcgctggagctgaggagagcggccagcctcgctcctttatgcgtctaaatgacctgtccggcgctggcggcagacctggacctggcagcgcggagaaagatcccggttccgccgacagcgaggccgaaggcttgccatacccagccctggcccccgtcgtctttttctatctgagccaggacagtcgaccgcgctcctggtgtttgcgcaccgtatgcaatccttggtttgaacggataagtatgcttgtcatcttactcaattgcgttaccctgggcatgttcaggccctgcgaggacatagcatgcgactctcagagatgccgcatactgcaggctttcgatgactttattttcgctttttttgcagtggagatggtggtgaagatggtggccctgggaatcttcggaaaaaagtgttatctgggggacacttggaaccgccttgatttttttatcgttatagcaggaatgctagagtatagcctggacctgcagaacgtctccttttcagcggtgcggaccgttcgggttctaaggccactacgcgcaatcaaccgggtgcctagcatgcgcatcctggtgaccttactgctggataccctgccgatgctaggtaacgttttgctgctatgtttcttcgtttttttcatttttggaatcgtgggagttcagctatgggcaggacttcttagaaataggtgcttcttgccagagaacttttccctgccattgtccgtggacctggaaagatattatcaaactgaaaatgaagatgagagtcccttcatctgcagtcagcccagggaaaacggtatgcggtcatgtcggagtgtccccacgctacgtggagacggaggcggcggcccaccttgtggcttggactacgaagcttacaactcctctagtaatacgacctgtgtgaattggaatcaatactataccaattgttcagctggggagcacaacccgtttaagggcgcgatcaacttcgataatatcggatacgcgtggatcgctatctttcaagtgatcactcttgaggggtgggtcgacattatgtactttgtgatggacgcccattctttctacaattttatatatttcatactgttaatcatagtgggatcattcttcatgattaacctatgcttggtcgttatcgctactcagtttagcgagaccaaacaacgcgagtcacagctaatgagagaacagagggttcgatttctctccaacgcctcaactctggcctctttctccgagccaggaagttgttacgaagagctgctgaagtatctggtttatatcctgaggaaggcggcccgaaggctcgcacaagtgagcagagctgccggagtcagagtgggattactgtcaagccctgcaccgctcggcggccaagaaacccagccatcctcctcctgctcccggtcacaccgtcgtctgagcgtccatcacttagtgcatcaccaccaccaccatcatcaccactaccacttgggcaacggaaccctgagagctcctagggcaagcccagagatccaggaccgggatgccaacggcagccgcaggttaatgttgccacccccctctacacctgcgttgagtggggcacccccaggcggagccgaaagcgtgcattctttttaccacgctgactgtcatctcgaaccagtgaggtgtcaggctccccctccgcggtccccatcagaggcctctggaaggactgttgggagtggaaaagtgtatccaacggttcatacatcccccccccccgaaaccctgaaagaaaaggctctggtggaagtggctgcgtcctctgggccgcctactctgacatctctgaatatcccccctgggccatattcgagtatgcataagctgctcgaaactcagagcaccggagcgtgtcaatcttcgtgtaagatcagctccccttgtctgaaggccgattccggggcatgtggcccggattcctgcccatactgcgctagggcaggcgccggcgaagttgaactcgcggatcgcgaaatgccagactccgattctgaggcagtgtacgagttcacccaagacgcccaacatagcgacctacgggaccctcattctagaaggcaacgctcgctgggacccgatgctgagccttccagtgttctagccttttggcgccttatttgcgatacgtttcgcaagattgtggattctaagtattttggtcgaggcattatgatcgccatcctggttaataccctgagtatgggtatcgagtatcacgagcagcccgaggaactcaccaatgcgctggagattagcaatatagtctttacatctttgttcgcactggagatgttgctgaaactcctcgtctacgggccattcggttacatcaagaacccctataatatctttgatggcgtgattgtggtgattagcgtgtgggagattgtcggccagcaggggggaggtctgtccgtcctgaggacattccggctgatgagagtcctgaaactggtgcggtttctgcccgccttgcagcgccagcttgtagtcctgatgaaaacaatggacaatgtggcgaccttctgtatgttgctcatgttgttcatatttattttttccattctgggcatgcacttgtttggctgcaagtttgcctcagagagggacggggatacattacccgaccgaaaaaacttcgactcacttctgtgggcgatcgtgacggttttccagattttgacgcaggaggactggaataaggtgctgtataacggaatggcatctacctcttcatgggcagcgctgtattttattgccctgatgacctttgggaattatgtcctattcaacctgctcgtggcgatcctggtggagggatttcaggccgaaggcgatgcaaacaagagcgagtccgaaccggactttttcagccccagtttagatggggatggagatagaaaaaaatgcttggccctcgttagtctcggcgaacatccagagctgagaaagagcctgctcccaccactgataatacatactgcggctactcccatgtcccttccaaaatcaacatccactggcctgggtgaggcactgggcccagcttctcgccgaaccagtagcagtggctccgcggagcccggagccgctcacgaaatgaaaagccctccatccgccaggtccagccctcactcaccgtggagcgccgcctcatcttggactagcaggcgatcctcacgtaacagcctgggtcgggctccatccttgaagagacgctctccaagtggtgagagacgatcgctactgagtggggaaggccaagaaagtcaggatgaggaggagtctagcgaggaggagagggcttcgccggctggctccgaccacaggcaccgaggtagcttagaacgcgaggccaaatcttcttttgacctgcctgataccctgcaggtgccaggcttacatcggaccgcctccggtcgcggcagtgccagtgagcaccaggattgcaacggaaaatctgcctccggccgtctggctcgggcgctgcgtcccgatgacccccccctggacggggacgatgcagatgacgaaggcaatctgtccaagggggagagagtgagggcctggattagagcccggttgcccgcgtgctgcttggagagggacagttggtccgcatacattttccctccacagagcaggtttaggctgctgtgccaccgaattataacccataagatgtttgatcacgtggtgctcgtgattatttttttgaactgcattactatcgctatggaacggcctaagattgatccccacagcgccgagcgcatcttcctgaccctatctaattatattttcactgcagtgttcctggccgagatgactgtgaaggtagtggccctcggctggtgttttggcgagcaggcttatttacgctcctcttggaatgtgctggacggcctgctcgttctcatcagtgtgatagacattctggtttccatggtgagcgatagtgggaccaaaatcctcgggatgctcagggttttgaggctactgcggacattgcgccccctccgagttatctctagagctcagggcctcaaactggtcgtcgagactctgatgtcttccctaaagccgattggtaatatcgtggttatttgctgcgctttctttattatattcggcatcctgggagtgcaactcttcaagggcaaattttttgtttgccaaggtgaggatacccgtaacatcacaaataagtcagactgtgccgaagccagctaccgttgggtgagacacaagtataactttgacaacctgggccaggcgctgatgtcactgttcgtgctggcaagcaaagatggctgggtggacataatgtacgacgggctggacgcagtgggtgtggatcaacagccaataatgaaccataacccctggatgcttttgtattttatctctttcttgctgatcgtggcattcttcgtgctgaatatgtttgtgggcgtggtggtggagaattttcacaagtgtcgccagcatcaagaggaggaagaagctaggcgccgggaggagaagcggcttcggagactcgagaagaaacgacggaaggcacaatgcaagccctactattctgactatagccggtttaggctcttagtccaccatctgtgtacctctcactatcttgacctgtttatcacgggagttatcggcctgaacgtagtgacaatggcgatggagcattaccagcagccccagatactagatgaggccctgaagatctgcaattacatctttacagttatctttgttctggaatccgtctttaagctggttgcatttggatttaggcggttttttcaggatagatggaatcagctggatttagccatcgtgctgctgtcaattatgggcatcacactggaggagatagaggttaacgcttccctcccgattaaccccaccattatcaggatcatgagggtgttgcgcatagcaagagtgctgaagctgttgaaaatggccgtgggcatgagagctcttttggacacggtgatgcaggccctgcctcagctgtgggcctggtcatcgctggagacgtggagtgttacccggcacacccctgtgcgggcttgggcagtaatgccaccattcgggacattagcctggccttcatag

SEQ ID NO: 24728 - DNA, 5298 bp, Artificial Sequence
  Description of Artificial Sequence: Synthetic coding sequence
atggatgaggaggaagacggcgcaggcgccgaggagtctggtcagccacgttcatttatgcggttaaatgatctatctggcgctgggggcagacctggcccaggatcggcagagaaggaccccggtagtgctgacagcgaggcggaaggactaccataccctgctctcgctcctgttgttttcttttacctgagtcaggactctcggcctcgatcttggtgtctccgaactgtgtgtaacccctggttcgaacgaatctccatgctggttatactgttgaactgtgttacactgggtatgttcagaccctgtgaggacatcgcctgcgactcgcagcgctgcagaatcctgcaggcgtttgatgacttcattttcgcttttttcgccgtggagatggtggttaagatggtggccttgggaattttcgggaagaaatgttatctaggagacacatggaacaggctggacttcttcatcgttatcgcgggcatgctggagtattccctcgatctgcagaacgtatctttcagcgcagtgagaaccgtgagagtactgcgccctttgcgggcgattaatcgggtaccgtccatgcgcatcctcgtcacattgttacttgatacactgccaatgcttggcaatgtgctcctgctttgcttttttgtcttctttatttttgggatcgtgggggtgcagttgtgggcgggccttctgaggaatagatgctttctacccgagaacttcagcttgccactatctgtggatctggaacgctactaccaaacagagaatgaggacgaatccccatttatatgctcacaacctcgagagaatgggatgcgatcttgtcggtccgtgcccaccttgaggggtgacggcgggggtggccccccatgtgggctcgactatgaggcctataattcttcatccaataccacttgcgtaaattggaatcagtactataccaattgcagtgctggggagcacaaccccttcaagggagcaatcaacttcgacaacataggctatgcctggatcgctatctttcaggtcataaccctcgaaggatgggtggatataatgtatttcgtcatggacgcccatagcttctacaactttatctacttcatccttctgatcatcgtgggatcgttctttatgataaatctatgtctcgtggtgatagccactcagttcagcgagaccaagcaacgagaaagccagctcatgagggagcagagggtcaggttcctgtcaaacgcctcaactctcgcctcttttagcgagccggggtcctgttacgaagaactcctgaaatatttagtctacattctccggaaagctgctcgacgcctggcccaagtgagcagagcggcgggagttcgtgtgggactgctgtcctcacctgccccgctgggaggccaagagactcagcccagctcttcttgctcacggtcccacagaagactttcagtgcaccacctggtccatcaccaccaccatcaccaccaccattatcatctcggcaatggtaccctgcgggcccccagagcaagcccagaaattcaggatcgagacgctaacggaagtagaagactgatgctgcctcctccatccaccccagcattatccggcgccccccccggaggagcagagagcgtgcatagtttttatcatgccgattgccacctggagcctgtgaggtgtcaagccccccctccaagatcccccagtgaggcttcagggcggactgtgggtagtggcaaagtatacccgacggtgcacactagccccccacctgaaactttaaaggagaaggcgctggtggaggtcgctgcctcatctggccccccaaccctgaccagcctcaatataccaccaggaccatatagcagtatgcacaagcttcttgagacacagtctaccggtgcctgtcagtcgtcctgcaagatcagcagcccgtgcttaaaagcagactcaggagcatgtggccccgattcctgtccctattgtgccagagccggggccggtgaggtggagctggcagaccgagagatgccagactcagattccgaggccgtgtatgagttcacccaggatgcacagcatagcgatctgcgggatccccactctcgccgccagagatcccttggcccagacgccgagccttcttcggtcttggctttctggcggctcatttgtgatacttttcgcaagatcgttgacagcaagtatttcggccgcggaatcatgatcgctatcctggtgaataccctgtccatggggattgagtaccatgaacaacccgaggagctcacaaacgcccttgaaataagcaacatcgtttttacctccttatttgcactggagatgctgctgaaattgctggtctatggccccttcggatacattaaaaacccttataacatattcgatggtgtgatcgttgtcatctccgtgtgggagattgtgggacaacagggaggtggacttagcgtactgcgcacctttcgattgatgagggtgttgaaactggtgaggtttctgccagctctccagagacagctggtggtgttaatgaaaaccatggataatgtcgcaactttctgcatgctgctgatgctcttcatttttatcttttccatcctgggcatgcacctttttggatgcaaattcgcatccgaacgtgatggggatacacttcctgatagaaaaaacttcgactccttactgtgggcaattgtgacagttttccagatacttacacaagaagattggaacaaagtactgtataacgggatggcaagtacatcctcctgggccgctctctactttatagcccttatgaccttcggaaactatgttctgtttaatctgctggttgccatcctcgtggagggatttcaggccgaggagatttcaaagagagaggacgcctctggccagcttagttgcattcagctgccagtggactctcaggggggagatgccaataaatcagagtccgagcccgacttcttttccccaagccttgatggcgacggggataggaaaaagtgtctggcgctggtaagcctgggagagcatcccgagctccggaagtccctgctgccgcctctcatcatccacaccgccgctaccccgatgagcctccccaaaagtacttcaactggactgggggaagccttggggcctgctagcaggagaacctccagttccggatctgctgagccaggcgctgctcacgagatgaagagcccgccctctgctaggtcatcccctcactccccctggagcgccgctagcagttggacgagtcgccggtcatccaggaactctctcggaagggcaccatcactcaagcgtcggtcaccttctggggagcgaaggtcactgttgtcaggtgaaggacaggaaagccaggatgaagaggagagctccgaggaggagagggcctcaccagccgggtccgaccaccgtcatagagggtcactggagagggaggcaaaatcaagctttgatctccctgacacacttcaggtgcctggcttgcaccgcacggcatctggaagggggtccgcctccgagcatcaggactgtaacgggaaatccgcgagcggccgactcgctagagccctgcggccagacgacccaccccttgacggtgatgacgctgacgacgaagggaacttatctaaaggggagcgggttagagcctggatcagggcacgcctgccagcatgctgtctcgagagagattcctggtcagcctacatctttcccccacagagccgctttaggctactgtgccacaggataataacccacaagatgtttgaccacgtcgtcttggtaataatattcctgaactgcatcaccattgccatggagagaccaaaaatcgatcctcatagtgccgagcggatcttcctcactctctctaattatatatttacagctgtgttcttagcagagatgactgtgaaggtcgtggctctgggatggtgcttcggcgagcaggcgtatctgaggtcttcatggaacgtcctcgacggcctcctggttctgatatcggtcattgacattctggtgagtatggtcagtgattcaggcacaaaaattctgggcatgttacgcgtgctgcgacttctccgaacactgaggcctctgagagtgatttctcgcgcacagggcctgaagctggtcgtagaaaccctgatgagctccttaaagccaattgggaatatcgtcgtgatctgctgtgcatttttcatcattttcggaattctgggggtacagcttttcaaggggaaatttttcgtctgccagggcgaagacacacggaacataacaaacaaaagtgattgtgcggaggcgagttatcgttgggtcaggcataagtataacttcgacaacttggggcaggcgttgatgtcgttattcgtgctcgcttccaaggacggatgggtagatattatgtacgatgggctggatgccgtcggggtggatcagcaacccattatgaatcacaacccatggatgctgctgtactttatatcattccttctcatagtagccttttttgtgctgaacatgtttgtaggggtggttgtggaaaacttccacaagtgccgccagcatcaggaggaagaagaggcccgaagacgagaggagaagcggctgcgccgtttggaaaaaaagcgacggagcaaagagaaacagatggccgaagcccaatgcaagccgtattattcagattactcgagatttcgcctgctcgtgcaccacctgtgcacttctcattatctcgacctgtttatcactggggtgatagggctcaacgtcgtcaccatggcgatggagcactaccagcagccacagatactcgacgaagcattgaagatctgtaattacatcttcaccgtgatctttgtcctagagtcagtttttaagctcgtcgctttcggctttagacggttctttcaggatagatggaatcaattagatctggctattgttctcctgagcattatgggcataacactagaggaaatagaagtcaacgcttctctgcccattaaccccaccataatcagaatcatgcgtgtgctgcgaattgcaagggtgttaaaactgctcaagatggccgtcggaatgagagccttgttggataccgtgatgcaggcactcccccagctgtgggcctggagcagcctggagacttggtccgtcacaagacacactcccgtccgggcctgggctgtcatgccaccctttggtactctggcttggccttcttag

SEQ ID NO: 24729 - DNA, 6618 bp, Artificial Sequence
  Description of Artificial Sequence: Synthetic coding sequence
atggacgaggaggaagatggcgctggtgccgaggaatccggccagccaaggtccttcatgagattaaatgatctctccggagcaggaggaagacctggtccagggagcgccgaaaaagatccaggaagtgcagatagcgaggccgaggggctgccctatcccgccctggctcccgtcgtgttcttttacctcagtcaggattcgcgcccaaggtcatggtgcctgaggacagtttgtaatccgtggttcgaacggatcagtatgctagtgatccttctgaattgcgtgactctgggcatgtttcgaccatgcgaggatattgcatgcgattcccagagatgccgcatcctccaggcatttgatgacttcatctttgcattcttcgctgtcgaaatggtagtcaagatggtggcactggggatctttgggaaaaagtgctatctcggtgacacgtggaacaggcttgatttttttattgtcattgccggcatgctagagtactccctcgacctgcaaaacgtgagcttctcggctgttcggaccgtacgcgtcctgagaccccttcgggctatcaatagggtaccttccatgcggatactggtgacacttcttctcgatactcttccaatgctgggcaacgtgctgctgttatgtttttttgtgttttttatcttcgggattgtcggagtccaactgtgggctgggctgctacgcaatcgttgctttctaccagagaatttctcattaccgctcagtgtggacttagaacggtactatcagactgagaatgaagacgaaagcccctttatctgcagccagccacgggagaacggaatgcggtcctgccgtagtgttcctaccctgcggggggatggcggcggaggaccgccatgcgggctggattacgaggcctataattcttcatcaaatacaacttgcgttaactggaaccagtactacaccaactgtagcgcaggagagcataacccttttaaaggggctattaacttcgataatattgggtacgcttggattgccattttccaggtgattacattagaaggctgggttgatatcatgtatttcgtcatggatgctcatagtttctacaacttcatatacttcattctcctgataattgtgggctccttctttatgataaatctgtgtctggtggtaattgctacacagttctcagagactaaacagcgggagtctcagctaatgagggagcagagggtcagattcctctccaacgcctcaacccttgcctcattctctgaacccggttcttgttatgaggagcttctgaaataccttgtgtacatcctgagaaaagcagcgaggcgactggcccaggtgtctcgcgctgctggggtgcgggtaggactcttatctagcccagctccccttggcggccaggaaacccagccttcatcaagctgctcgcggagtcaccgaaggctaagtgtccatcatcttgtgcaccaccatcaccaccatcaccaccactatcacctgggcaatgggacgctacgggcgcccagagcgagtcctgaaatccaggaccgcgacgccaatggatctcgcaggctgatgctacctccaccaagtaccccagccttatcaggcgcgcctcctgggggagcggaatctgtgcactctttttatcacgcggattgtcatttggagccagtgagatgccaagccccaccccctaggagtccaagcgaagcctcaggaaggaccgtggggagcgggaaagtctacccgactgtccacacttctccacccccagaaacattaaaggaaaaggccctcgtcgaagtggctgcctcttcaggacccccaacgctcacaagcctgaatataccaccagggccttatagctcgatgcacaaactgctggagacacaaagcaccggagcttgtcaaagctcctgtaagatttcgtcaccatgcttaaaagccgattcaggtgcatgtggacctgattcgtgtccctattgcgcacgggcgggcgccggggaggtagagctggcagatcgggaaatgccagatagcgactccgaggctgtctacgaatttacacaggatgctcagcattctgatcttagagaccctcactctaggcgccagcggagcctcggcccagacgccgaaccttcgtccgtcctggccttttggcggctgatctgcgacaccttcagaaagattgtagacagtaagtattttgggcggggtatcatgatcgctatcttagttaataccctgtctatgggcattgaatatcacgagcaacccgaggaactaacgaacgccctcgaaatttcgaacattgtgttcacatccctgttcgccctcgaaatgctcctcaagctcctagtctatggaccattcgggtacattaagaacccctacaacatttttgatggggttatcgtcgtgatttctgtgtgggaaattgtcggccagcaggggggcggactgtcagtactcaggacgtttagactaatgcgcgtgctaaagctggtcagatttttacccgcactgcagagacaactggtggtgctaatgaagaccatggacaacgtggcgacattctgcatgctgctcatgctctttatctttatcttctccatactgggtatgcacctcttcgggtgcaagttcgcttcagaaagggatggagatacgctgccggatagaaagaacttcgactctctcctctgggccatcgtcacggtgttccagatccttacgcaagaggactggaacaaggtgttatataacggtatggcctccacctcaagttgggcggcactttactttatcgctctgatgacttttgggaactacgtgttgttcaatctgcttgtggccatactggtcgagggcttccaggccgaggagatttccaagcgtgaggacgcaagcgggcagctctcttgcatccaattacccgtcgacagccagggaggggacgcaaacaagtcagagtcagagccagatttcttttctccctctttggacggtgatggagatcggaagaaatgtctcgcactggtttccctgggcgagcaccccgaactaagaaagagcctgttaccaccccttatcatccacacagctgcaacgccaatgagtttacccaagtctacctccacaggactgggtgaagctctggggcccgcgtcgagacgcacctcctcttctggtagcgcagagcctggagccgcacacgaaatgaagagcccaccttctgctagaagctctccacattctccttggtctgcagccagctcttggacatcccgccggagttctcggaacagcctaggcagagcacctagcttaaagcgacggagcccgtccggtgagcgacgttcgttgctgtcgggcgagggccaggaaagccaagacgaggaggagtcttctgaggaagaaagagcaagccctgcagggagcgaccaccggcaccggggtagcctggagagggaggctaagtccagctttgacctgccagacaccctccaggtacctgggttgcataggaccgcatccgggcgaggctccgcctcagaacaccaggattgcaacggcaagtcagctagtggcagactggctcgggcgttgagacctgatgaccccccgctggacggggatgatgctgatgacgagggaaatctctctaaaggcgaacgcgtgagagcttggatcagggccaggctacctgcttgctgcctcgaacgggactcttggagcgcatatattttcccaccacagagtagatttcggttgctttgtcaccggattattacgcataagatgtttgatcacgtggtcctcgttatcatatttcttaactgcatcacaatcgcaatggagaggccaaagattgaccctcattccgccgaaagaatattccttactctttccaactatatcttcacggccgtcttcctggccgagatgactgttaaggtggtggccctgggatggtgctttggagagcaggcctaccttcggtcctcttggaacgtactggatgggctgctggtcctcatcagcgtgatcgacatattagtatcaatggtgagcgactccggaaccaagatccttggcatgctgagagtccttcgactcctgcggaccctgagaccactacgtgtgataagccgtgcacaggggctgaaattggttgtcgaaaccctgatgtcctccctgaagcccatcggaaatatcgtggttatctgttgcgccttttttataattttcggcatcctcggcgtgcaactgtttaaaggcaaatttttcgtgtgtcagggggaggacaccaggaatatcaccaataaaagcgattgcgcagaagcttcgtatagatgggttcgtcacaaatacaattttgacaacctgggacaagctttgatgtctctgtttgttctcgctagcaaggacggctgggtggatataatgtacgatggactggatgccgttggcgtcgaccagcagccaatcatgaaccataatccctggatgctgttgtactttatttcatttcttctgatcgtggcgttcttcgttctgaacatgttcgtgggcgtggtggtcgagaatttccacaagtgccgccagcatcaggaagaagaagaggccaggagaagagaggaaaagcgactccgacgcctggaaaaaaagcgccggaacttaatgctcgacgatgttatcgcatccggctccagcgcttccgcagcttcagaagcccaatgtaagccctattacagcgactactctaggttcagactcctggtgcaccacctgtgcacctcccactatctggaccttttcatcacaggcgttataggcctgaacgtcgtgactatggcaatggagcattaccagcagcctcagatcctggacgaagcactcaaaatttgcaattatatcttcaccgtgatcttcgtcctggaatccgtttttaagttagtggccttcgggttccgccggttctttcaggacagatggaatcagctggatctcgcgattgtactactgtcaataatgggcatcactctcgaagagatcgaagtcaacgccagtctgcctataaaccctactatcatccggatcatgagagtcctcagaatagccagggttttgaagcttctgaagatggcggtgggcatgcgcgcgctgttggacaccgtgatgcaggccctgccccaggtcggcaatctcggtttgcttttcatgttgctctttttcatctttgccgcgcttggcgtcgaactcttcggggacctcgagtgcgatgaaactcatccatgtgaagggctggggcgccacgccacctttcggaattttggtatggcctttctaaccttattccgcgtgagtactggggataattggaatggcatcatgaaggacactctcagggattgcgaccaggaaagtacctgctacaacactgtgatttctcccatttactttgtaagttttgtgttgactgctcagtttgtactcgtgaatgtcgtgatcgccgtgttgatgaaacacttggaagaatctaacaaagaagctaaggaggaggcagagctggaggctgagttagagttggagatgaagactctttccccgcagcctcactcacctcttggctcaccatttctgtggccaggggtggagggcccagacagcccagattcccctaaacctggcgcgctacatccagcagcccacgcacgaagcgcaagtcacttcagccttgaacaccctaccatgcaacctcaccctacagaactgcccggaccggatctgcttacagtgcgaaaaagtggggtcagccgaactcacagtttaccgaacgatagttatatgtgcaggcacgggagcactgccgaaggccccctgggccacagaggctggggcttgcccaaggcacaaagcggatcagtactttcggtgcacagtcagccagcagacacctcctatattctgcagctgcctaaggatgcacctcatctcctgcagccccactccgcaccaacttggggcactatacccaagctcccaccaccgggtagatcccccttagcccagaggccactgcggaggcaggccgctatccggacagatagcctggacgtccaggggcttgggtcccgcgaagatctgttggctgaagaggaacctccaagccccagagaccttaagaagtgttattcagtggaagcccagtcctgtcaacgcagacccacatcctggttagacgaacaaagacgccatagcatcgccgtgtcctgtttggattcaggcagtcaaccgcacctgggaacggacccctcaaatcttggcggccagccactgggcgggcccggcagccgccctaagaagaagctatctcctccgtccatcaccatcgatcctccggaatcacagggacccagaacaccaccaagccccggaatttgtctgagaagacgcgcaccttcctctgactcaaaggatcctttagcatctggaccgccagactcgatggcagcctcaccaagcccaaagaaagatgtgctttccctcagcgggctgtctagtgaccccgctgatctcgacccttag

SEQ ID NO: 24730 - DNA, 5331 bp, Artificial Sequence
  Description of Artificial Sequence: Synthetic coding sequence
atggatgaagaagaagatggtgcgggcgccgaggagtctggccagccaagatcatttatgaggcttaacgacctgagtggcgccggcggacggcctggcccaggctcggccgagaaagatccaggctctgctgactctgaagccgagggcctcccttacccggctcttgcgcctgtagtttttttttacctcagccaagactctagacccaggtcctggtgtctgcgcactgtgtgtaatccatggttcgaaaggatttctatgctggtgatactgttaaactgtgtgacactcggcatgtttagaccatgtgaagatatcgcctgcgattcgcagcgttgcaggattctgcaggcttttgatgactttattttcgctttttttgcggtcgaaatggtcgtcaagatggtcgcccttggcatattcgggaagaaatgttatctcggggatacatggaatcgtttagactttttcatcgtgatcgccggcatgttggagtattccttagatctccagaacgtcagcttctctgcagttcgaaccgtgcgcgtattgcggccactcagagcaatcaaccgcgtccccagtatgcgcatcctcgtcacgctgttactcgacacactgccaatgctgggaaatgtgctgctgctgtgctttttcgtttttttcatattcgggatagtgggggtccagctttgggccggtttgctgaggaataggtgtttcctgccagaaaatttctcactgcctctgtctgttgatttggagaggtattaccagactgaaaatgaggatgagagtccatttatttgttcacagcctagggagaacggcatgagatcatgcagaagtgtgccgacattgcggggggatggcggcggcggcccaccatgtggcctcgactatgaagcctataactcatcctcaaataccacttgtgttaattggaatcagtactacacgaattgttcagccggcgaacataatccctttaagggagccatcaactttgataacattgggtatgcttggatcgccatcttccaggtcatcaccctggagggctgggtggatataatgtatttcgttatggatgcccacagtttctacaacttcatctatttcattctcctgatcatcgtaggcagcttctttatgatcaacctctgcttggtggtcattgccacacaattcagcgagaccaagcaacgggagtcccaactgatgagggaacagcgggtgcggtttctgagtaatgccagtactctggccagctttagcgagccgggctcctgctatgaggagctgctaaagtatctggtttatattctgagaaaggcggctcgccggctggcgcaagtgtctcgggccgccggagtgagagtgggcttactaagttctccagcaccactgggtgggcaggagactcagccaagctcctcttgcagcaggtcgcaccgtcgcctaagcgttcaccacctagtgcatcaccatcaccaccatcaccaccattaccacctgggaaacggcactttgagggcaccccgggcgtctccagaaattcaggatagagacgccaacggatcacgtaggctaatgttacctcccccctctactcctgccctgtcaggagcgccacctggaggtgctgaaagtgtacactctttttaccatgcggactgtcacctcgagccggtccgctgccaggctcctcctcctagaagtccttctgaggcttctggccgcacagttggcagtggcaaagtgtatcccaccgtacacacatctcctcctcctgagaccctgaaggagaaggcattggtggaggtcgccgcctcttctggaccgccgacgttaacgtcattaaacatcccacctggcccatactcctctatgcataaactgctggaaactcagtcaacaggggcatgtcagtcatcctgtaaaatctcctccccttgcctcaaagccgattcaggtgcctgtgggccggactcttgcccctactgtgcacgggctggggctggagaagtcgagctggccgatagagaaatgcctgactctgatagcgaagcggtgtacgaattcacccaggatgcacaacactctgatctacgcgacccccactctaggcgccagagatccctggggcctgatgctgagccttcaagtgtccttgccttttggcgactcatttgtgatacctttagaaagatcgtcgactcaaaatattttggcagggggataatgatagcaattttagtcaatacactgagcatggggatcgagtatcacgaacagcctgaagagctcaccaatgctttagagataagcaacattgtgtttactagcctgttcgctctggaaatgttgctcaagttgttggtgtacggaccatttggttatataaagaacccttacaacatatttgacggcgttatcgttgtgatctccgtgtgggaaattgtgggccagcaaggcggcggactctcagtgctgagaacatttaggctcatgagggtactaaagcttgtacgtttcctgccagctttacagagacagctggtggtgttaatgaaaacaatggacaacgttgccaccttctgtatgctgttaatgctattcatctttatcttttctatcctcgggatgcacctgtttggatgcaagttcgcatccgagagagacggggatacccttccagatcgcaaaaatttcgactctctgctgtgggcaattgtgactgtttttcagatcctgacccaagaggactggaacaaagtactgtacaacgggatggcttcgaccagcagctgggccgcactctacttcattgcactcatgacctttggcaactacgtcctgttcaaccttctggttgcgatcttggtggagggctttcaggccgaggaaatctcgaaaagagaagacgcatccggccaattgtcatgcattcaacttcccgtcgattcgcagggaggagatgcaaacaaatcggagtcggagcctgactttttcagtcctagcctcgatggggacggcgacaggaagaagtgccttgcattggtgtctctgggcgagcaccctgaactccgtaaatctttactgcctcctctcatcatccacaccgcagctaccccaatgtccttacctaagagcacaagcaccggactgggcgaggccctgggccctgcctctcgccgtacttcctcctcgggctcagccgaacccggcgccgcgcacgagatgaaaagtccgccgtcagcccgcagtagcccccatagtccttggtctgctgcgtctagctggaccagtcggcgatcatcaagaaatagcctggggagagctcccagcctgaagcggcggtccccttcaggcgaacggcggagccttctgtccggcgagggacaggaatcgcaggatgaggaggaaagttccgaggaagagcgggcttcaccagccggtagcgatcaccgacatagagggagcctggaaagggaagctaaatcttcgttcgatctcccagataccctccaggttccgggcttgcatcgaaccgcctctggaagagggtctgccagcgaacaccaggactgtaatggaaaaagcgccagcggccggctcgcccgcgcactgcgccccgatgacccgcctctggacggtgacgacgccgatgatgagggcaacctgtccaagggcgagcgcgtgcgcgcgtggatcagagcgaggcttcccgcctgctgcctggaacgcgattcttggtccgcctacattttccccccacaatctaggttcaggcttttgtgccaccgcattattacccacaaaatgtttgatcatgtggtcctggtgattatcttccttaactgtattacaatcgctatggagcgaccaaaaatcgatccacattcagctgagagaatctttttgacactttcaaactacattttcactgccgtttttctcgctgagatgacagtgaaggtggtagccctagggtggtgtttcggggaacaagcttaccttcgatccagttggaacgtactcgacggtctgctcgtactcattagtgtcattgacatcttggtgagcatggtatccgatagcggcactaagattttgggcatgttgagagtactgaggctgttgagaaccctacgaccactaagagttattagccgtgcccaaggcctaaaattggttgttgaaacactgatgtcgagccttaagcccatcggcaacatagtcgtgatctgctgcgcatttttcatcatcttcggcatcctgggagtgcaattgttcaagggtaaattcttcgtttgtcagggggaagatacacgcaatattacaaataagagcgattgcgcagaagctagctaccggtgggtgcggcacaaatacaatttcgacaatctgggtcaggcactcatgagtttgtttgtgcttgcgagcaaggacgggtgggtggatatcatgtacgatgggcttgatgcagtgggggtggatcagcaaccaatcatgaaccacaacccatggatgctcctgtacttcatctcctttctgcttatcgtggcattttttgtcctcaacatgtttgtgggtgtcgtggtggaaaacttccacaagtgccggcagcatcaggaggaggaggaggctcgacgaagagaggagaaaagactcagaaggctggagaaaaaaaggcggaacctgatgctcgatgatgtgatagcttcaggaagctccgcctctgcggcctctgaggctcaatgcaagccgtactactccgattactcacgctttcgcctgctggttcatcacctctgcaccagccactacttagacttgtttatcaccggcgtgattggactgaacgttgtgaccatggcgatggagcattaccagcagcctcaaatccttgatgaagcacttaagatctgtaattacatatttacagtaattttcgtcctcgagtctgtattcaagcttgtcgcgtttgggtttcggaggttcttccaggatagatggaatcagctagacctggcgattgtactgctcagcatcatgggcataacccttgaggagattgaggtgaatgcctctttaccgataaatcctaccattattcgaattatgcgagtgttaaggatcgccagagtgcttaagctgcttaagatggctgttgggatgcgggctctgctggacaccgtaatgcaggccctgcctcagctctgggcttggtcctctcttgaaacctggtccgtgacaaggcacacccccgtgagagcatgggctgttatgccgccttttggcacacttgcttggccttcatag

SEQ ID NO: 24731 - DNA, 7101 bp, Artificial Sequence
  Description of Artificial Sequence: Synthetic coding sequence
atggacgaagaagaagatggcgcgggcgccgaagagagtgggcaaccccgctcctttatgaggctcaacgacctgtcaggagcgggaggcagacctggcccaggctctgcagaaaaagatccggggtctgcggacagcgaagcagagggactgccatacccagcacttgcccccgtggtgtttttttatttatcccaggactctcgaccaagatcctggtgtctgcggactgtgtgtaacccgtggttcgagcgaatttccatgcttgtgattctgctgaactgtgtcaccctgggcatgtttaggccgtgtgaagatattgcttgtgattctcagaggtgtcgcatactgcaggcctttgacgatttcatattcgctttctttgcagtggaaatggtggtgaaaatggtcgcactcggcatattcggaaagaagtgctacctgggcgatacctggaatcggctcgacttttttatcgttattgccggcatgctggagtactccttggatctgcagaatgtttctttcagcgctgtcagaaccgtgagggtgctcagaccattaagagcaataaacagagtccctagtatgcggattctcgtaaccctacttctggacactctgccaatgctcggcaacgtcctactgctctgtttttttgtttttttcatcttcggcattgtgggagtccagctttgggccggactgctgagaaataggtgctttctacccgagaacttctcactcccactatcggtggatctggagaggtactatcagactgagaatgaagatgagtctccattcatttgtagccagccacgcgagaatggcatgcgaagttgtagatctgtccccaccctccgaggcgacggcggcggcggacctccatgtgggttagactacgaagcctacaactccagctcgaacacaacctgtgtgaactggaaccaatactatacgaattgttcagcgggtgaacacaacccctttaaaggcgccatcaacttcgataatatcggctatgcgtggatcgccatttttcaggtgattacactggagggttgggtcgacattatgtactttgtcatggacgcgcattctttctacaactttatttattttatcctgctgattattgttggatcctttttcatgattaacctgtgcctcgtggtcatagcaacccagtttagcgagacaaagcagagagagtcgcagctgatgagggagcagagagtgaggtttctatcaaacgcttctacactggctagcttctcggagccaggcagctgctacgaagagttactgaagtatctggtctacattctgagaaaagcggctaggagattggctcaggtgagccgcgctgctggcgtgcgagtcggtctgctgagctcgccggcgcctctgggagggcaggaaacacagcccagtagtagttgctcaaggtcacacagacgcctgtccgtgcaccatctagtccatcatcaccatcaccatcatcatcactaccacctcggaaacggcactctgcgcgctccacgcgcgtcccctgaaattcaggaccgcgacgcgaatgggagccgtcggctgatgctgccacctccaagtacgcccgccctgtcaggggcgccacctggcggggccgagagcgtgcactcattctatcacgccgattgtcatctggagccagtgaggtgtcaagctcccccaccacgctctcccagcgaggcctccggcagaaccgtggggtctgggaaggtctaccctaccgttcatacatctcccccacccgagaccctcaaagagaaggcccttgtggaagttgccgccagttccggaccccctacccttaccagcttgaatatacctccaggtccctacagtagcatgcacaaactgttagaaacacagtcgacaggggcctgtcaaagtagctgtaagatctctagcccttgtcttaaagctgactccggtgcctgtggacctgatagctgcccgtactgtgcccgcgctggggccggtgaggtggaattggccgatcgtgagatgccagatagcgacagtgaggccgtttacgaatttactcaggacgctcagcatagtgatcttagagacccacatagccggcgccaaaggtccctcggtcccgacgctgaaccgtcgtccgtcttggctttttggcgcctaatctgtgacacctttaggaaaattgtagacagcaagtattttggaaggggtatcatgatcgctattttagtgaacactttaagcatgggcatagagtaccacgagcaaccagaagagctaactaatgctttagagatcagcaacattgttttcacctccctgtttgcactagagatgcttctcaagctgctggtgtatggtccctttgggtacatcaaaaacccctacaatatctttgacggcgttatcgtggttatttcagtgtgggagatcgtgggccagcagggcggaggtctttcagtgctccggaccttcagacttatgagggtgcttaaacttgtgcgattccttcctgccctccagcgccagctggtggtccttatgaaaactatggacaacgtggccacattttgtatgctgctgatgctgttcatatttatctttagcatcctcggcatgcacctgtttgggtgcaaatttgcaagcgagagagatggcgacaccctgcctgaccggaagaactttgatagtctattatgggcgatcgtgaccgtgtttcagatcctgacccaggaagattggaataaggtactgtataatggcatggcctctacttccagctgggcagctttatattttatcgccctaatgaccttcgggaattatgtattattcaatctccttgtcgccatcctcgtcgaagggttccaggccgaagaaatttccaagcgggaggacgcatctggccagttgtcctgtatacagctgccggtggacagccagggtggcgacgcaaacaagtctgaatccgagcccgattttttctctccatccttagatggcgatggggacaggaagaaatgcctggccctggtgagcttgggtgagcaccccgagctgcgtaagtccctactgcctccacttattatccacaccgccgctactccaatgtcattgccaaaatcgacttcaacaggcttgggtgaagctcttggccccgcctctcggaggacaagctcctccggctcagcagagccaggcgcggcgcacgagatgaagagtcctccatccgcaagaagctccccacactctccttggtccgccgcctcttcttggacttctcgccggagctctcggaatagcctgggtcgggcgccctctttgaagcgcaggtcacctagtggcgagaggcggagtctcttatccggtgaaggccaggagtcccaggatgaggaggagtcaagtgaagaggagagggcaagtcctgccgggtctgaccaccgccatagggggagtctggaacgagaggccaagtcctcctttgacttgccagatactttgcaggtgcccgggcttcatcggaccgcttccggacgcggaagcgcctctgaacaccaggactgcaatggaaaaagcgcatctggtcggttggcccgtgccctaagacctgacgatcctcctctcgatggcgacgatgccgatgatgaagggaacctcagtaagggcgaaagggtcagagcatggatcagagctaggcttccagcctgttgtcttgaaagagattcatggtccgcttatatctttccccctcaatcacgttttcggctcctgtgccacaggattatcacacacaagatgtttgaccacgtggtgttagtcatcattttcctgaactgcatcacgatagccatggaacgaccaaaaattgatccgcactctgcagaaagaatctttctcaccctgagcaactacatctttacagcggtgttcctggcggaaatgaccgtgaaagtggtggccttaggatggtgcttcggcgaacaggcgtacttacgcagcagctggaacgtgctggatggcctgttagtattaattagcgtgatagacattctagtcagtatggtgagtgactcgggtaccaagatcctggggatgctgcgggtgcttcggctcctgaggacgcttcggcccctgcgagtgatctcacgcgcgcagggacttaaactcgtggtcgagacactcatgagttctcttaaacccattggcaatatcgttgttatttgctgtgccttttttattatctttggcatattgggtgttcagctctttaaaggaaagttcttcgtgtgccaaggggaggacactcgcaacataaccaataagtcagattgcgcagaagcatcataccggtgggtgcggcataagtacaatttcgataatctggggcaggccctcatgtcactctttgtgttagcctccaaagatgggtgggtcgacatcatgtacgacggtctggacgccgtcggcgtggatcaacagccaataatgaatcacaacccatggatgctactgtatttcatttctttcctgctaatcgtcgcattctttgtcctgaatatgtttgttggcgtggttgtagaaaacttccataagtgtcggcagcaccaagaggaggaggaggccaggcggagagaggaaaagcgactgagaagactcgagaaaaagaggagatccaaggagaagcaaatggcggaagcccaatgcaagccgtactacagcgactattctcggttccgactgctggtgcatcatttgtgtacatcccactacctcgatctctttataacaggagtcatcggcttaaacgttgtgactatggccatggaacactaccagcaacctcagatccttgacgaggcccttaaaatatgtaattacatttttactgtcatcttcgtcctggagagtgtatttaagttagtcgcctttggcttcagacggtttttccaggaccgctggaaccaactggacctggccattgtgctgctctctattatgggtatcacactcgaagaaatcgaggttaacgcatccctacccatcaacccaactattatccggataatgagggtactgcggattgcgagagtgctgaagcttttgaagatggccgttggaatgcgggcactcctagatactgtgatgcaggccctgccccaggttggaaatctgggattgctttttatgcttctattcttcattttcgctgcactgggggttgagttgttcggtgatctggagtgcgatgagactcacccttgcgaaggcctggggcgccatgcaaccttccggaactttggtatggcctttttgaccctcttccgagtctctacaggcgataactggaatgggattatgaaagacacattgcgggattgcgatcaggaatcaacatgttataataccgtcatctcacctatatacttcgtttcttttgttctgactgcccagtttgtcctcgtgaatgtcgttatcgccgtgttaatgaagcatctggaggagtccaacaaagaagccaaggaggaagcagaactggaagccgagctcgagctcgagatgaaaactttgtcccctcagccacactccccattaggcagtccgtttttgtggcctggcgttgaaggtcccgacagtcctgattctcccaagcctggggcattgcaccccgccgcacacgccagaagcgccagccacttcagtctggagcaccccaccgaccggcagcttttcgacacaatcagtctgttgatccaaggaagtcttgaatgggaactgaaactaatggatgaactggccgggccaggcggacagccctcagctttccctagtgcaccatctcttggcggcagtgaccctcagatcccgctcgccgaaatggaagccctatccctgactagcgaaatcgttagcgaacctagctgctctctggctcttactgatgactcactccccgacgacatgcatacactgctcctgtctgccctggaatctaatatgcagccccacccaaccgagttgccaggccccgacctcctcacggtacgtaaatccggcgtaagcagaacccactccctgcctaacgattcatacatgtgtcgacacggatctaccgcggagggccccctggggcacagaggttggggactgccgaaagcacaaagtggctccgtactgtccgtccactctcagcctgccgatacatcatatattctccagctccctaaagacgctccccacctcctgcaaccacactctgcaccgacctggggtaccatccctaaacttccgcccccagggaggtcaccactcgcccagcggccattaaggaggcaagcggctatccggactgacagtctggacgtgcaggggctgggaagtagagaggacctgttggccgaggtcagtgggccaagtcctccattggcccgggcctacagtttctggggccagtcaagcacacaggcacagcagcatagcaggagccatagtaaaatctcaaagcacatgactccccctgccccttgtcccggaccagaacccaactggggcaagggcccccctgaaacccggtcttctttggagctcgataccgagcttagttggatttctggggacctgcttcccccgggtggacaggaggagcccccaagccccagggatttgaagaaatgttactccgtggaggcccagtcctgccagcgaagacctacgtcatggctcgacgagcagcgcagacattctattgctgtgagctgtctcgactcaggtagtcaaccccacctgggcacggatccgagcaaccttggaggacagcctctggggggacctggatctaggccaaaaaagaagctgagcccaccttctatcactattgaccctcctgagtcccagggacccaggaccccaccgtctccaggcatttgtctccggaggagggcaccttccagcgacagcaaggacccattagccagtggccctccggattcaatggccgcatctcctagcccgaagaaagatgtcctgtccctgtcgggcctgtcttctgatcctgccgatctggatccttag

SEQ ID NO: 24732 - DNA, 6999 bp, Artificial Sequence
  Description of Artificial Sequence: Synthetic coding sequence
atggatgaggaggaagacggggctggagccgaggagtccggccagccgcgaagcttcatgcgattgaatgacctgtcgggagccggcggccgccccggacctggttctgcagagaaggacccaggctcagcagacagtgaagctgaaggcctgccctatccagccctggcacctgtggtgttcttttacttgagccaagattctcgcccaaggtcttggtgtctccgtacagtgtgcaacccatggttcgagcgcatctccatgctcgtcattctacttaactgcgtcacattaggaatgttccggccctgcgaagacattgcttgcgatagtcagaggtgtagaatcctccaggctttcgatgacttcatatttgctttctttgcagtagagatggtggttaagatggtcgccctgggcattttcggcaaaaagtgttacctgggagatacctggaatcgtctggactttttcattgtgatcgccggcatgctggaatacagcctcgatttacaaaacgtgagcttctccgctgtgcgcaccgtccgggtcttgagaccactgcgtgctatcaatagggttccttccatgcggatcctcgtaaccctattgttggacaccctcccgatgctagggaacgtgttgctactgtgctttttcgttttttttatatttggcatagtcggggtgcagctatgggcgggcctgcttcgtaatagatgttttctgcctgagaacttcagcctcccgctgtctgtggacctggagaggtactatcagacagagaacgaagacgagtccccatttatttgctcacaacctcgagagaatggcatgagatcctgtcgatcagtgcctactctcagaggtgatggcggagggggaccaccatgtggactagattacgaagcttacaattccagttccaacacgacatgtgtgaactggaatcaatactacaccaactgcagcgccggcgaacataacccattcaagggagcgatcaattttgacaatatcgggtatgcttggattgccatctttcaggtgatcactctcgagggatgggtcgacataatgtactttgtgatggacgcccacagtttctacaatttcatttacttcatccttctgatcattgtcggctccttcttcatgatcaacctctgtctcgtggtgatcgctacacaattctccgaaactaagcaacgcgagtcgcagctgatgcgggagcagcgggtgcgatttctgagtaatgcatctaccctagctagcttttcagaaccaggatcctgctacgaagagctgctcaaatatcttgtatatattttgaggaaagccgccagacgactcgcccaggtctctcgagccgccggcgtgcgggttggcttgctctcctctccagccccattaggcggtcaggaaacccagccaagtagcagctgcagcaggagccaccggcggctgtccgtccaccatctggtgcatcatcatcatcaccaccaccatcactatcacctagggaacggcactctcagggcgcctagagcttctcccgagatccaagacagagatgctaacggctcaaggcggctgatgctgccacctccatcaacacctgctctctcaggggctccaccaggcggtgcggaatccgtgcattctttttatcatgcagactgtcacctggaacccgtgagatgccaggcccctcctccaagaagtccctctgaggcttctggacgaactgtgggcagcggtaaggtgtatcctacagtgcatacctcccccccaccagaaactttgaaagagaaagccctagtagaggtggcagcatcgagtggcccccccactctgacctctctgaatatcccaccaggcccatacagctccatgcacaagctgctggagacacaatccaccggagcatgtcagtcatcgtgtaagattagcagtccctgcctgaaagcggactctggggcctgtggtccggacagctgtccttattgtgcgcgggcaggcgccggagaggtagaactggcagaccgtgagatgcccgacagcgactccgaagccgtctatgaatttacccaggacgctcaacattctgaccttcgagaccctcattcgcggaggcaacgaagcctcggcccagatgccgaaccatcctcagtgctcgcattctggcggctgatctgtgacaccttcagaaaaatcgtagactccaagtattttggcagagggattatgatagcgatactggtgaatacactatccatgggcatagaatatcacgagcagcccgaggagttaaccaacgccctcgagatctctaatatcgtttttaccagtctgtttgcgttggagatgttgctaaaactgctcgtttacggccccttcggatacatcaaaaacccatacaacatcttcgacggagtgatcgtggttatcagtgtgtgggagatagtgggccaacagggggggggtctcagcgtcctgcggacattccgtctgatgagagtgttaaaactggtacgttttttacctgccctccaacggcagttggttgtactcatgaaaacaatggataacgtcgcgacattttgtatgctcctcatgctgtttatatttatatttagcatcctgggtatgcatttattcggctgtaaattcgcttccgaacgcgacggagatacattaccggaccgaaagaattttgattcgctgctttgggccatagtgaccgtgttccagatacttactcaggaagactggaataaagtcctttacaatgggatggcctctacatccagctgggctgcactctactttattgcattgatgacattcggtaactacgtactgttcaacctattggtggcgattctcgttgaggggttccaggcagaggaaattagcaagagggaggatgcctcgggacaactcagttgtatccagctgccagtggatagtcagggcggagacgctaacaagtctgagagtgagcctgacttttttagcccatctttggatggtgatggcgataggaaaaaatgtctagctctggtaagtctgggcgaacacccagaactaagaaaaagcctcctgccacctttaattatacacacagcagccacacccatgtcactgccgaagtcaacgtcaacaggcttaggggaagctctgggtccagccagcagacggaccagtagtagcggaagcgctgagcctggcgctgcccacgagatgaagtctcctccgtccgcgcgctctagcccccacagcccttggtctgccgccagctcatggactagccgaagaagctcgcggaactccctcggtcgcgctccttcattaaagcgcagaagccccagcggggagcgaagaagtctcttgagcggtgaagggcaggagtcccaggacgaggaggagtcatctgaagaggagcgcgcctcacccgctggatcggaccaccgtcaccgcggttcactggagcgagaggcaaaaagtagctttgatcttcccgacactcttcaggtccctggcctgcacagaacagcctccgggcggggatctgcttctgaacaccaagactgtaatggaaagtctgcgtctggacgactggcaagggccctgcggccggatgacccgccgcttgatggcgacgatgccgacgatgaggggaatctgtccaagggggaacgcgtgcgagcatggatacgagccaggctgccagcttgctgcttggagcgggactcctggagcgcctatattttccccccgcagtctcgctttcgcttgttatgtcaccgtattataacacacaagatgttcgaccacgtagtgctcgtgattatctttttaaattgtattacgatcgccatggagcggcccaagattgacccgcatagcgcagaacgaattttcctcacgctgagcaattacatattcacagctgtatttctggccgaaatgaccgttaaggtcgtcgctcttgggtggtgtttcggggagcaggcatatttgcgttcttcatggaacgtgctcgacggactgcttgtgctgatttccgtgatcgacatcctggttagcatggtcagcgacagcgggaccaagattctgggcatgctcagagtgctgcggctgcttcggaccctgcgcccgcttcgcgttatctcacgagcacagggcctgaagctggtggtggagaccctcatgagttccctcaaacccatcggtaacatcgtggtgatctgctgcgcattctttatcatttttggaatcctcggcgtgcaactgttcaaaggcaagttcttcgtctgtcaaggggaagatacaaggaacatcacaaacaagagcgactgcgcagaagccagctaccgatgggttcgccataagtacaatttcgacaacctcggacaagcactaatgagcttattcgtgttagcctccaaggacggttgggttgacataatgtatgatgggctcgacgctgtaggcgtcgaccaacagcctatcatgaatcacaacccttggatgctgctttactttatttcatttctgttaatagtcgccttttttgtattgaatatgtttgtaggagtggtggttgaaaactttcacaaatgtaggcagcaccaagaggaggaggaagcccgccgcagggaagagaaacgcctgaggagactggaaaagaaacgacgtaacctgatgcttgacgacgtcattgccagtggaagttcagcctctgcggcctccgaagcccaatgcaagccgtactacagtgactactctcggttccgccttctcgtccatcatctttgtaccagtcactatctggacctctttatcacgggagtcatcggacttaatgtggtgacgatggcaatggaacactaccagcagccacaaattctggatgaggctctgaaaatctgcaattatatattcacagtgatattcgttctcgagtccgtgtttaagctggttgcattcggctttcgaagattttttcaggacaggtggaatcagctggaccttgccattgtgcttctttctatcatgggaatcaccctggaggagatagaggtgaacgccagcctgccgatcaaccctaccataatacggattatgcgcgtactgcgcatcgcccgcgtcctaaagttgcttaaaatggccgtggggatgcgggcccttctcgacacagtgatgcaagctctgccccaggtgggaaatcttggcttgctgtttatgctgcttttttttatcttcgcggccttaggcgttgagctgtttggtgaccttgagtgtgacgaaacccatccttgtgaaggtctcggtagacacgcgacattccgaaactttggcatggccttccttactctgttccgggtgtccaccggtgataattggaacggaattatgaaggatacattgagagattgtgaccaagagagtacctgttataacactgttatctctccaatctattttgttagtttcgtgttgactgcgcagtttgtactggtgaatgtggttatagcagtgctaatgaagcatctagaagagtctaacaaggaagccaaggaggaagctgaactggaggctgagcttgaactggagatgaagacattgagtcctcagccccactccccacttggatctccctttctctggcctggggtggagggccctgactctcccgattcacctaaacccggagcgctccatcctgcagcccacgcgaggagcgcctcgcatttctccctcgaacacccaactgacagacaattatttgatacaatttcactgctgattcaaggcagcctcgaatgggagctcaagctgatggatgaacttgccggcccgggcggccaacctagtgcttttccgtctgccccctccctgggcggttctgacccccagatgcagcctcacccaacggagctcccaggccccgaccttttaacggtgagaaagagtggtgttagtcggacccacagcctccctaacgattcctacatgtgtaggcatggttcaaccgccgaaggccctctggggcaccgaggctggggcctccctaaagcgcagagcggctcagtacttagcgtccactcccagccagctgatacatcctacatattacagctgcctaaggatgcaccccatctgctacagccccattcggccccgacctggggaacaattcctaaattacctccgcccggcaggtcaccgctcgcccaaaggccattgcgtcgacaagccgcaattcgcacagacagcctggatgtgcagggattgggtagcagagaggacctcttggccgaggttagcggaccctctcctcccctggcccgtgcatacagcttttgggggcaaagctcgactcaggcccagcaacattccagatcacacagtaagattagcaagcacatgacacccccagctccatgtccagggcccgagcccaactggggcaagggccctcctgagacacggtcctctcttgagctcgatactgaactgtcttggatctctggggatctcctgccccctggtggacaggaagagcctccctccccccgtgatctcaaaaagtgttacagcgtcgaagctcaaagctgccagagacggcctacatcttggctggatgagcagcgtcgacacagcattgccgtgtcctgcttagattctggcagtcaaccacatctggggaccgacccatccaatctgggagggcagccactgggggggcctgggtcaagacctaaaaagaagctatcccctccttccattacaatcgatcctcccgagtctcagggacctcgtacaccaccatcgccagggatctgtttgagacgtcgggcaccctcgagtgactcaaaagaccccctggccagtggcccgcccgattcaatggctgctagtccatcccccaagaaggatgtcctgtcgttatcagggctgtctagtgatccagccgacttggatccttag

SEQ ID NO: 24733 - DNA, 6834 bp, Artificial Sequence
  Description of Artificial Sequence: Synthetic coding sequence
atggatgaggaagaagatggagccggagcagaagagtctgggcaaccaaggtccttcatgcgactgaatgacctgagcggcgccgggggcagacccggccctggctccgctgagaaggatcccggcagtgctgactccgaagccgaaggactcccgtacccagccctggcaccagtcgtatttttttacctttctcaagatagcagacctcggtcttggtgtttgcggaccgtatgtaatccgtggttcgagcggatttcaatgttggtgattctgcttaattgtgtgaccctggggatgtttcgtccatgcgaagacattgcgtgcgactctcagcggtgccgaattctgcaagcatttgatgatttcatcttcgcgtttttcgctgtggaaatggtagttaagatggtggccctggggattttcggcaaaaaatgttatctgggtgatacttggaatcgcctcgacttttttatagtgattgccgggatgttagagtatagtcttgacctacaaaacgtgtctttttctgccgttcgtactgttagggtgttacgcccccttcgcgccatcaatcgagtcccctccatgagaatcctggtgacactgttgttagataccctccctatgctgggaaatgtgttactgctgtgtttcttcgtgttcttcatctttggaattgtgggggtacagttgtgggccggattgctcaggaatcggtgtttcctccccgagaacttctcactgcccttgtctgtcgatctcgagcgctactatcagacagagaatgaggacgaaagtcccttcatctgctctcaaccaagggaaaatgggatgcgcagctgccggtctgtacccacactgcgaggtgacggcggcggtggccctccatgcggcctcgattatgaagcgtacaactcaagcagcaacacgacctgcgttaattggaaccagtattatacaaattgttccgcaggagaacataacccatttaaaggggcaatcaactttgacaacattggctacgcctggattgccatttttcaagtgatcaccctcgaaggctgggtcgacataatgtactttgttatggacgcccactcattctacaacttcatttactttatacttttgattatcgtgggatcgttttttatgattaacctgtgcttggttgtgatagccacccagttttcagaaaccaagcagagagaatcccaattaatgcgagagcaaagagttagatttctgagcaacgcatctacactagcctctttttcagagccaggatcttgctatgaggaactgctgaaataccttgtgtacattctcaggaaagctgcacgccgactggcacaggtttcacgggctgccggcgttcgggtggggcttctttcgagccctgcccccctgggcgggcaggagactcagcctagcagtagctgtagccgtagccaccgcagactgtccgtgcaccatctcgtccaccaccatcaccatcaccatcaccactatcacctgggcaacgggacactgcgggctccccgagcaagtcccgagatccaggaccgtgacgcaaacggcagtcgtaggctgatgttgcccccacccagcactccagcactctccggggccccccccggaggagccgagagcgtgcatagcttttatcacgctgactgtcacttggagcccgtgagatgccaggccccacccccccgaagtccatctgaagcctctggtcgtactgttgggagcggaaaagtgtatcccactgtccacacctctcctccgcccgaaaccttgaaagagaaagccctcgtagaagttgctgcatcttccggcccgcctacactgaccagtttaaacatcccccccgggccatatagcagcatgcacaaactgctggaaacccagagtactggagcttgccagtccagctgcaagatctctagcccttgtctcaaggctgactccggcgcatgcggtccggactcttgcccttattgcgcccgcgcaggagcgggggaagtcgagttggcggaccgggaaatgccagattctgactccgaggcagtgtacgaatttacacaggacgctcaacatagcgatttacgcgatccccattctaggagacagaggtctctcggccctgacgctgaacccagcagcgtgctggccttttggcgcctcatttgtgacacatttcggaaaatcgtagatagcaaatactttggacgcgggataatgatcgccatactcgtgaataccctgtctatgggaatcgaatatcatgaacagccagaggagctcactaacgccctggagattagcaacattgtgtttacaagtctgtttgccttggagatgctcctgaaattgttggtttacggacctttcggctacattaagaatccatataacatctttgacggtgtaatagtcgtcatctcagtgtgggaaatagtgggacaacaaggtggaggattgtccgttctcagaaccttccgcctgatgagggtcctcaagttagtgcggttcctccccgccctgcagagacagctagtcgtgctgatgaagaccatggacaacgtcgccactttttgtatgttgttgatgctgtttatttttattttttctatcctggggatgcacctctttgggtgcaaattcgcctctgagagagatggcgacacattgccggatcgcaaaaattttgattccctcctgtgggctattgttacagtcttccaaatcctgactcaggaggattggaataaggtcctgtacaacggcatggcaagcacaagttcttgggccgctttgtactttatcgctctgatgactttcggcaactacgtcttgttcaatttgctagtggccatactcgtggagggtttccaggcagaggagatatctaagagggaggacgctagtggacagctttcctgtatccagctcccggtcgatagtcagggaggagacgcaaataagagcgagtccgagcctgactttttttccccaagtctggatggagatggggatcgcaagaaatgtctggcgctggtctccctgggggagcaccccgaattaaggaagagcctcctccctcccttgattatacatactgctgcaactccaatgtcattgccaaagagtactagcacaggcttgggagaggccctcggacctgcttcccggcgtacctcatcttccggctccgcagaacctggtgccgcacacgaaatgaaatcaccccccagcgcccgttccagcccccactctccatggtcggccgcgtctagctggaccagtagacgcagtagccgcaactctctgggccgcgcaccatccttaaaacgacgttctccgtccggcgaacgacgcagtctgttaagtggtgagggtcaagaaagtcaagacgaggaggagtccagcgaggaagagagggcgtctcctgcggggtcggaccacagacacagaggcagcctggagagggaggctaagtcctcctttgacctacccgatacactccaagtacccgggttgcatagaacagcatctgggaggggttctgctagtgagcatcaggattgcaatggtaaaagcgctagtggtcggctcgcccgtgccctgcggcccgacgatcctcctctggacggcgacgacgctgacgatgagggcaatctgagtaaaggggagagagttagggcttggatccgcgcgcgattgcccgcctgttgtctggaacgcgacagctggagcgcctacatttttcccccccagtcaaggttcagactactctgtcacagaatcatcacccacaaaatgttcgaccacgtggtcctagtgattatctttctcaattgcatcaccatcgctatggagaggcccaagatcgatccacactcagccgaaagaatctttctcactctgtcgaactatatttttactgcagtttttttggcagagatgacagttaaagtcgtggctttaggatggtgcttcggggagcaggcttatcttagaagctcatggaacgtcctagacgggttgttggtactcatttctgttattgatattttggtgtctatggtgtcagactctggaaccaaaatactgggaatgcttagagttctccgtttgcttcgcactttgcgaccactacgggttatttcacgggcacaggggctgaaactggtggtggaaactctcatgtccagtctgaagccaatcggaaatatcgtcgtgatctgttgtgcgtttttcatcatcttcggcattttgggtgtacagctgttcaagggaaaattttttgtatgccaaggagaggatacaaggaatattacaaacaagagtgattgcgccgaggcctcctatagatgggtgcggcataaatacaattttgacaacctcggccaggccctcatgagtctgtttgtcctcgcatccaaagacggatgggttgacatcatgtatgatggactggatgccgtgggggttgaccagcaaccaattatgaatcacaacccttggatgctcctgtacttcatctcatttttattgatcgtggcattcttcgtcctcaatatgttcgtgggcgtcgtagtcgagaacttccacaaatgtcggcagcaccaggaagaggaggaggccagacgtcgagaggaaaagcgactgcggcgtctggagaagaagcgtcgaaacctcatgctcgatgatgtgattgcgtctgggagtagcgcatctgccgcgtcggaagcgcaatgtaagccctattactctgattactcccgctttcgtctcttggtgcatcatctgtgcacgagccattatctcgatctctttattacgggcgtgattgggctgaatgtcgtcacgatggcaatggaacattatcagcagccgcagatcttagatgaggctctgaagatttgtaattacatcttcacagtgattttcgtactggagagcgtatttaaactggtagccttcggatttcgaaggttctttcaggacagatggaaccagctggaccttgctatagtactgctgagcattatggggataaccttggaagagatcgaagtgaatgcttctctaccaataaaccctacaattatacgtattatgagagtgttgagaattgcgcgggtcttgaagttgctgaagatggccgttgggatgcgtgcccttctggacacagtgggaaacctgggactgctgtttatgctgctgttcttcatcttcgccgccctgggcgtggaattgttcggagatttagaatgtgatgaaacccacccctgcgagggcctggggaggcatgctaccttccggaactttggtatggcattcctgaccctgtttagagtgtccacgggggataattggaacgggataatgaaggacactctccgtgactgtgatcaggaatccacctgttacaatactgtgatctcccccatctactttgtctcttttgtgttaacagcacagtttgtgcttgtgaacgtggtcatagcggttctcatgaaacatctggaggagtctaacaaagaagccaaggaggaagccgagctcgaagccgagcttgagctggagatgaagaccctatccccacagcctcattcccctctcggctcaccttttctgtggcccggcgtagaaggtccagactcacctgattcaccgaagcctggcgctctgcatccagctgctcacgccaggtctgcctcccatttctctctggagcaccctacaatgcagcctcaccccactgaacttcccggaccagacttgcttacagttcgcaaaagcggcgtgtctcgcactcactccctgcccaacgactcctacatgtgcaggcatggaagcacggccgagggcccactggggcaccggggatggggcctccccaaggcacagtccggttcagtgttgtctgttcacagccaaccagcggacacctcttacattctacagctcccaaaggatgcccctcatctgctccagccacactccgcaccgacttggggcacgatcccaaaattgccccctcctggtcgaagtccgcttgctcaacggcccctccggcgacaggcggccattagaacagactcccttgatgtgcagggcttgggatccagagaggatctgctggccgaggtgtcgggcccctcccccccactggcaagagcatatagtttttggggccaaagctctacccaagctcaacagcactcccgttcccattctaaaatatctaagcatatgacccctcccgcaccctgccccggccctgaacccaactgggggaagggaccgcccgaaacacggagctccctcgagctggacaccgagctgtcatggatatctggcgatcttcttcctccagggggccaagaggaacccccttcaccccgggacctgaaaaagtgttatagcgtggaagcccaatcgtgtcagagaaggccaacctcatggctggacgaacaacgaaggcatagtatcgccgtgagttgcttggactctgggagtcagccgcatcttggtacagatcccagcaaccttgggggccagcccttaggggggccagggtctcgccctaagaagaagttatcgccgcccagtatcactattgacccgcctgaaagtcagggcccccgcacacccccatctcccgggatctgtctgcggcgccgtgccccttcaagcgacagtaaagaccccctcgcctccgggccacccgactccatggctgcctcaccctcccctaagaaggatgtcctcagcctgagcggtctgtcttccgatcctgcggatctcgacccatag

SEQ ID NO: 24734 - DNA, 6585 bp, Artificial Sequence
  Description of Artificial Sequence: Synthetic coding sequence
atggatgaagaagaagatggtgctggcgccgaggagagcgggcagccccgttcgttcatgaggttgaacgacttgagtggcgccgggggtcgacccggaccaggcagcgctgaaaaggatcctggaagcgccgactcggaggctgaaggcctaccataccccgcgttggcaccagttgtgtttttttatctgagtcaagattcgcggccaagatcctggtgcctacgtaccgtgtgcaatccatggttcgagcggatcagtatgctggtcattcttctgaattgcgtgacattggggatgtttagaccttgtgaggacatcgcctgcgatagccagagatgccggattcttcaggccttcgatgacttcatattcgcgttcttcgctgtcgagatggtcgtgaagatggttgcgctgggcatttttggcaagaagtgctatcttggggatacgtggaacaggcttgacttttttattgtcatcgccggtatgctagaatacagtttggatctgcagaatgtgtcttttagcgcagtgagaacagttagggtactgcgaccactccgggccatcaacagggtcccatccatgaggatactggtaactctgctgctggatactttgcctatgctgggtaatgtgctactgctttgcttcttcgtgttttttatctttggaatcgtgggcgtccagttatgggccggactgctgcgtaaccggtgttttttaccggagaactttagtctgccattgagcgtggatttggaaagatattatcagaccgaaaacgaagacgagagcccgttcatatgttcccagcccagggaaaacggcatgagaagctgcagatcagtgcccacactcaggggagatggtggagggggtccaccgtgcgggcttgactatgaagcctataacagctcaagtaacaccacatgtgtgaactggaaccagtattacactaattgtagtgccggggaacacaatcccttcaagggcgccattaatttcgataacatcggctacgcctggatagcaatcttccaggtcattaccctggaaggctgggtggacatcatgtattttgtcatggatgcccactccttttataattttatctactttatactcctaattatcgtgggcagtttctttatgattaacttgtgcttggttgtgatcgctactcagtttagtgagacaaagcaacgggagtcacagctgatgagggagcaacgcgtaaggttcctcagcaacgcatcaactctggccagcttctctgaacccgggtcgtgttacgaggagctgctgaagtatcttgtttacattcttagaaaagcagcacgtaggttagctcaagtgtccagggccgccggggtgagagttggcctcctcagcagccctgcacctctcggaggacaagagacacagccgagctcctcttgtagcaggtctcatcggagactgtccgtacaccacttggtgcaccaccaccaccaccatcaccatcattatcacctggggaacgggactttgagggcaccacgcgcttctcctgaaattcaggatcgggatgcgaacggttcccgtcggctcatgcttccccccccatcgacgcctgcattgtccggtgctccccccggtggggccgaatctgtgcacagcttttatcacgccgattgtcatcttgaacctgtgaggtgccaggcgccaccaccccgcagcccctctgaggcctccggtcgcactgtgggcagcggcaaggtctaccctaccgtgcacacgtctcctccaccagagaccctcaaggagaaagcactggtggaggttgcggcctcatccgggccacctactctcacgtctcttaatattcctcccggaccttactcttctatgcacaagctgctggagacccagtcgacaggcgcctgccagtcgtcctgtaaaatctcttccccctgtctgaaagcagacagcggagcttgcggtccggactcttgtccatactgcgcccgggctggggctggcgaggtggagctggccgacagggagatgcccgacagtgactccgaggctgtatatgagttcacccaagacgcacaacactcagatctccgagaccctcactcacgcagacagagatctcttggccccgatgccgaaccttcctcagtcctcgcgttttggcgactgatttgcgacacgtttagaaaaatcgtggacagtaaatactttgggagagggattatgattgccatccttgtcaataccctgagcatgggtatcgaataccatgaacaacccgaggagctcaccaacgcactggagatttctaatattgtattcacctcactgtttgcgttagaaatgctgctaaagctcctcgtctacggcccattcgggtacattaagaacccttataacatcttcgatggagttatcgttgtgataagcgtttgggagatcgtgggtcagcagggaggggggttgagcgtgctgagaacgtttagacttatgagagtcctcaagttggtgagatttctccctgcgttgcaacggcagctggtggtgctgatgaaaactatggacaacgtggcaacgttctgtatgcttctgatgttgtttattttcatctttagcatattgggaatgcacctttttggttgcaagttcgcaagcgagcgagatggcgatacgctgcctgatcgcaagaactttgatagcttattgtgggctatcgtgactgtgttccagattctaacgcaggaagattggaacaaggtgttgtataatggtatggcttcgacttctagctgggccgccctctattttatagcgttgatgactttcggaaattacgtgctttttaacctgctcgtcgcaatcctagtcgaaggcttccaggctgaagaaatttccaagcgcgaggatgctagcgggcagttatcttgtatccaattgccagtcgactcccagggaggcgacgcgaacaagtccgagtctgagcccgattttttctccccgtcactggatggagatggggacaggaaaaaatgtttagccctcgtgtctctcggtgaacatcccgaattgcggaaatcactcttgccccccctgataatacacactgctgccactccgatgagtttacccaagagtactagtacagggcttggcgaggctctgggaccagcatccagacgcacttcatcctctggtagcgccgaaccaggggctgctcacgagatgaaaagcccgcctagtgcacgtagctcaccccatagcccttggtccgcggcatcatcttggaccagtcgcagatcgtccagaaattcactgggccgggcacccagcctgaaacgccgctctccaagtggagaaaggaggtccttgctctcaggcgaaggccaggagagtcaggacgaagaggagtcgtcagaagaggaacgcgccagccctgcaggtagcgaccaccgccaccgggggtcactggaacgagaagccaaatcatccttcgacctgcccgatacactccaagtcccgggcctgcacaggaccgcttctgggcgtggctcagccagcgagcaccaggattgcaatggcaagtcagcctctgggagactcgcgagggcactgcgtcccgacgatccacctctggatggcgacgacgctgacgacgaaggcaacctgagcaagggcgagcgggtccgagcatggattcgcgcccgactgcccgcatgttgcctcgagagagactcttggtctgcatacatttttccacctcagtcaaggttccgcttgttgtgtcatcgcatcatcacccacaagatgtttgaccacgtcgtattggtgattatctttctgaattgtatcacaatcgccatggagaggcccaaaattgacccccattctgcagagcgcatctttctgacgctgtcaaattatatctttactgcggttttcctggcagagatgaccgtgaaggtcgtagcactcggctggtgctttggggagcaggcttacctgagaagctcgtggaatgtgctggatgggctccttgtcttaatatccgtcatcgatatccttgtctccatggtttctgactcggggaccaagatcctgggcatgctgcgggtattgcgattgttaagaaccctgaggccgctgagagtcatctctcgggcccagggtctcaaactggtcgtggagactttgatgagttcacttaaaccgatcggaaatattgttgtcatctgttgtgccttctttattatcttcggaatcctgggcgtgcagctgtttaagggaaagttttttgtatgccaaggcgaagacactcggaacattactaacaagtcagactgtgccgaggcatcttaccgatgggtgcgccataagtacaacttcgataacttaggtcaggcgctgatgtctctgtttgtgctcgcatccaaagatggttgggtggatataatgtacgacggcctagacgcagtcggcgtagatcaacagcccatcatgaatcataacccctggatgttactttactttatttcctttctcctcattgttgcgttctttgtgttaaacatgtttgtgggagttgttgtggaaaatttccacaaatgtaggcagcatcaggaggaggaagaggctcgacgccgcgaggaaaaaagactcaggcggctagagaagaaaaggcgctccaaggaaaaacagatggcggaggcacagtgtaaaccgtactattccgactactccagattccggttgctggttcaccatctatgcaccagtcattacctcgacctctttattacgggtgttattggtttaaacgtggtaacgatggccatggagcactatcaacagccccaaattctcgacgaggccctgaagatatgcaactatatttttacggtgatcttcgtgctggagtctgtgtttaaactggtcgccttcgggttccgtaggtttttccaagacagatggaatcagcttgatctggctattgtcctcctgtcaattatggggattaccttagaggagatcgaagtcaacgcttccctccccattaaccccacgattattcgtataatgagggtgctaagaatagcccgagttttgaaactgttaaagatggctgtgggcatgagagcactgctcgacacagttatgcaggccctgccccaggtcggcaacttgggattattgtttatgcttctgtttttcatcttcgcggctctcggagtggaactgttcggcgacttagagtgtgacgaaacacacccttgtgaaggtttgggccggcatgctaccttccgaaactttggaatggcgttcctaaccctgtttagagtgtccacaggcgacaattggaatggtatcatgaaggacacgctgcgcgattgtgatcaggagtccacttgctacaataccgttatatccccgatttattttgtctcttttgtgttgacagcccagttcgttctggtgaatgtcgttatagcagtcctcatgaagcacctggaagagagcaataaggaggcaaaggaagaagctgaactggaggcagaactggagcttgaaatgaagacccttagcccccagccacatagtcccttaggctccccatttctgtggcccggcgtggaaggtcccgatagtccagactcaccaaagcctggcgctctacaccccgccgcccatgcccgatccgccagtcacttctccctggaacaccctaccatgcagccccacccaacagaattgcctggacccgacctcttgacagtcagaaaaagcggagtgtcccgcacgcacagcttgccaaatgattcatacatgtgcagacacggaagcacagctgagggtccactaggtcacagaggttgggggttacccaaagcgcagtcgggctctgtgcttagtgtgcacagccagcccgctgacacgtcatatattctccagctgcccaaagacgcccctcacctcctgcagccacattcagcccccacctggggcaccattcctaagttgcctcctcctggtaggtctcccttagcccaacgccctctgcgtcgccaggcagcaatccgtaccgactccctggacgttcagggtctgggttctcgggaggacctcctggcagaggaagaaccacccagccctagagacctcaagaagtgttactcggtagaagcacagtcctgtcagcggcggcctacgagctggctcgatgagcagcgacgtcacagcattgctgtttcctgtctagattcaggctcccagccccacttaggcacagaccctagtaacctgggaggtcaaccgcttggcggccccggatctaggccaaagaaaaagctctctccgcctagcatcactatcgaccctccagagagccaaggccctaggacaccccccagtcctgggatttgtctgcgtcgccgggcaccttcttccgatagtaaggaccccctcgcctctgggcctccggattccatggccgcttcaccttcccccaagaaggatgtgttgagtctgagcggcctgagtagcgatccagctgacctggatccatag

SEQ ID NO: 24735 - DNA, 6897 bp, Artificial Sequence
  Description of Artificial Sequence: Synthetic coding sequence
atggacgaagaggaagacggggccggagcggaggagtctggccaacctaggtcgtttatgcgcctgaacgatctgtctggagcaggagggagacctggccccggaagcgcggagaaagaccccggatccgcagattctgaagcagagggcctgccttatcctgcgctcgccccagtggtttttttttatctctctcaggactcgcgccctagatcgtggtgcttgcggacagtatgtaacccttggttcgagaggattagcatgttggtgatcctgttgaattgcgtgactctgggtatgtttagaccatgcgaagacattgcctgcgatagccagcgatgtcggattctgcaggcctttgatgacttcatcttcgctttctttgccgttgaaatggtggtcaagatggtggcactgggcatctttggcaaaaagtgctatctgggagatacttggaacaggcttgatttctttatcgtaattgcgggtatgctggaatatagcctcgatttacagaatgtgtccttctctgccgtccggacggtgcgtgtactaagaccgctccgggccattaaccgtgtgccaagcatgcgaattctggtcaccctcctccttgatacccttccaatgctcggcaacgtgctcctcctctgcttctttgtatttttcattttcggcattgtgggagttcagctgtgggcaggcctgctgagaaatcgctgtttccttccggaaaacttcagcctgcctctgagcgtggatttggaacgatattaccagacagagaacgaggatgagtctccgttcatatgctctcagccccgggaaaacggcatgcggagttgccgctccgttcccactctgagaggcgatggaggtggcggcccaccctgtggcctagactatgaggcctacaatagttctagcaatacaacttgtgtgaactggaaccagtactacaccaactgtagcgccggtgaacataacccctttaagggcgctatcaattttgataatatcgggtacgcctggatagcgatctttcaagtcatcacactggagggctgggtcgatataatgtacttcgtaatggatgcccactcattctataattttatatatttcatattgttaattatcgttgggtccttcttcatgataaatctgtgcttggtggtgatagccactcagttttcagagacaaaacagcgagaatctcagctcatgagagaacagagggtaaggtttctcagcaatgcaagcacattggccagtttctcagaacccgggagttgttacgaggaattactgaagtacctggtgtacatcctgaggaaagccgctcgcagactggctcaggtgtcccgcgcggccggcgtgagagtagggttgctgagcagccccgctccactgggcgggcaagagactcaaccaagcagcagctgttctcgcagtcaccggcgattgtcagttcatcatctggttcatcaccaccaccatcatcaccaccactaccatctgggtaatggaacgctccgggcgccacgggcctccccggagattcaggatagagatgcgaacggttctagacggctgatgctccccccaccaagtactcctgcgctgagcggtgcccccccggggggagcggagagcgtgcattctttttaccacgcagactgtcacctcgaaccagtgagatgccaggccccccccccacggtccccctccgaagctagcggacgaaccgtaggctccggaaaagtgtatccgactgtgcatacttccccaccaccggaaacattaaaagagaaggctttagtagaggtcgcagcctcgtcggggccacccaccctgacttcccttaacataccacccggaccctactcttccatgcacaaactgctggagacgcagagtaccggagcctgtcagagctcctgtaagatctccagcccttgtcttaaagcagactctggcgcctgcggcccagacagctgtccgtactgcgcccgggctggcgctggtgaagtcgagttggcagacagggaaatgccagattctgattctgaggccgtctacgagtttacccaggacgctcagcatagcgatctccgagatcctcactcgcggcggcagagatcactggggcctgacgcagaaccatcctccgtcctggcattctggcggctgatttgtgacacctttcggaaaattgtggattctaagtacttcggccgcggaatcatgatcgctattctggtgaacacactgtccatgggaattgagtatcacgagcagcctgaggaactgacaaacgctcttgagatttcaaatatcgtcttcacaagtctatttgccctggaaatgctgctcaaactcttggtgtacggtccctttggttatatcaaaaatccttacaatatctttgatggcgtcattgtcgtgataagcgtgtgggaaattgtggggcagcagggaggcgggctaagcgtgttgcgcacattcaggctaatgcgcgtactcaaactggtaagattcctgcctgcgttacagcgccagctggtggtgttgatgaaaacaatggataacgttgccacattctgcatgctgctgatgctgtttatcttcattttttccatattgggcatgcatctgtttggctgcaaattcgctagcgagcgcgatggagacaccctccctgacagaaagaattttgatagtctgctgtgggccatcgttaccgtgttccagatactgactcaggaggactggaataaggtcttgtacaacggtatggcatcaaccagctcttgggcagcactgtactttattgctctgatgacattcggaaactacgtcctgtttaatctccttgtcgccatattagttgagggcttccaggccgagggggacgcgaataagtctgagtccgagcctgacttcttttccccttctctggatggcgatggtgatcgcaaaaaatgtctcgccctggtgtcactgggtgagcatccagagttgagaaaaagtctgctgccccccctcatcattcatactgcagctacacctatgtccctgccaaaaagtactagcacaggcctcggagaggccttagggccagcatctcgccggacctcttcttctggaagtgcggaacccggtgctgctcatgagatgaagagtcccccttcagccaggtcaagcccccattctccctggtccgccgcatcctcttggacctctaggaggtcatctcggaacagccttggcagggccccaagcctcaaacggcgctcaccttccggtgaaagacgcagtttactgagcggagaaggccaggagtcccaggacgaggaggaatcaagcgaggaggagcgggccagccccgcaggatcagaccacagacaccggggctctctggagcgcgaagccaagtcgtctttcgacttacccgacaccctccaggtccctggactgcatcgaactgccagtggacgaggctctgcatcagaacatcaggattgtaatggcaagagcgcttctggcagattggcccgcgcgctgcgtccggatgatccacccctggatggagatgatgcagatgatgaggggaacctgagcaagggcgaacgcgttcgggcctggattcgggcacgattgcctgcatgttgcctggaacgcgactcctggagcgcgtacatctttccacctcagagtagatttaggcttctatgtcaccggattataactcataagatgtttgatcatgtggtactcgtcatcatcttccttaattgcattactattgcgatggaacggcccaagatagatccccatagtgcagagcgcattttcttaacactctcgaactacatttttaccgcagtgttccttgccgaaatgacagttaaggtggttgctttaggctggtgcttcggcgaacaagcctacctcagatcctcctggaacgttctggacggccttctagttctcatttctgttatcgacattctggtgtccatggtcagcgatagtggtaccaagatcctcggtatgcttagagttctccgcctgttacggacactacggcccctcagggtgatttcacgggcgcaaggtctgaagctggtggttgaaactctaatgtctagtctgaaacccatcggtaatatagtggtgatttgctgtgccttcttcatcattttcggcatactcggcgtccagttgttcaaggggaagttcttcgtgtgccagggtgaagatactcggaatattacgaataagtctgactgtgcagaagcttcctacaggtgggtgaggcacaaatacaacttcgacaatctcggacaagcgctgatgtccctttttgtgctggcctccaaagacggctgggttgatatcatgtacgacggcctggatgcagtcggcgtagaccagcagcctatcatgaatcataatccatggatgctcttgtactttatcagcttcctcttaattgtggccttcttcgtgcttaacatgttcgtgggcgtagtcgtcgagaacttccacaagtgtcgtcagcaccaagaagaggaggaagcgcgaagacgtgaggagaagaggttacgccgactggaaaaaaagaggagatccaaggaaaaacagatggccgaggcccagtgcaagccttactattccgattactcccggttcaggctgcttgtccatcacttgtgtacatcacactacctggatctctttattaccggtgttataggccttaacgtcgtcacaatggcgatggaacactaccaacagcctcagatcctagatgaggccctgaagatctgcaactatatttttacagtcatcttcgtgctggaaagtgtgttcaagctcgtggcgttcgggttcaggcggttcttccaggaccggtggaaccagctggatctcgccattgttctcctaagcatcatggggataacactggaggaaattgaagtcaatgcttccctgcccattaaccctacaattataagaatcatgcgtgtgctgcgaattgccagagtcctgaaattgctgaagatggccgtggggatgcgcgcgctactggacactgtgatgcaggctctgccacaggttggaaatctgggactactatttatgctcctgtttttcattttcgcggcattaggagttgagctgttcggggatcttgagtgcgacgaaacccacccttgcgagggtctgggcagacacgcaacctttcgtaacttcggcatggccttcttgactctgtttagagtttctacaggcgataattggaatgggatcatgaaagacacactccgagattgcgaccaggagagcacttgctacaacactgttatttcgccaatatacttcgtttctttcgtgctcacagcccagtttgtcctagtcaacgtggtgattgcggtgcttatgaagcatttagaggaatcaaacaaagaggccaaggaggaagctgaactggaggccgagctggagctggaaatgaagactctcagccctcagccccattcacctcttgggagccctttcctgtggcctggggttgaggggcctgactccccagactcccctaagcccggggccctgcatcccgctgctcatgcacgcagtgcctctcatttctctcttgagcaccccaccgatagacagctcttcgataccatctcactgctgatccaggggagcttggagtgggagttgaagttgatggatgagctcgctggcccgggtggccagcctagtgccttccccagtgctcccagcctcggaggaagtgatccccagatgcagcctcaccccacggaactaccagggcctgatttactgacagtgcgtaagtctggagtttcccgaactcacagtttacccaacgattcttatatgtgccgacacggaagcactgcggaaggacctctgggacatcgcggctgggggttacctaaagctcaatcaggttccgtgctctccgtgcacagccagcctgctgacacaagttacattttgcaactcccgaaggatgctcctcatctcctacaaccgcactcagcccctacctggggtacaattcctaagctcccccccccaggcagatctcctctggcacagcggccactccgcagacaggcggcaattagaacagacagcctggatgtgcaagggctgggatccagagaagacttactggcggaggtctccggaccatcaccaccattagctcgcgcctattccttttggggtcagagttccacccaggctcaacagcactcgaggtcacattcgaaaatctccaagcatatgacaccaccagcaccttgccccggacctgaacctaattggggcaaagggccgcccgaaactcgatccagtctagaactggatacagaactgagctggatatccggagacttacttcccccaggagggcaggaggaaccccccagcccccgggatctcaagaagtgttacagcgttgaagctcagtcttgccagcggagacctacttcttggttagacgaacaaaggcgacacagcattgcagtgagctgcctggattcaggttcgcagccacacctcgggaccgaccccagcaacctcggcgggcaacctcttggcggaccgggatctaggcccaagaaaaagctgagcccaccaagcatcacaatagatccaccagaatcacagggcccaagaactcccccaagtcccgggatatgtctgaggcgtcgtgccccaagctcagatagcaaggaccccctggcctctgggcccccagactccatggctgcttccccctctcccaaaaaggatgtactgagcctgtctggattgagctcagatcctgcagatctcgacccatag

SEQ ID NO: 24736 - DNA, 6699 bp, Artificial Sequence
  Description of Artificial Sequence: Synthetic coding sequence
atggacgaggaggaagacggtgccggcgccgaggagtctgggcaaccaaggagctttatgaggttgaacgacctgtccggggccggtggtagaccagggcccggcagtgccgaaaaagatccagggtccgccgactccgaagctgaggggcttccatacccagcccttgccccagtagtcttcttctaccttagccaggatagtcgaccaaggtcttggtgcctccggacagtgtgtaatccctggttcgaaaggatctccatgctcgtcatcctactgaactgcgtcaccctcggcatgtttcgcccatgtgaggatattgcctgcgatagtcagaggtgcagaatattgcaagcctttgatgattttatattcgcttttttcgctgtggagatggttgtcaagatggtggctttagggattttcgggaaaaaatgctatctcggtgacacttggaatcggctggatttctttatagttatcgccggcatgctggagtactccttagacttgcaaaacgtcagttttagcgccgtccgaacagttcgtgtgcttcggcccttgagagctatcaatagagtgccaagtatgagaatcctggtgaccttgttgctagatactctcccgatgctcggcaacgtcctcctcctgtgcttctttgttttctttatctttgggattgtaggagtccaactctgggcaggactgctccgcaaccggtgtttcctgccagaaaacttcagcctacccttgtcggtagatctggaacgctattaccagacagaaaatgaagacgaatcaccttttatctgtagccaaccacgggaaaatggcatgcgctcctgtcgttccgtgcccacactacggggtgacgggggaggaggccccccctgcgggctggattacgaggcttacaacagctcaagtaacaccacatgtgtcaactggaaccaatattatacaaactgctctgccggcgaacacaacccttttaaaggagcaattaacttcgataatataggctatgcctggatagccatcttccaagtgataaccttggagggttgggttgacattatgtacttcgtgatggacgcccatagcttctacaattttatttactttatattactcatcatcgttggttcattcttcatgattaatctctgcctagtggtgatagccacgcagttctccgaaaccaaacaacgggaatcacagcttatgcgtgagcagcgagtgcgtttcctgtccaatgccagcaccctggcctccttcagcgagccgggatcatgctacgaggagcttctaaagtacctggtgtacatactcagaaaggccgcgcgtcgcttagctcaagtgtctcgggcagctggagtcagagtgggactgctgagctcaccagccccgctgggaggacaggaaacacagcccagctcttcctgctctagatcgcacaggcggctgagcgtccaccacctggtgcaccatcaccatcaccaccaccaccattaccacctgggcaatgggacgcttcgagccccaagagcatcaccggagattcaagacagggacgcaaatgggtcgcgccgcctgatgctcccaccgccttctacccctgctcttagtggggctccccccgggggggcggaaagtgtccactccttttaccatgccgactgccacctggaacctgtccgttgccaggccccacctcctcgttctccctctgaggccagtgggaggactgtgggcagcgggaaagtatatccaactgttcacacaagcccccctcctgagacactaaaagaaaaagctctggtagaagttgctgcatctagcgggccccccacactgacttcactaaacattcccccagggccatattcatccatgcataaactccttgagacccaatctaccggagcctgccagtcctcctgtaaaattagttccccctgcttaaaggcggattccggcgcctgcggaccagactcatgcccctactgtgctagggctggggccggggaggttgaattggctgatcgggagatgcctgatagtgacagtgaagcagtgtatgagttcacacaggatgcacagcacagtgacttgcgcgacccccactctaggcgccagcgctcactggggccagacgctgagccctcttctgtccttgctttttggcggctaatctgcgacacatttaggaaaattgttgacagcaaatatttcggaaggggcattatgatcgcaatcttagtgaacacattatcaatgggcattgagtatcacgagcagcccgaagagctaacaaatgccttagagatctcaaacattgtttttacttctctattcgcactcgagatgctactaaaacttctagtctacgggccctttggctacatcaagaatccatacaacatcttcgatggcgttattgtcgtaatcagtgtgtgggagatcgtcggccagcagggcgggggactctctgtgttgcgaacctttagactgatgcgagtgttgaagctcgtgcgtttcttgcctgccctgcagcgccagcttgtcgtattgatgaaaactatggataacgttgccactttttgcatgctcttgatgctgttcattttcatcttttctatcctggggatgcacctgtttggatgtaagttcgcttctgagagggacggggacacactgcctgatagaaagaattttgacagcctcctgtgggctattgtgacagtgtttcaaatcttgacacaggaggattggaataaggtactgtataatgggatggcttcaacttcctcctgggcagctctgtattttatcgctctcatgacatttggcaactacgtactattcaaccttctcgttgctatattggtggagggcttccaggctgaagagattagcaaaagagaagatgccagtgggcagctctcgtgtatccagctgccagtggactcacaggggggcgatgcaaataagagtgagtcagagcctgacttcttctcaccctcattggacggggacggggacagaaagaaatgcctcgctctagtgtcactgggggagcaccctgaactgagaaagagcctactccccccactgatcatccacacagccgcaacccctatgtccctgcctaaatcaacttcgacaggcctgggggaggccttaggcccggcttcacgccgcacttcatcgagtggatcagctgaaccaggcgccgcacacgaaatgaagagcccaccatccgcgaggagttcccctcactccccttggtctgctgcaagttcttggacatccaggaggagttcacggaactcacttggcagagcgcctagtctgaagcggcgcagcccctcaggtgagcgaagatccctgttgtcgggcgaaggccaggagtctcaagacgaagaggagagctctgaggaagaacgcgcatcacccgctggctccgatcatagacacagaggatcgctcgagcgtgaggctaagtccagcttcgatctacccgacacgctccaggtgcctggcctgcacaggacggccagtggcagagggtcagcctctgaacaccaggactgcaacggaaagtctgctagtggtcggctggcccgcgccctcaggcccgatgacccccctctggacggcgatgatgcagacgatgaggggaacctctcaaaaggcgaacgtgttagagcatggatccgtgctcggctgcccgcctgctgcttagaacgggattcttggtctgcttatatatttccccctcaaagtcggtttaggctgctgtgtcacagaatcattactcataaaatgtttgaccacgttgttttggtaattattttcctcaattgtattactatcgctatggaacggcccaaaatcgacccccatagcgccgaaaggatctttctcactctttcaaattacatatttacagccgtcttcctggccgaaatgacagttaaggtggtggccttaggatggtgtttcggcgagcaggcctacctcaggagctcctggaacgtgctcgacggactactggtcctgattagcgttattgacattctggtaagcatggttagcgactctggaaccaaaatcctcggcatgctgcgagtgcttcgcttgctcaggacccttcggcccctgcgggtgatttcgcgcgcacagggactcaaactggtagtggaaactctgatgtcatcattgaaaccaataggcaatatcgtcgtgatctgttgcgccttctttatcatcttcggaattcttggtgtccaactcttcaaggggaaattctttgtgtgtcaaggcgaagatacacggaacataacaaacaaatccgattgcgcagaggcaagttaccgctgggtgagacacaaatacaattttgataatcttgggcaggcccttatgagcctgttcgtgctggcttcaaaggatggctgggttgatataatgtacgatggtctggatgctgttggcgtcgatcagcagaacttccacaagtgccgtcaacatcaggaagaagaggaggcaagacggcgtgaggagaagcgcctgcgccggctggaaaagaagcggagaaaagcccagtgtaaaccttattacagcgattacagcaggtttagactgctcgttcatcatctctgtacatcgcattacctggacctgttcataaccggcgtgattggacttaacgtggtgaccatggcaatggagcactaccagcagccgcaaatactggacgaagccttgaagatctgcaattacatattcaccgtaatatttgtcctggagagtgtttttaagctcgtcgcctttggattccgcaggttcttccaggataggtggaaccagctagatctcgcaattgtgctcctgtctatcatgggaatcactctggaagaaatcgaagtgaacgcctctctgccaataaatccgaccattatccgcatcatgagagtactgcgcatagctcgcgtattaaagttgctcaagatggcagtaggcatgcgcgcccttctcgacacggtgatgcaggcacttccgcaggtcggaaatctggggttgctgttcatgctgctgttttttatttttgcagcactgggcgtggaactgttcggagatctggaatgtgacgaaactcatccctgtgagggcctcggcagacacgcgacattccggaattttgggatggctttcttaaccctgtttcgtgtgtccacaggcgataactggaatgggatcatgaaagacactcttagggattgcgatcaggaaagcacatgttataacacggtgatttctcccatatatttcgtttccttcgttctaaccgcccagtttgttttggtgaacgttgtgatcgcagttctaatgaaacacctggaggagagtaataaggaggccaaagaggaagccgagctggaggcagaacttgaattggagatgaagactttgtcaccccagccacattcacctctgggatctccatttctgtggcccggtgtggaagggccagacagcccagacagtcctaaacccggggcattacaccccgctgcccatgcccggtctgcctcccattttagtttggaacacccaacaatgcaacctcaccctacagaacttccaggtcccgacctgctcaccgtgcgtaaatctggcgtctcacggacacactcgcttccaaacgattcatatatgtgtagacacggatccacagccgaagggccactggggcatcgcgggtggggcctgcccaaggcccagagtgggtcagtactttctgttcacagtcagcccgccgacactagctatattctgcagctgccaaaggacgcacctcaccttctgcagccccatagtgctcctacctggggcacaattccaaagctccctcctcccgggaggtctcctctggcccaaagacccctgcgccgacaggccgcaattcggacggatagcttagatgtccaagggctcggctcccgggaggatctcctcgctgaagtctccggtccttctccccctctggcccgggcatattccttttggggccagagctctacccaagcccaacaacattcgaggtcacatagcaagattagcaagcatatgacgccccctgctccatgcccaggccccgaacccaactggggcaagggcccccccgaaacacgtagctctctggaactggataccgaactgagttggatctcaggcgacctgctaccccccggcggtcaggaggagccaccttccccccgggatctcaagaaatgttattcggtggaagcccaaagctgccagcgccgtcccacgtcatggttggatgaacagagacgccactcaatcgctgtttcttgcctggatagcggtagccagccccatctgggtaccgaccctagcaacttgggcgggcaaccactgggcgggcctggcagcaggcccaagaagaagctgtcacccccgtcaattactatagatcccccagaaagccaagggccccgcaccccacccagtcccggcatatgcctaagacggcgcgcaccatcgtcggattctaaggaccccctggcaagtggccctccagattcaatggcagcatccccctcccctaagaaagatgtgctgtcattatccggcctctcttctgatcctgccgatctggacccctag

SEQ ID NO: 24737 - DNA, 5277 bp, Artificial Sequence
  Description of Artificial Sequence: Synthetic coding sequence
atggatgaggaggaagacggggctggcgcggaggagtcagggcaacctcgatccttcatgcgattaaacgacctgtcaggggcaggaggacgacccgggcccggaagcgctgaaaaggatccaggatctgctgactcagaggcagagggactcccttatcctgcactggcacctgttgtcttcttctatctttctcaggattctcgcccaaggtcttggtgtctccgaacggtctgcaacccctggttcgagagaatatcaatgctggttatccttctgaactgcgtgacattgggaatgtttcgaccatgcgaggacattgcctgcgacagtcaaaggtgtcgcattctgcaggctttcgacgactttatctttgccttctttgccgtggagatggtggttaagatggttgctctggggatcttcggaaagaagtgctacctaggcgacacatggaaccgcctcgactttttcattgtgattgctgggatgctggaatactcactagatcttcagaatgtgagcttctcggccgtgaggacagtgagggtactgagaccactgagagcaatcaatagagtaccttctatgcgcatccttgtgacccttctactcgacactctaccaatgctggggaatgtgctcctactctgcttctttgtgttttttattttcggaatcgtcggagttcagctctgggctggtctgctgcgtaatcgatgctttctccctgaaaacttttccctgcccttgagcgttgacctggaaaggtattaccagaccgagaacgaggatgaaagtccgtttatttgtagccaacctcgggagaatggaatgagatcatgcaggtccgtgcccacactgagaggcgacggcggtggaggtcctccttgtggcctcgattatgaggcttacaacagctccagcaatactacctgcgtcaattggaaccaatactacacaaattgttccgcgggtgagcataatccttttaagggagctatcaactttgacaatattgggtacgcctggatcgctatttttcaggtgatcactctcgagggctgggtggacataatgtactttgtcatggatgcacacagcttctacaatttcatctacttcattctactcatcatcgtaggcagcttttttatgatcaatctttgtctcgtcgtgattgccactcagttcagcgaaactaaacaaagggaaagtcagcttatgcgcgaacagcgcgtccggttcctgtcaaacgcaagcactctggccagttttagcgagcctggcagctgctacgaggagctgctaaaatatttggtgtatatacttcggaaagcggcccggcgcttggcccaagtgtctagagctgctggagtgcgcgtgggactgttgagctcgcccgcacccctaggcggacaggagactcagcctagcagctcatgctctcgcagtcatagacggctttctgtccaccatttggtgcaccaccaccaccaccaccatcaccattaccacttgggcaatggtactctaagggcacctagggcctcacctgaaattcaagatcgcgacgctaatgggtcacggagactgatgcttccgcctccatccacgcccgcgttgtccggtgcgccgccgggaggtgcagagtccgtccattctttctaccacgccgattgtcatctcgaacccgtgcggtgtcaggccccacctccacggagcccatccgaagccagtggccggaccgtgggctccggaaaagtataccccacagtgcacacatcccctcctccagagacactcaaagagaaggctctcgttgaagtggcagccagttccggacctcccaccctgacatctctcaacatccctcctggcccgtactctagcatgcataaactcttggagacccagtccactggcgcctgccagtcctcctgcaagataagctcaccctgtctgaaagcagatagtggagcttgcggacccgatagctgcccatactgtgcccgcgcgggtgccggagaggtggaactggcagatcgcgaaatgccggacagcgacagcgaagccgtgtacgagttcacccaagacgcacagcatagcgatctgcgtgatccacattccaggcggcagaggtccctcggccccgatgccgaaccctcttccgtgttggctttctggcgtctgatctgcgacaccttccgcaaaatagtagactcaaagtactttggccgagggataatgatcgccatacttgttaataccctcagcatgggtattgagtatcacgagcagcctgaggaacttaccaatgcactggaaatttcaaatattgtgtttacttccctgtttgccttggagatgctgcttaagctgttggtctatggtccttttggttacataaagaatccatataatatctttgacggggtgatcgttgtgataagtgtctgggaaattgtggggcaacaagggggcgggctaagcgtgctgcgcacattccgcctgatgagggttctgaaactcgttcgtttcctcccagctcttcagaggcaactcgtcgtactgatgaagaccatggacaacgttgcaaccttctgcatgctgctgatgttgttcatctttatcttttcaattttaggcatgcatctgtttggctgcaaatttgcctctgagagggacggcgatactctcccggaccggaaaaacttcgatagtctcctgtgggccatcgtaacggtgtttcaaatcctaacacaggaagactggaacaaagtgctatacaacggcatggccagcacatccagctgggcagccctgtactttattgcattaatgacctttggaaattacgtgctcttcaacctcttagtggccattttggtcgaggggttccaagcggaggaaatttccaagagagaagatgcctctgggcagctgagttgcattcagctgcccgtcgatagtcaggggggcgacgccaataaaagtgagtctgagcccgatttctttagcccgagcctggacggagatggcgaccggaagaagtgtctggctctagtgtccctgggtgagcatccagagcttcggaaatctctcctgccaccactgataattcatactgctgccactccgatgtcactccccaagtccacatctaccgggttaggagaagcgttgggacctgccagtagaagaacctcaagctccggatctgcggagccgggcgctgcccatgaaatgaaatccccaccctctgctagatctagcccacatagtccttggtctgctgcctcttcttggacaagtcgccgttcctccaggaacagcctgggccgcgccccaagcttgaagcggcggtcgcccagcggagagaggaggagtctgctctcgggcgagggacaggaatctcaggacgaagaggagtcatccgaagaagagagagcctcaccggccggctctgatcatcgtcatcgcgggagcttagagcgggaggcgaaaagctccttcgacctgccagatacgctgcaagtccctgggctacaccggactgcttcaggccggggctcggcatccgagcaccaagattgtaacggaaagagcgccagcggtcgtctggctagagccctcagacctgatgaccctccacttgatggggatgacgccgatgacgaaggtaatctgtccaaaggggagcgtgtccgcgcatggatccgagcccgcttgcccgcctgctgcctggaacgggatagctggtccgcttacatcttccctcctcaatctcgcttcagactgctgtgtcatagaattatcactcacaaaatgtttgatcacgtggttctcgttataatctttctcaattgcattactatcgccatggagcgtcccaagattgaccctcacagcgctgagaggatctttctcacactatctaactatattttcaccgccgtgttcctcgctgaaatgactgtcaaagtggtcgccctgggctggtgtttcggggaacaggcatatctccgctcttcttggaacgtactagacggactgcttgtgttgatctcggtgatagatatcctagtcagcatggtctctgactctggaaccaaaattctggggatgcttcgtgtgctgcggttgctccgtaccctgcggccccttagggtcattagtcgcgcccagggccttaagcttgtggttgagacactgatgtcctcactcaaacctatcggtaacattgtggtgatctgttgtgcctttttcataattttcggcatactgggtgtccaactgttcaagggaaagttttttgtctgccagggcgaagatacccggaatattaccaacaaatccgattgcgccgaagccagttatcgctgggtgaggcacaaatacaattttgataatttgggccaggctctgatgtctctgtttgtgctggcatccaaagacggatgggtcgacatcatgtacgacggattggatgcagtgggagtagaccagcaaccaatcatgaaccacaacccatggatgctgctctatttcatctcttttctgttgattgtcgcctttttcgtgctgaatatgtttgtcggcgtggtggtggagaactttcataaatgccgccaacaccaggaggaggaagaagctcgaagaagagaagaaaagcgcttaagaaggttggagaagaagagacgcaaggctcagtgtaaaccttactacagtgactactcgcgcttccgtctgctggtgcaccatctctgcacgtctcactatttggacctgtttatcactggagtcatcggactgaacgtggtaactatggctatggagcattatcagcagccccagattcttgacgaggctcttaagatatgtaattatattttcaccgttatatttgtgctcgagtccgtcttcaaactggtcgcattcggattcaggcgatttttccaagacagatggaaccagctcgacctcgctatcgtccttctctctataatggggattaccttagaggagatcgaggtgaatgcctcccttcccatcaatcccacaatcattcggatcatgcgcgttctgaggatcgccagagtgcttaaattactgaaaatggccgtgggaatgcgggccctgctggacacggttatgcaggcgctgccccagctctgggcctggagttctttggaaacttggtcagtgacacgccatacccccgtccgggcatgggcggtgatgcccccttttgggactctagcttggccctcatag

SEQ ID NO: 24738 - DNA, 5241 bp, Artificial Sequence
  Description of Artificial Sequence: Synthetic coding sequence
atggatgaggaagaggacggcgccggcgccgaggagagcggccagccgagatcatttatgcgactgaacgacctgagcggggccggggggaggcctggaccagggtccgccgagaaagaccccggctctgccgatagcgaggctgagggtttaccctaccctgcattggcaccggtcgtttttttctacctgtcccaagattcaagaccgcgcagctggtgcctgaggaccgtgtgcaacccgtggtttgaaaggattagcatgctagtaattctgcttaattgtgtcaccctggggatgttccgcccgtgtgaagacattgcgtgcgatagtcagcgctgtagaattcttcaggcgtttgatgatttcattttcgccttcttcgccgttgagatggtggtcaagatggtggccctgggaatctttggtaagaaatgctatctgggcgacacctggaataggctggatttttttatagtcatcgccggcatgctcgagtattccctggatctccaaaacgtgtcgttttctgcggtaagaactgttcgtgtgctgcgtccccttagagcgatcaaccgggttcctagcatgcggatcctggtcactctgctgctggatacactccctatgctcgggaatgtcctcctgctgtgtttctttgtcttctttatcttcgggatcgtcggagtccagttatgggccgggttgctgcgtaacaggtgctttctgccagagaacttcagcctaccactgtcagtggacctggagcgttactatcagacagagaatgaggatgaatccccattcatttgttcacagccccgcgagaacgggatgagatcctgcagatcagttccgacactacggggggacggtggggggggacctccttgtggattggactatgaggcttataactcttcttccaataccacgtgtgtgaattggaaccagtattacacaaactgtagtgccggtgagcacaacccttttaaaggggccatcaactttgataatatcgggtacgcctggattgctatattccaggtgataacgttggaagggtgggtggacattatgtacttcgtcatggatgcgcacagcttctacaactttatttacttcatcttgctcattattgtcgggtcattcttcatgatcaacttgtgcctcgtcgtgatcgccactcagttctcagagaccaagcagagagagtcccagctcatgcgggaacagagggtcagattcctcagcaatgcaagtacgctagctagtttctccgagccagggtcttgttacgaggagcttctgaaatatctcgtctatattttacgcaaggcggcacggcgcctcgcccaggtcagtcgcgccgctggtgttcgagttggactcctgtcgagccctgcacccctcggaggtcaggagacccaaccatccagctcctgcagccgctcacatagacgtctgagtgtgcatcatctggtccaccatcatcatcaccaccatcaccattaccatttgggtaacggaacgttgcgggccccaagagcaagtccggaaattcaggatcgcgatgcgaacggcagccgcagacttatgcttccacctccttccaccccagcattgagcggggcgccaccaggcggcgccgaatccgtccactccttttatcatgcagactgtcatcttgagcctgtcaggtgccaggcgccgcccccccgcagcccatccgaggcctctggcagaacagtgggaagcggcaaggtgtatcccacagtgcatacctcacctcctccagaaactcttaaggaaaaagcactcgtggaggtggctgcatcatccggaccgcccacactcacaagcctaaacatccctccaggcccctattccagcatgcataaactccttgagacacagtcgactggcgcgtgccaatcttcttgtaaaatttcaagcccctgtctcaaagccgactcaggagcctgcggcccagatagctgtccctactgtgcccgggcgggcgccggtgaggtcgaattagctgacagggaaatgccagactccgattctgaggccgtgtacgaatttacccaggacgcacagcacagcgatctcagagacccgcactcacgcagacaacgatctctggggccagacgccgagccatcctctgtgcttgctttctggaggctgatttgtgatactttcaggaagatcgtggattccaaatacttcggcaggggcattatgattgcaatattagtcaacaccctctcaatgggaattgagtatcacgaacagcccgaggagctgaccaatgcactggagatttccaatattgttttcactagccttttcgccctggagatgttgttgaagctccttgtgtacggtccatttggatacattaagaatccctacaacatctttgacggcgtgattgtagtgatcagtgtctgggagatagtgggccagcagggaggtggtttgtctgtcctgagaaccttccggctgatgcgcgtgttaaagttagtgagattcttgccagctctccagcggcagctcgttgtgctgatgaagaccatggacaatgtggctaccttttgcatgctcctgatgttgtttatcttcatcttttctatcttgggaatgcatctgtttgggtgtaagtttgccagtgagcgcgacggcgacacactccctgaccggaaaaacttcgactcccttctctgggccatagtcacagttttccagatcctgacacaggaggactggaataaggtgctgtataatggcatggcctccacgtcctcgtgggcagccctctattttatcgctctgatgacatttgggaactacgtcctctttaatctcctagttgccatcctagtggagggatttcaggccgagggagatgcaaacaaatcggagagtgagccagactttttcagccccagtttggacggggatggcgacagaaaaaagtgcttggctctggtgagcctaggagaacacccggaactcaggaagagcctgctgcctccgctaatcattcataccgctgccacaccaatgtctctgcctaagagtacttctaccggactcggagaggctctcggcccagcctcgcgccgtacctcctctagcgggtctgccgaacccggggccgcacacgaaatgaaaagtcctcccagtgcaagatcatctcctcatagcccctggtccgctgcctcatcctggacctcaagaagaagttcccgcaattcattgggcagagctccttcgctgaagcggcgctctccctccggcgagaggagatctctgctcagtggcgagggccaggagtcacaagatgaggaggagagcagcgaggaggaacgcgcttcacctgcaggcagcgaccataggcatcgcggctctttggaaagagaagcgaaatcaagcttcgatctaccagacacgctgcaggtgcccggtctccaccgcactgccagtggtcgaggtagtgcctcagagcatcaggattgcaacgggaaatcagcctctggcagactggctcgcgcacttagaccagacgacccccccttggacggggacgatgccgacgacgaagggaatcttagtaaaggtgagcgagttagggcttggatccgcgcccgccttcctgcctgttgtctggaacgggactcatggtctgcctacatctttcctcctcagtctcggtttcgccttctctgccaccgaatcattactcataaaatgtttgatcatgtagtgctggtaatcatctttctcaattgcattaccatcgctatggagaggccgaagattgatcctcatagtgctgagcggatctttctcacgctctccaattatatatttacggccgtgtttcttgcggaaatgacggttaaagttgtcgctctcggttggtgctttggtgaacaagcgtacctgcggagctcttggaacgtgttggacggattactagtgttgatctcggtcattgacatactggtgagcatggtgagcgactctggtactaagattctgggaatgttgcgggtgttgcgcttacttcggaccttgcggcccctgcgggtgatatctcgagctcagggcctgaagctggttgttgaaacattgatgtcatctctgaaaccaatcggaaacatagtcgtcatttgctgcgcgttttttatcatctttggaatcttgggtgtacagctcttcaagggcaagtttttcgtgtgtcagggggaggacaccaggaatatcacaaataaatcagattgcgcagaagcgagctatcgatgggtcaggcacaaatataacttcgacaacctcggtcaggcattgatgtcgctgtttgttctggcttccaaagacggctgggtggatatcatgtacgacggactggacgcagttggtgtggatcagcagccgatcatgaatcataacccgtggatgttgctgtactttatttccttcctgctaatcgtggcattctttgtcctgaatatgttcgtgggggtggtcgttgagaacttccataagtgcaggcagcaccaggaagaagaggaggcccggaggcgcgaggaaaagcgactgaggaggcttgagaagaagcgtagaaacttgatgctggatgacgtgatagcatcaggctcctccgccagcgcagcaagcgaagcccaatgtaagccatactatagcgattattcacggttcaggctcctggttcatcacctgtgtacctcccattatctcgatcttttcattacaggagttatcggcctaaatgttgttactatggccatggagcattatcaacagcctcaaatactggatgaagccctgaaaatatgcaactacattttcactgtgatcttcgtcctggagtcggtttttaagcttgtggcctttggtttcagacggttcttccaggatcggtggaaccagctggacctcgccatcgtgctgttatccattatgggtattacactggaagagattgaagtaaacgcaagtctgccgattaacccaaccatcatcaggattatgagagtgcttagaattgctagggtcctcaagctgctaaagatggcggtggggatgagggcgcttctcgatacactgtgggcttggtcctcgctggagacttggagtgtgacccgccacactcctgtgcgagcgtgggctgtcatgcctccattcggtacattagcttggccttcgtag

SEQ ID NO: 24739 - DNA, 6822 bp, Artificial Sequence
  Description of Artificial Sequence: Synthetic coding sequence
atggatgaggaggaggacggggcgggcgctgaggaatcaggacagcctcgcagttttatgcgactcaacgatttgtccggagccggcggacgtcctggtcctgggtctgctgagaaagaccccgggtccgccgactctgaggctgaaggacttccgtacccagctctagcgcccgtggtcttcttttacttgagtcaggacagtcgtcccagatcctggtgtctgagaactgtgtgcaacccctggttcgagaggatctcaatgttagtaattctgctcaattgcgtaactctgggtatgttcagaccttgtgaggacatagcatgtgacagccagagatgccgcatcctgcaggcctttgatgacttcatcttcgcgttttttgccgtggagatggtagtgaagatggtggcactgggaatttttggcaagaagtgttatctgggcgacacttggaacaggctggatttctttatagtaattgcgggcatgctcgagtatagtctggacctgcagaatgtatcattctccgctgtgaggacagtgcgggtgttgaggcccctgagagccatcaacagggtccctagcatgagaatcctggtaacattgctgttggacactctgccaatgttaggcaacgtgctgctcctttgctttttcgtgtttttcattttcgggatcgtgggcgtgcagctgtgggccggactgctgagaaaccgctgcttcctcccggaaaacttttcgctgcccctcagtgtcgacctcgagagatactaccagactgagaacgaggacgagagcccattcatttgttcgcaacccagagagaacgggatgcggagctgcagaagtgtgccaacccttagaggcgatgggggagggggccctccatgcggactcgactacgaagcctacaactcctcttctaacaccacttgtgttaattggaaccagtattatactaactgtagcgccggggaacacaaccccttcaaaggggctatcaattttgacaatattggttatgcctggattgccatattccaggtgataacattggagggatgggtggatatcatgtatttcgttatggatgcacacagtttctacaatttcatctacttcattctgctcatcatcgttggctcattcttcatgatcaatctttgtttagtggtgatcgccacacaattttccgaaaccaagcagcgcgaatctcagttgatgcgggagcagcgggttagattcctcagcaacgcctctaccctggcgtcgttctcggagcctggatcatgctatgaggagctcctcaagtatctggtttatattttaagaaaggccgctagacgcctggcgcaggtaagtcgtgcggcgggcgtccgtgtagggctcctctcatcacccgctcctctaggaggccaggagacgcaacccagttcttcatgctctcgcagccatcgcagactatctgtgcatcacctagtgcatcatcaccatcatcatcaccaccattatcacctggggaacgggactctgcgagctccccgagcgtcccctgagattcaagatagagacgctaatgggtcaaggcgcctcatgctgccgcccccatccacgcccgctctcagcggcgcgccacctggtggagctgaaagtgtgcacagcttctaccatgccgactgccacttggaacctgtgcgctgtcaggccccccccccacggtccccgtctgaagccagtggccgcaccgtcggctccggaaaggtgtacccaacagtgcatacctccccacctcctgagacactgaaggagaaggctctcgtagaggtggcagcctccagtggcccaccaacactcacatctctgaacattccaccagggccttacagcagcatgcacaaactgttggagacgcaatctactggagcatgccagtcatcttgcaaaatctctagcccatgtctgaaggcagatagtggggcttgcggaccagattcctgcccttactgcgctagagccggtgcgggggaggtggaactggctgacagggaaatgcctgattctgacagcgaagctgtctatgaatttacccaggatgcgcaacacagtgatctacgggacccacacagccggagacagcgctcattaggcccagacgctgagccttcctccgtcctggcattctggcgactaatctgcgatacatttcgaaaaatcgtggactcaaaatacttcggtagaggaatcatgatagccatcctggtaaacacactgtcaatggggatcgagtatcatgaacaacctgaagaattaaccaacgctctagagatatcaaacatcgtgttcacgtcactgtttgctttggagatgttgttaaagctactggtttatgggccctttggctatatcaaaaacccttacaatatctttgatggtgtgattgtggttatcagtgtgtgggagatcgttggacagcagggggggggcctctccgttctaagaacattccggttaatgcgcgtattaaaactcgtccgcttcttgcctgcattacagcgccagctcgtggtcctgatgaaaaccatggacaatgtggccacattctgcatgctgctgatgctctttattttcatcttcagcattctcggcatgcatctgttcgggtgtaagtttgctagtgagcgagacggagataccctgccagatagaaagaacttcgactcgctgctctgggcaatcgtcacagtgttccagatacttacacaggaggactggaacaaagttctgtataatggaatggccagtacgagctcatgggcggccctttacttcatcgctttgatgacctttggcaactacgtgctattcaatctcctagtagctatcctcgtggaaggttttcaagcggaagaaattagcaagcgcgaagacgcctccggacagctgagttgcattcagttgccagtggactctcagggaggggatgccaacaagagcgaatctgagcctgacttcttctccccctccctggatggtgacggcgaccgcaaaaaatgcctggccctcgtgtctctgggtgagcaccccgagctcaggaagtcactgctccccccattgatcatacataccgcagccacccccatgtctctgcctaaatcaacatctactggcctaggcgaggcacttggcccagcctctaggaggaccagctcatccggctcggctgagcctggcgccgctcacgaaatgaagtctccccccagcgccaggtcgagtccccatagtccttggtcagcagcctcctcctggacgtcccgcagatcttccaggaactcattaggtcgcgcgccctctttgaaacggaggagcccttcaggcgaacggaggtcactcctgagcggggaggggcaggagtctcaagacgaggaggagagcagcgaagaagagcgggcctcgcccgccgggtccgatcatcgccaccggggaagcctggagcgggaggccaagtcttccttcgatctccctgacacgctgcaggtgccaggcctccatagaaccgcctctggcagaggtagtgctagtgaacatcaagattgcaatgggaaaagcgcttcaggccgtcttgctcgggccttgcgccctgacgatccaccactagacggggatgatgcagacgacgaaggcaacctatccaagggcgaacgtgtgcgcgcctggatcagggcgaggctgccagcttgctgccttgagagggatagttggagcgcctatatatttccgccacagagccggtttaggctgttatgccatcgcatcattactcacaagatgttcgatcacgtggtgctggtcatcattttccttaattgtatcacaattgccatggagcgacctaaaatcgaccctcatagcgctgagcggatcttcctaaccttgtcgaattatatattcactgcagtgtttttagccgagatgacagtgaaagtcgtggccctggggtggtgctttggcgagcaagcctacctgaggtcttcctggaacgtgttggacggtcttctggtactcatctcagtcattgacattcttgtgtcgatggtgtccgatagtggaacaaagatcctgggcatgctgagggtgttgcgcctcttacggaccctgcgcccactgagagtgatcagccgagcccaggggctcaagctggtggtggaaacccttatgtcctcgttgaagcccatcgggaatattgtagtcatttgctgtgctttcttcattatcttcggcattctgggcgtgcagctgttcaagggtaaattctttgtgtgtcagggcgaggacactcgtaacatcacgaacaaaagtgactgcgcagaagccagttaccgctgggtgcgccacaaatacaacttcgataaccttggtcaggctctgatgagcctgttcgttctggcatctaaggacggatgggtggacattatgtacgatggactcgatgccgtcggggtggatcaacagccaattatgaatcacaacccttggatgctactctacttcattagttttcttctaatcgtcgctttctttgtgctcaacatgtttgttggagtggtcgtagagaactttcataaatgcagacagcaccaggaagaggaggaagcacgccgccgagaggagaagaggctcaggcgtctggaaaaaaagagacgctcaaaggagaaacagatggccgaagcccaatgcaagccctactactccgactatagtcgtttccgcctgctggtccatcacctgtgtacctcacactacttggaccttttcatcaccggcgtcattgggctgaatgtggtcaccatggctatggaacactaccagcagcctcagattctagacgaggccctgaagatatgtaactacatcttcaccgtgatattcgtgctcgagagcgtctttaaactggtggcctttggatttcgccgctttttccaggatagatggaaccagctggatctcgcaattgtattgctttcaatcatgggaatcacccttgaggagatcgaagtgaatgcgtcactccctatcaatcccaccatcatacgcataatgagggtgctgaggatcgctagagtgctgaaactcctgaaaatggcagtcggaatgcgggcgctgcttgacaccgtaatgcaagccctccctcaggttggaaaccttggccttctgtttatgctgctgtttttcatctttgctgcattaggtgtcgagctatttggggacctcgagtgtgacgagacccatccctgcgagggactgggccgacacgctacatttcgcaatttcgggatggctttccttacattattcagagtgtcgacaggagataactggaacggaattatgaaagatacattgagagattgcgatcaagaatccacatgctacaacacagtcatcagccctatttacttcgttagttttgtgctgaccgcgcagtttgtgctcgtgaatgtggtcatcgccgtgctgatgaagcacctggaagaatctaataaagaagcaaaggaggaagccgaactggaggccgagttggaactggagatgaaaacactctctccccaacctcattcccctcttggctccccatttctctggcctggtgtggaggggcccgactccccggatagtccaaaaccgggtgccctgcatcccgcagcccatgccaggtcagctagccatttctcgcttgagcatcctaccatgcaaccccatcctacagaactcccagggcctgacctgctgactgtcaggaaatctggcgtgtcacggacacactctctccctaatgattcgtatatgtgccgccacggatctactgccgagggcccgctgggacaccgagggtggggcctccctaaagcgcagtccggcagcgtactctctgtccatagccagcctgctgatacttcatatatcctgcaactgcccaaggacgcccctcacctactgcagccgcatagtgctccgacttggggaacgatcccaaagttaccccccccaggacgatcaccacttgctcaacgtccactgagacgccaggccgccattcgaactgacagtttagatgtgcaaggcctggggtctagagaggacctattggctgaagtgtcaggtcccagccctcccctcgccagggcctattcgttttggggccagtcttccacccaggctcaacaacactccaggagccatagtaaaatttctaaacacatgacgccaccggcgccttgtccgggcccagaacctaattggggcaaggggccaccggaaacgaggtcctctttggagctggataccgaactgagctggatcagtggtgacctgcttccgcccgggggccaggaggagcccccttccccgcgggatctcaaaaaatgttattccgttgaggctcagagctgccaaaggagacccacctcctggctggatgagcagaggcggcactcaattgccgtcagttgcttagacagtgggtcccagcctcatctcgggacggatcctagcaatctgggcggccagcccctaggtggaccgggatctcggcctaaaaaaaagctatcgcctcctagcattacgatcgaccccccagagtcacagggccccaggactccaccatcccccggaatttgcctaagaagaagggcaccgagcagcgactccaaagatcccctggcatccggaccacccgatagcatggctgcgtctccaagccccaagaaagatgttctctcactgtccggcctgagcagtgaccccgcggacttggatccctag

SEQ ID NO: 24740 - DNA, 6864 bp, Artificial Sequence
  Description of Artificial Sequence: Synthetic coding sequence
atggatgaagaagaagacggcgcaggcgcggaggagtcagggcagccacgctctttcatgagactcaacgacttgtcaggagccggcgggcgacctggccctggatcagcagagaaagaccccggaagcgccgactccgaggcggagggtctcccctaccccgccctcgccccggtggtgttcttttacctctcccaggacagccgcccccgttcctggtgcctgcgcacagtttgcaatccttggttcgaacgcatctccatgctggtgattctgcttaactgtgtcactttaggcatgtttcgcccttgtgaagatatcgcatgtgactcccaaagatgtagaatactgcaggcctttgatgattttatcttcgcattcttcgctgttgagatggtcgttaaaatggtggccctcgggatctttggtaagaagtgttaccttggtgacacttggaaccggctggacttcttcatcgttatcgcaggtatgttagagtactctcttgacctacagaatgtgtccttcagcgccgttcgtaccgtgagagtgcttaggcctctccgcgccatcaatagagttccgagcatgcggatcctggtaaccctactgctggatactctcccaatgctgggcaacgtactgcttctgtgttttttcgtctttttcatcttcggcatcgttggagtgcagttgtgggccggtctgcttcgtaacaggtgttttctgcccgagaatttctctctaccactcagtgttgacctggagcggtactatcagacggagaacgaggacgagtctcctttcatctgcagtcagccccgagaaaatggaatgcgctcatgcagatcagtacctactttaagaggggacggcggcgggggacctccttgtgggctcgactacgaggcgtataactcctcgtcaaacacgacctgcgtgaattggaatcaatactataccaactgttctgctggtgaacacaaccctttcaagggagctataaatttcgacaatattgggtacgcctggattgctatcttccaggtgataactttggaaggatgggtggatatcatgtattttgtgatggacgcacattcattctataattttatttactttattcttctcatcatcgtggggtcttttttcatgatcaatctgtgcttagttgtcattgcaacccagtttagcgagaccaaacagagagaatcccaacttatgcgcgagcagagggtgaggtttttaagtaatgcgagtactctcgccagtttttcggagcctgggtcctgctacgaagagctgcttaaatatctggtgtacatactgcgcaaagcagctaggcggctggctcaggtgtcaagggcagcaggcgtgcgggtcgggctcctgtctagccctgccccactcgggggtcaggaaactcagccttcatcctcatgtagccggtcgcatcggcgactgtccgtgcaccaccttgtacaccaccaccatcaccaccaccatcactatcacttaggcaacggaaccctccgggctcctagagcctctcctgagatacaggatagagacgccaacggatcccgtagactgatgctgccgccacccagcacccccgctctgtctggtgctccacccggcggtgctgaatcagttcattctttctaccatgccgactgccacctggagcccgttcgctgccaagcaccgccccccaggagcccttccgaagcgagcggaagaaccgtgggtagtggtaaggtctaccctactgttcacacatctcccccacctgagactttgaaagaaaaagccctggtagaagttgcggcaagctccggccccccaactctgaccagcctcaacatccctcctggcccctacagtagcatgcataagttgcttgagactcagtctacaggggcttgtcaaagtagttgcaaaatctcttcgccatgtctgaaagcagactccggagcttgtggccccgattcctgtccctattgcgcacgggccggcgctggagaagtagagctcgccgaccgcgagatgcccgactccgattctgaagccgtgtatgagttcacacaggatgcccaacatagcgatttaagagaccctcacagtcggcgacagcggtccctgggaccggatgcagaaccatccagtgtactggctttctggcgcctcatctgcgacactttccgaaaaattgtggattcaaaatactttggaagaggaatcatgattgccatcctggtaaacacgctctcaatgggtatcgaatatcatgagcaaccggaggagctaacgaacgctctggagatatctaacatcgtctttactagcctctttgctctggagatgcttctcaagctgctcgtgtacggccctttcggatatattaaaaacccctacaacatctttgacggggtgatcgtcgtcattagcgtatgggagatcgttgggcagcagggcggaggcctgagcgtgctccgtactttcaggttgatgcgcgtgttaaagctggtgaggtttctcccagctttacagcgacaactggttgtgctgatgaagacaatggacaacgtggccactttttgcatgttgcttatgctgttcattttcatattttccattctggggatgcacctattcggctgtaaattcgcctcagaacgagacggggacacactgcctgacagaaagaattttgatagtctcctgtgggccatagtgaccgtgttccaaatattgacgcaagaagactggaataaggtgctctacaatggcatggcttcaacctcaagttgggcggccctttattttattgccctgatgacatttggcaactacgtacttttcaatctgctcgtagcaatcctcgttgagggctttcaggcagaagaaattagcaaaagagaagatgccagcggccagttgtcctgtattcagttaccagtggattcccagggcggagacgctaataaatcagagtcagagccagattttttcagtccaagccttgatggggacggggataggaaaaaatgcctggccctggtgagcctgggggagcaccccgaactacgcaagagcctgctgcccccacttatcattcacacagctgccaccccaatgtctctccctaaaagtaccagcacaggattaggagaggcactcggaccagcctcacgtcgaaccagctcctctggctccgcagagccaggggccgcgcatgaaatgaagagcccgccctccgcacggtcttcgccgcacagtccctggtctgctgctagcagctggacctcccgcagaagtagcagaaactctctgggcagggcacccagtctgaaacggcgatccccttccggtgagcgccgttcgcttctgtccggcgaagggcaggagtcacaagacgaggaggagtcctccgaggaagagagggcttcccctgccggaagtgatcacaggcatcgaggcagtcttgagcgtgaggctaaatcttcctttgatcttcctgacacactgcaggtacccggtttacacaggaccgcctctggaaggggaagcgcttcagagcatcaggattgcaacggcaagagcgcttcaggtaggctggcgcgcgccctgcgtcctgacgatcctcccctggatggtgacgacgccgacgacgaaggcaacctctctaagggggagcgcgtgagggcatggatcagagcacgccttccagcatgctgcctcgagcgcgattcctggtccgcatacatattccctccgcaaagtaggttccgacttctttgccatcggataataacacataagatgttcgatcatgtggtgctggtgattatcttccttaactgtattacaattgccatggaaaggcccaagatcgatccgcattccgcagaaaggatcttcctgacactctccaattatatcttcaccgctgtttttctcgcggagatgacagtgaaggtagtggccttggggtggtgcttcggcgagcaggcctatttgagatcttcatggaacgtcctggatgggctgttggttctaatctcagtaatcgacatactggttagcatggtgtcggactctggcactaaaatcctgggcatgctcagggtgctgcgcctcctccgcacgctgcgtcccctgagggttattagcagggcccaggggctaaaattagtggtcgaaacactcatgagcagcctgaaacctatcggtaacatagtggtgatctgttgcgccttttttatcattttcgggatactgggcgtgcagttgtttaaaggaaagttttttgtatgccagggcgaagacactcggaatataaccaataagagcgactgcgcggaggcctcatataggtgggttagacacaaatacaactttgataacctcggacaggcgttaatgtctcttttcgtgttggcgagtaaagatggctgggtggatataatgtacgacgggctggatgccgtaggagtggatcagcagaattttcataaatgtagacagcaccaagaagaggaagaggcccggcggcgggaggaaaagcggttgcgcagactcgaaaagaagcgaagatcgaaggaaaagcaaatggcagaggctcaatgcaagccatattattctgattatagtcgttttagactgttagtgcatcatctatgtaccagtcattacctagatttatttattacaggtgtgattggcctgaacgtcgtaactatggctatggagcactaccagcagcctcagatactcgacgaggccctcaaaatctgtaattacatctttactgtgatttttgtgttggaaagcgtatttaagctagtggcctttggctttagacgctttttccaggatcggtggaatcaactcgacctggctattgtattgttatccattatgggaatcacattggaggaaatcgaagtgaacgctagtttacccataaatccaacaattataagaataatgcgggtcctgcgaatcgccagagtgctgaagcttctgaaaatggcggtgggaatgcgggcccttctcgacacagtgatgcaggccctcccccaggttggcaacttgggcctactgtttatgctgctcttcttcatatttgctgctttaggagtggaactgttcggggaccttgaatgcgacgaaactcatccctgcgaaggcctggggcgacacgcgacttttaggaactttgggatggccttccttaccttgtttagagttagcaccggagataattggaacggaattatgaaagataccttgagagactgtgaccaggaaagcacgtgttacaataccgtgatttcccctatctatttcgtgtcattcgtgttgaccgcgcagtttgtactggtgaacgtggtgattgcagttctgatgaagcacttggaggaatcgaataaagaggcgaaggaggaagctgaactcgaagctgagctcgaactggagatgaaaaccctgagtccgcaaccccatagtcccttgggatccccattcctctggccaggggtggagggaccggattctcctgattccccaaagcctggggccttgcatccggcagctcatgccagatctgcctcacacttctcactggaacaccctaccgaccggcagttgttcgatactatttccttgctcattcagggtagcctggaatgggagcttaaactgatggacgagctggccggaccaggcggacagccttccgcattcccaagcgctccttccttgggcggctctgacccccagatgcaaccacatcctaccgaattgcccggcccagacctcctgactgtgaggaaaagtggcgtgtccagaactcattctctgcctaatgacagttatatgtgccgccacgggagcacagctgaagggcctctggggcaccgcggctggggactacctaaagcacaatcaggctctgtattgtccgtccacagccaacctgcagatacaagctatatcctgcagctccccaaagacgcccctcatctgctgcagccgcactccgcccccacctgggggacaattcccaaactgcctcctccaggtaggtcacccctcgctcagagacctctccgacggcaagcagctatcaggacagattccttagacgtccagggcctcgggtcccgcgaagatctcctggctgaggtcagcggcccttccccccccctggcaagggcgtatagcttttggggtcaatcatcaacacaagcccagcagcatagccgctctcattctaagatttctaagcatatgaccccacctgccccttgcccgggccccgagcccaactggggaaagggaccacctgagactcggagcagcctggagctggacacagaactctcctggatatccggtgatctcctgccaccgggcgggcaagaagagcctccaagcccaagggatctgaagaagtgctacagcgtcgaggcacagtcttgccagagaaggcccacttcttggctcgatgaacaacgtagacactccatcgccgtgagctgtttagactcgggctctcagcctcacctgggcacagatcctagtaacttggggggacagccgctggggggaccaggcagcagacccaagaagaagctaagtcccccgagcatcacaattgaccctcctgagtcccaaggcccccgaacccccccctcacccggcatttgtctaaggaggagagcgccttcctccgacagcaaagaccctcttgccagtgggcctccagacagcatggcagcctcaccttcacctaagaaggacgtcctatccctctccggtctgtctagtgatcccgcagatctggatccttag

SEQ ID NO: 24741 - DNA, 6720 bp, Artificial Sequence
  Description of Artificial Sequence: Synthetic coding sequence
atggacgaggaggaggatggagcaggagcagaagaatcaggacagccacgctcgtttatgcgactgaacgatctgtccggagccggcgggcgaccgggccccgggtccgcagaaaaagatcctggcagcgccgattctgaagccgaaggcttgccctaccccgcactcgcgcccgtcgtgttcttttatttatcgcaggactcacggccccgatcgtggtgtttgaggaccgtgtgcaacccttggtttgaacgaatatctatgctcgtgattctccttaattgtgttaccctgggcatgttcaggccctgcgaggatatcgcatgtgattcacaacgctgcagaatcttgcaagcatttgatgactttatcttcgccttctttgcggtcgagatggtggtcaaaatggtggcacttggaatcttcggaaaaaaatgttacttgggagacacctggaaccgccttgacttcttcatagttattgccggaatgctcgaatatagtctcgacctgcagaatgtgtcattttctgctgtgcgcaccgtgcgcgtactgcgacctctcagggccatcaacagagttcccagtatgcgaatcctggtgactttgctgttggacacactgccgatgctgggtaacgtcctgctgctgtgctttttcgtgttctttatttttggcatagtgggcgtgcaactgtgggctggactcttgagaaatcgatgcttcctacctgagaatttttctctgcccctgagcgtggacctcgaacgttactatcagacagaaaacgaagatgagagccctttcatctgtagtcagcctagggaaaacggtatgcgaagctgccggagcgttccaactctcaggggcgatggcgggggtgggcccccatgtggtctagattacgaggcctacaacagcagctcgaacactacctgtgtgaattggaaccagtactatacaaattgcagcgctggcgaacataacccgttcaagggtgccattaacttcgataacatcggatacgcctggatagctatcttccaggttatcacattagaagggtgggtggatataatgtatttcgtgatggacgcgcattcattttataattttatctacttcatcctccttatcattgtgggtagcttcttcatgattaacttatgccttgtcgtaatcgcaacccaattttccgagactaaacagagggagagtcagcttatgcgtgagcagagggtgagattcctgagtaacgcaagcacactagcaagcttttctgagccggggtcttgctacgaagaactgctgaaatatttggtgtatattttaagaaaagccgccagacggctggcacaagtgagcagagcagcaggagtccgtgtcggactgcttagcagcccagcgcccctggggggccaggaaacgcagccatcctcctcatgtagccgttcccaccgcaggttatccgtgcatcacctggtacaccaccaccaccatcatcaccaccattatcacctgggtaatggaactctgagggccccccgcgcatctcccgaaatacaggaccgggacgccaacgggtctaggcggctcatgttgccgccaccttcaacccccgccctgtctggagcaccgccaggtggggctgaaagcgtccactccttttatcacgccgattgtcatttagaacctgtccggtgccaggcacctcctccgagatcaccatctgaggcttctgggagaacagttgggtctggcaaggtatatcctacagttcatacttcaccccccccagagacgctgaaggaaaaagctctcgttgaggtagccgcttcatccgggccccctacacttacaagtttaaacatccctcccggtccatatagttcaatgcacaagctgctagagacacagagcactggagcctgccagtcgtcctgcaaaatttcttccccgtgcctgaaggcggactctggggcatgcgggcctgattcctgtccatattgcgctcgggctggagcaggcgaggtagaactcgcggacagggaaatgcccgactccgattccgaggccgtgtatgagttcactcaggatgcacaacattctgatctgcgcgatcctcactcgagacgtcagaggtccctgggacccgacgccgaaccttcttctgttcttgccttctggcgtctgatctgcgacacattccggaaaattgtggattccaagtatttcgggcggggaattatgatcgccatccttgttaataccctgagtatgggaatcgaataccatgagcagccagaagagctcaccaatgccctggagatcagcaatatcgtcttcactagtctcttcgcactagaaatgcttttgaagctactggtttatggaccatttgggtatatcaagaacccttacaacatattcgatggagtgatcgtggtcatcagcgtgtgggaaatcgtcggacagcaaggcggcgggctcagtgtactgagaacattcaggctcatgcgcgtcctgaagttggtccgatttctgcccgccctgcaaagacagctcgtggttctgatgaaaactatggataacgtggctacgttttgtatgctccttatgctgttcatattcatcttcagcattcttggaatgcatctgtttggctgtaagtttgctagcgaaagggacggggatactctgcccgatcgaaaaaacttcgattccttgctttgggccatcgtgactgtcttccagattctgactcaggaggattggaacaaagttctgtataatggtatggcgtccacctctagctgggcagccctgtactttatcgcgcttatgacattcggaaactatgtgttgttcaatctgctggtggccattctagtcgaagggttccaggctgaagagatttcaaagcgggaagacgcttcaggtcagctcagctgtattcagctgccggtcgatagccaaggtggcgatgctaataagagcgagtcggagcctgactttttctccccgagcttggatggtgatggagaccggaaaaagtgcctcgcgctcgtgtccttaggcgagcatcctgaactgcgtaagagtctgctgcccccacttatcatccacacagccgccactcctatgtccctgccaaaaagtacatcaactggactcggcgaggctctgggaccagcatcccgacggacatccagttcaggctccgccgagccgggagctgctcacgaaatgaagagtcctccttctgctcgctcttctccccactccccatggagcgccgcatcctcctggacatcaaggcggtcttctcgcaactccctcggaagagccccttctcttaagcgaaggagcccatcaggggaacgccgcagtctcctgagcggggaaggccaggaatcgcaagatgaggaggagagttccgaggaggagagagcgagccccgcaggatccgatcaccgacacagaggctcactggaaagggaagccaagtcctccttcgacctacccgataccctacaggtgcccggccttcacagaacagcgagcggacgagggtcagcgtcagaacatcaggactgtaacggaaaatcagcatctggacggctggccagagccctgcggccggacgaccctcccctcgacggtgacgatgctgacgatgaggggaatctgtccaagggggagagagtacgtgcttggatccgtgcgcgactgcccgcctgctgcctggagagagactcctggtcagcgtacatctttcccccccagagtagatttcggctgctttgccatcggatcataacccacaagatgtttgaccacgtagtcctcgtaataatcttcttaaactgtatcacgatcgccatggaaaggcccaaaatcgacccccattccgcggaaagaatcttcctaaccctgagcaattacatattcactgctgtttttctggcagaaatgacagtcaaagtggtcgcactgggctggtgtttcggagagcaggcttacctccgttcgagctggaacgtcctcgacggtcttttggttctgatttctgtcatcgacattctggtgtccatggtctctgactctggtaccaagatactgggcatgctgcgcgttctgcggctcctgaggaccctgcgtccgttgcgcgtgatatcgcgagcccagggactgaagctggtggtggagaccctcatgtcatctcttaagcctatcgggaatatcgttgtgatatgttgtgcattttttatcatttttggcatcctgggggttcaactcttcaaaggaaaattttttgtgtgccagggggaggatacacggaacattaccaacaagtcagactgtgccgaagccagctaccggtgggttaggcataagtataactttgacaatcttggccaagccctcatgtcactatttgtcctggcatctaaggatggttgggttgacataatgtacgacggactggatgccgtgggggtagaccagcaaaacttccataagtgccgacagcatcaagaagaggaggaagccaggaggagggaagagaaacgcttacggcggttagaaaagaagaggcgctcgaaggagaaacaaatggcagaggcacaatgcaaaccttactattctgactattcccgttttcgtctcctggttcaccatctatgcaccagccactatctggacctttttattacaggggtgataggccttaatgtggtcacgatggctatggaacactatcaacaaccccagatcttggacgaagcactcaagatctgcaattacatttttacggttatcttcgtcttggaatccgtgtttaagttagtcgcattcggctttcgccgattttttcaggatcggtggaaccagttggacctggcaatcgtactcctgtctatcatgggcattaccctggaagaaatagaggtgaacgccagtttacctataaatccaacaatcattagaatcatgagggtcctccgaatcgcaagggtactcaagttattgaaaatggcagttgggatgagggcgctcctggacacagtgatgcaggctcttccccaagttgggaacctggggttgctctttatgctattgttttttatttttgccgcccttggtgtggagctgttcggcgatctggaatgtgatgagacccatccatgtgaaggtctggggaggcacgccacctttaggaactttggtatggcttttttaacactttttcgggtctctactggagacaactggaacggaatcatgaaggatacgctgagggactgcgatcaagaatccacctgctataataccgtgatatcgcctatttactttgtgtcattcgtattgaccgcacaattcgtattagttaacgtggtcatcgccgtgctgatgaaacatctggaagaatccaataaggaggccaaagaggaggctgaactcgaggcagagcttgagcttgagatgaaaactctctccccacaaccccattcccccctcggcagcccttttctgtggcccggggtcgaggggccggatagccccgatagtcctaaacctggcgccctccaccccgccgcacacgctaggagcgcctctcatttttcattggaacaccccaccatgcagcctcaccccactgaactcccaggccccgatctcctgaccgtgagaaaaagcggagtgtctcgcactcactctttaccaaatgatagctatatgtgtcgccatggatccacagctgaagggcccctgggccaccgaggctggggtctcccaaaagcccagtctgggagtgtactgagtgtccactcacagcctgccgacaccagctacatcctgcagctgccaaaagatgcaccccatctgcttcagccacatagcgcaccaacatggggaactattccaaaactgccgccgccagggcggtcaccactcgcccagcgaccgctgagacgacaggccgcaattagaactgattccctggatgtgcaggggcttgggtcccgagaagatctcctggccgaggtgtctgggccttccccgcctctggcacgggcctactctttctggggtcagtcatccacccaggcccagcagcatagcaggtcccatagtaaaatcagcaaacacatgacacctcccgccccatgtcccgggccagagccaaactggggcaaggggccaccagagactaggagtagcttggaacttgatactgagttgtcatggataagcggcgatctattgcctccaggcggacaagaagaaccaccatcaccgcgagatctgaagaaatgttatagcgtcgaagcccaatcatgtcagagacggcccacaagctggctggacgaacagaggcggcatagtatcgccgtttcctgtctggactccggaagccaaccacacctggggactgacccgtccaatcttgggggacaacctctcggcgggcctggatcacgacccaaaaaaaaactttcacctccctcaatcacaatagacccaccagaaagccagggaccaaggaccccaccctccccggggatatgcctcaggcgccgagccccctcctccgactccaaggatcccctggcctccggccccccggattccatggctgcatcccctagtcctaagaaggacgtactgagcctgagtggattgagctccgatccagccgacttggatccttag

SEQ ID NO: 24742 - DNA, 6876 bp, Artificial Sequence
  Description of Artificial Sequence: Synthetic coding sequence
atggatgaagaggaagacggcgctggagctgaggaatctggccagcctagatcattcatgcggcttaacgatctgtccggcgctggcggcaggcccggacccggcagcgctgagaaggaccccggcagcgccgacagcgaggccgaaggtttaccatatcccgctctggcccccgtggtttttttctatctgtcacaagatagccggccgcgtagctggtgcctgcggactgtctgcaacccatggtttgagcggatctcaatgcttgtgatcctgctgaactgcgtgactctgggcatgttcaggccctgcgaggatatcgcctgcgacagccagcgctgccggatccttcaggcattcgatgatttcatatttgcattttttgcagtggagatggtagttaagatggtggcgcttggtatctttggaaaaaagtgctatttgggcgatacatggaatagactggatttcttcattgtcattgcaggcatgctagagtactctcttgacctgcagaatgtgagcttctccgctgttcgaaccgttcgcgtgctccgccctctacgcgctatcaacagggtgccctcgatgcgtatcctggtaaccctgctgttggacacactgcctatgctgggcaacgttcttctgctatgcttcttcgtgtttttcatcttcggtatcgtgggggtgcagctctgggccggcctgctgaggaaccgctgtttcctcccggagaacttctcattgccactatcagttgatctggagcgttattatcaaacagaaaatgaggacgaatctccctttatctgctcccaacctcgggagaacggcatgaggtcttgcagaagcgtccccactcttcgcggggacgggggagggggtccaccgtgcggcctcgattatgaagcttacaacagtagcagtaatacaacctgcgtgaattggaatcagtattacaccaattgtagcgcgggggaacacaatccgtttaaaggcgcaatcaacttcgacaacattgggtatgcctggatcgccatcttccaggttattacgctggaggggtgggtcgacatcatgtacttcgtgatggatgcccattcattctacaattttatctacttcattctgttaataatagtgggcagcttttttatgattaacctgtgtcttgtcgtcatcgctacccagttctcagaaactaagcagcgggagtctcagttgatgcgagaacagcgcgtccggttcctttccaatgctagcaccctggcctcctttagcgaaccaggatcctgttacgaagaactcttgaagtatcttgtatacattctgcggaaggccgctcgcagattggcacaggtgagcagagccgctggtgtgcgcgtggggctgctttccagccctgctccgcttggaggtcaggagacccaaccatcatcttcatgctccagatcccatcgacggctgagcgtgcaccacctggtgcatcatcatcatcatcatcaccaccactaccacttgggaaatggtactctgcgtgccccccgcgcatcgccggaaatccaagacagagatgcgaacgggtctcggcggctcatgctgccacccccttcaacgcctgcgttgagcggcgccccaccaggcggcgccgaatcagtccactcattttaccacgccgattgtcacctcgaaccggttagatgccaggctccgccgccgagatctccatctgaggcatccggccggaccgtggggagcgggaaagtgtatcccacggtgcatactagtccgccacccgagaccctgaaagagaaagccctagtcgaggttgctgcgagtagcgggcctcctacgttaacttcactcaacatccctccaggcccctactcttccatgcataaattactcgagactcagagtaccggagcttgccagtcgtcctgtaagatcagttccccgtgcctgaaggcagattctggagcatgtgggcccgatagctgtccttattgtgccagagccggagcaggcgaggttgaactagcggatcgtgagatgccagattccgatagtgaagcagtttatgagttcactcaggacgcgcagcattctgatttacgcgacccgcatagccgcagacagcgttcattgggtccagacgctgaaccaagctctgtgttagctttctggagactgatttgcgacacctttagaaaaattgtcgacagcaagtacttcgggagaggaatcatgatcgctattctggtgaacactctgtctatgggaatagaataccacgagcaacctgaggagcttactaatgctttggagatcagcaatattgtcttcacatcgctgttcgcattggaaatgctgctcaagctgttggtatacggccctttcggctacattaaaaacccatacaatatctttgacggagtgatcgtcgtgatcagtgtgtgggaaatcgtgggccaacaagggggcggcttgtctgtcctccggactttccggctaatgcgtgttcttaagctagtgcgatttctgccggccttgcaaaggcagctggtggtcttgatgaaaacaatggacaacgtggccacattctgcatgctgcttatgttatttatctttatttttagcatcctcgggatgcacctcttcgggtgcaaattcgcttcagagcgtgatggtgacacactgcccgatagaaaaaactttgacagtctgctctgggcaatcgtcaccgtctttcagattctcacacaggaggattggaacaaagttctttacaatgggatggccagtaccagttcttgggcagcactgtatttcattgccctcatgaccttcgggaactatgtgctctttaaccttcttgtggccattctggtggagggattccaggcagaggaaatttcaaagagggaggacgcctcaggacagttgtcctgtattcagctaccagtggattcccagggcggtgatgccaataaaagcgaatcagagcctgactttttctccccaagcctggacggcgatggtgaccggaagaaatgtctcgccctggtgtcgttaggggaacatcctgaattgagaaaaagcctgctgccaccgttgatcattcatacggcagctacgcctatgtccctccctaaaagcacatcgacaggcctgggtgaggcccttggacccgcttccaggcgcacctccagctctggttcggccgaacctggcgctgcacatgaaatgaagtcaccaccaagtgccaggagctctccccactcaccttggagcgccgcctctagctggacctccaggcggtcttctaggaatagcttgggaagggccccttcattgaagcggaggtcccctagcggagagcggaggtcactgctgtcaggcgaggggcaagagtcccaggatgaggaggaaagttcagaagaagagagggcgtcacccgctgggagcgaccataggcaccgcggtagtttggagcgggaggcgaagtcgagtttcgacctcccagacactttgcaggtgcctggcttgcaccgcacagcaagcggccgtgggtctgcttcggagcaccaagattgtaacgggaaaagcgcctcggggcggctcgcccgcgctttgaggcccgatgaccccccactggatggggacgacgccgacgacgaagggaacctgtcaaagggcgaacgtgtgagagcctggatcagggcccgacttccagcttgctgtctagaaagagatagctggtcagcatatatcttcccacctcagtctcgctttcgactgttatgccacaggataataactcacaagatgtttgaccacgttgttcttgtaataattttcctgaattgcatcaccatagctatggagcgacccaagattgacccacatagcgccgagaggatctttctgactctgtctaactatatcttcaccgccgtgtttctggccgagatgacagttaaggtggtcgcgctcggttggtgcttcggggagcaagcttacctgcgttcctcttggaacgtccttgatggcctgctcgttcttatctccgtcatagatatcctggtgagcatggtatcagactcgggtactaaaatcctggggatgttgcgggtgcttaggctgctgcggacccttcgtccacttagggtgatcagccgggcgcaaggcttgaaattagtggttgagaccttgatgtcatcactcaagcccatcggtaacattgttgtaatctgttgtgctttttttattatttttgggatcttaggtgtgcagctattcaagggcaaattttttgtctgtcagggcgaggacacgcggaatattaccaacaagtcggattgcgcagaggcctcctacaggtgggtgagacataaatacaattttgacaatctgggccaggctcttatgtcactgttcgtgctggcttccaaggacgggtgggtcgacataatgtatgacggcctcgacgcggttggggtcgatcaacagcccataatgaatcacaacccctggatgctgctgtactttatttcttttcttttgatcgtcgccttctttgtactgaacatgttcgttggtgtagtggtagagaacttccataaatgccgccagcatcaagaggaggaagaggccaggcgcagagaggagaaacggctgagaagacttgaaaagaagcgaaggagcaaagagaagcaaatggctgatctcatgctagatgacgtgattgcttccgggtcaagtgctagcgcagcatccgaggcacagtgtaagccatattactcagactattcacgatttagacttctggttcaccacctttgtaccagtcactacctggacctctttattaccggggtgatagggctcaacgtcgttacgatggctatggagcattaccagcaaccacaaatcctcgatgaggccctgaagatctgtaactacattttcaccgtgatctttgtccttgagagtgtgtttaagctcgtagccttcggttttcggcgctttttccaggataggtggaatcagctggatcttgccattgttcttctgtcaattatggggataaccctggaggagattgaggtaaatgcaagtctccccattaacccgacaattatcagaataatgagggtgttgcgtatcgcccgagttttgaagctgctgaaaatggccgtcggcatgcgtgccctgctggacactgtgatgcaagccctcccacaggtaggcaaccttggactactgtttatgctgctgtttttcatctttgctgcattgggagtcgagctctttggtgaccttgaatgtgatgagacccacccatgtgaaggcctgggccgacacgccacctttcgcaacttcggaatggcattcctgaccctgtttcgtgtttccaccggcgataactggaatgggataatgaaagacaccctgcgagattgtgaccaggagtcaacgtgctacaatactgtgatcagtccgatctactttgtctcgttcgtgcttacggcacagttcgtcctggttaatgtcgtgattgccgttcttatgaagcatttagaggagtccaacaaagaagccaaagaggaagccgagttagaagctgagctggagttggagatgaagacattgagcccgcaaccgcatagccccttgggcagcccatttctgtggccgggagtggagggaccagactccccagattcccccaagcccggagctctgcaccctgctgctcatgctagaagcgcctcccatttttccctggagcatccaacaatgcagccccaccctaccgaactccctgggccagatctgctcacggttagaaaaagcggagtgagtaggactcatagcttgcccaacgactcatacatgtgtcggcacgggtcgacagctgagggaccccttgggcataggggctggggtctccctaaagcccagtccggctccgtcctcagcgtgcacagtcaacccgccgatacctcctatatactgcagctccctaaagatgctccccacctgctgcagccacacagcgcccccacctggggcactatcccaaagctcccgccacctggtaggtcccctctggctcaaaggccactgcggcgacaggccgcaatcagaactgatagcttagacgtccaagggctgggaagccgcgaagatttacttgcagaggtctctggaccaagccccccactggcccgggcctacagcttttggggacagagctctactcaggctcagcagcatagtaggagtcacagcaaaatcagcaagcacatgacgccgcctgccccttgccccggacctgaaccaaattggggcaaaggtccccccgagactcggtcctccttagaactggataccgagctgagttggatttccggcgatctgttgcccccgggtggccaggaagagcctccctctccccgcgatctgaaaaagtgctactctgttgaagctcagagttgtcagagacgccccacctcatggctagatgaacaacggagacactctatcgcagtgagttgcctggattcgggatctcaaccacatttagggacagaccccagtaacctgggcggacagccactcggtggcccagggagccgcccgaagaaaaagctttcccccccctccatcacaatcgacccccctgaaagccaaggccccagaactccaccgagccccggaatctgcctgcggcgcagggctccctcctccgattccaaggacccacttgccagcggccctcctgactctatggcagcctcgccttcacctaagaaagacgttttatcgttgtccggcctttctagtgatccagcggacctggatccctag

SEQ ID NO: 24743 - DNA, 6780 bp, Artificial Sequence
  Description of Artificial Sequence: Synthetic coding sequence
atggacgaagaagaggatggagcaggagccgaagaatccggacagccacgatcatttatgcggctgaacgacctatccggcgcgggcggtaggccaggccctggatcagctgaaaaagatccaggttccgccgactccgaggctgaggggttgccctacccagccctggccccagtagtctttttttacctcagccaggattctaggcctaggtcatggtgtctccgcacagtctgcaacccttggtttgagaggatctccatgctggtcatcctgttgaactgcgtcaccctcggaatgtttcgtccatgcgaagatatcgcctgcgattcacagcggtgccgcatacttcaggcctttgatgattttatttttgccttttttgcggtggaaatggtcgttaaaatggttgcccttggaatcttcggcaagaagtgctaccttggagatacctggaatcgactcgactttttcattgtcattgccgggatgttggaatactcgttggacctgcagaacgtgtcattctcagccgtgcggaccgttcgagttctgcgacccctgcgtgccatcaacagggtgcccagcatgcgcattctggtcaccctcctgctcgacaccctgcccatgctgggaaatgtattactcctctgtttcttcgtttttttcatctttggaattgttggcgtccaactgtgggcagggcttctcaggaacaggtgcttcctccctgagaatttctctcttcccctcagcgtggatctggagcggtactatcagacggagaacgaagatgagagcccattcatctgctctcagccaagagagaacggtatgcggagctgcaggtcagttcctacgctgagaggagacggcggtggtggacctccatgcgggctagactacgaggcttataactccagttctaatactacctgcgtgaattggaaccagtactatacaaattgcagtgcaggagagcataatccctttaagggagctattaattttgataacataggctatgcatggattgctatttttcaggtgataaccctggaggggtgggtcgacataatgtacttcgtcatggacgctcactcgttctacaacttcatttactttatcctgttgattatagtgggtagttttttcatgatcaatctgtgtctggtcgtcattgccacccagttctctgagaccaaacagcgcgagtctcagctaatgcgggagcagcgcgtgcgctttctgtcgaatgcatccacactcgcaagtttctcggagcctgggagctgttacgaggagctgcttaaatacctcgtgtacatactcaggaaagccgctcgcagactggcccaggtatcccgggctgccggtgttcgcgttggactgctgtcatcacccgcgcccctggggggtcaggagacccagccaagttcgtcttgttctcgctcccacaggcgtctctctgttcaccacttggtccaccaccaccaccatcaccaccaccactatcacctcggaaacggcaccctgcgcgcacctcgggcatcccctgagatccaggacagggatgccaacggaagtagacggctcatgttacctccaccgagtaccccagccctttccggtgctccccccggcggagcagagtccgtgcattccttttatcacgccgactgtcacctggaacctgtgcgctgccaagcccccccgccaaggtcaccttcagaagcctctggccggaccgtaggctccgggaaggtttaccccacagtgcatacaagtcccccccctgaaacactgaaagagaaagcactggtagaagtggcggcatcctctggcccccccacactcacaagcctgaacatcccgcctggtccttattccagcatgcataagttgctcgagacgcagtccaccggcgcctgccagagtagctgcaagatttcgtcaccatgtttaaaggcggacagtggggcatgcggacctgattcctgtccctactgcgcaagggctggagccggtgaggtggaactcgcggaccgggaaatgccagactccgactcagaagccgtttatgaatttacccaagacgcccagcactccgatctgcgcgatccccattctcggcgacagcgatcacttgggcctgatgcagaaccttcaagtgtgctcgcattttggcgccttatttgcgacacattcagaaaaatcgtggactccaagtacttcggaagagggatcatgatcgctatcctggtgaataccctttccatgggtatcgagtaccacgaacagcccgaagaattgacaaatgcgctggagataagcaatattgtgttcacctcgctctttgccctggagatgctgctgaaactcctcgtctacggcccattcggatacattaaaaacccatataacatattcgacggtgtgattgtggtcattagcgtatgggaaatagttggtcaacaagggggtgggctcagtgtactccgaacatttcgcttgatgcgcgtgcttaagttggtacgtttcttgcccgccctccagagacagctcgttgttctcatgaagacaatggacaacgtggctaccttttgcatgctgctcatgctgttcattttcatttttagcatcctggggatgcatctcttcgggtgcaaattcgcttctgagagagacggtgacactctgccagatcgcaaaaactttgatagcctcctgtgggcaatcgtgacagtgttccaaattttgacacaggaggactggaataaggtactctacaacggcatggctagcacttcaagctgggccgccctctacttcattgccctcatgacttttggaaactatgttctttttaacctgctggtggccatcctggtagaaggtttccaggctgaggaaattagcaagcgtgaggatgcgagcggccaactgagctgtatccaactgccagtagactcacagggcggggacgctaataagagcgaatccgaaccagattttttttcacctagcctggacggtgacggagaccggaagaaatgcctggccctagtatccctgggcgagcaccccgagctccggaagtctttattacctcccctgatcattcataccgctgctacgcctatgagtttacctaaatcgacatctactggcctcggagaggccctcggtcccgcgagccgcagaacttcgagcagcgggtctgcggagcccggagccgctcacgagatgaagtctccacccagtgcccggagtagtccacacagtccttggtcagcagccagctcttggaccagcagaaggtcctctcggaacagtctgggtcgcgctccttcactgaaaagacgctctccttctggtgagagacgctccctgctcagcggcgaaggccaggagagtcaggatgaggaagagagctctgaagaggaacgtgcttcaccagcgggttccgatcataggcaccggggctcactggagcgtgaagcgaaatcctccttcgacctcccagacaccctgcaggtgcccggattgcacagaaccgcttccggacgtgggagcgccagcgaacaccaagactgtaacggcaagtctgcatctgggagactggcccgggccctgcgccctgatgacccaccactggacggcgacgacgcagacgacgagggaaacctgtcaaaaggagagagagtaagagcgtggataagagccaggcttccagcctgctgtctggagcgggactcatggtctgcatacatatttcctccccaatcacgtttccggttgctgtgccatagaattattacccacaagatgttcgaccacgtggtcctggtgatcatcttcctaaactgcataaccatcgccatggaacgccctaagatcgacccccactctgcagaacggatatttctgacattgagcaattacattttcaccgctgtttttcttgccgaaatgaccgtgaaggtcgtggctctcggctggtgttttggcgagcaggcctacctgcggtcgtcttggaatgtgcttgacgggctgctggtcttgatcagtgtgattgatatcctcgtgtccatggtgagtgattctggcactaagattctcggtatgcttcgggtgttacgtctcttgcggactcttcgacctctcagagttatttcacgggcccaaggtctgaagctggtggtcgaaactctcatgtcgtccctgaaaccaatcggtaatattgtcgtgatctgctgcgcctttttcatcatcttcggaattctaggcgtccagttgttcaagggcaagttctttgtgtgccagggggaggacacgaggaacattacgaacaagtcagactgtgctgaagcgtcttaccgctgggtgaggcacaaatacaacttcgacaatttagggcaagcgcttatgtcactgtttgtgttggccagtaaagatggatgggttgatatcatgtatgatggattggatgccgtcggtgtcgaccaacaacccattatgaaccacaacccatggatgttgctgtatttcattagttttctgctgatagttgcgtttttcgtgttgaatatgttcgtaggggtggtagtggaaaattttcataaatgtagacagcaccaggaggaagaggaggctagacgaagagaggagaagcggctccggagactcgaaaagaaaagacgtaaggcccagtgtaagccctactacagcgactactcacgctttcggctactggtgcaccacctctgcacctcccactacttagatctgttcataacaggagtcattggcctgaatgtcgttaccatggccatggaacattatcagcagccccagattctcgatgaggcactcaaaatctgtaactacatttttacggtgatttttgttttagaatcagtgtttaagcttgtggctttcgggttccggagatttttccaggaccggtggaaccaactcgatctggccatagtattgctcagcatcatgggaataacgctggaggaaatcgaagtgaatgctagtcttcccatcaatcctacaatcataagaattatgagagtgctaaggattgcacgggtgttgaagctcctgaagatggctgttggaatgcgcgcattgctcgacactgtgggcaaccttggccttctctttatgctgttattttttatattcgcagctctcggtgtggaattgtttggcgacctggaatgcgacgaaacacatccttgtgagggactcggaagacacgccactttccgcaactttggtatggcttttctaaccctgttcagggtgtccaccggcgataactggaacggtatcatgaaggatacattgcgcgattgtgatcaggagtctacatgctataacaccgtcataagtcctatttactttgttagctttgttctcaccgcccagtttgtactcgtgaacgtggtgatagcggttctaatgaagcacctggaggaatccaataaagaagccaaggaggaagcggagctggaggccgagttggaactggaaatgaagactctgtccccccagccacactcccccctcggtagcccgttcctgtggcctggcgtagaagggccagactcacccgacagccccaagcccggcgccctccaccctgccgcgcacgctaggtctgcttctcacttttctctggaacaccctaccatgcagccacatcccacagaactgcctggaccggaccttttaacagtccgtaaaagtggcgtaagccgcactcactctctccctaatgattcttatatgtgtaggcacggctcaaccgcggaggggccactcggccatcgagggtggggactgcctaaggcacagagcgggagcgtgctttccgtgcacagccagcctgcagataccagctacatcctgcagcttcccaaagacgccccacacctgctccagccccatagcgcgccgacatggggcaccatccccaagttacccccacccggtagatctccacttgcccagcgtcccctgaggcggcaggctgctattcggacggactccctggacgtccaaggactgggcagccgtgaagatctgctggctgaagtttccggccccagcccgcccctcgcacgcgcctactctttctgggggcagagctccacacaggcgcagcaacattccaggagccattctaaaatcagtaaacacatgacccctccagcgccatgccctgggccagagcccaattgggggaagggcccccccgagacgaggtcctctctcgaattggacacagagctgagctggatctccggggacctccttcctcccgggggccaagaagaaccacctagtccccgcgacctgaaaaaatgctattcagtggaagcccagagttgtcagaggaggccaacaagctggttagatgagcagagacgccatagcatcgcagtttcatgcctggatagtggatctcagccccatctaggcaccgacccctccaatctcgggggccaacccctgggaggtccgggtagccgccctaagaagaaactatctcccccgtccataaccattgaccctcccgagagtcaggggcctaggacaccgccttctcccggcatttgcttacggagacgggctccatcttcagactctaaagatcccctggcctccggcccccctgacagcatggcagcttcaccttcgcccaagaaagatgtgctctcactgtctgggttaagcagcgacccggccgacctggatccatag

SEQ ID NO: 24744 - DNA, 6684 bp, Artificial Sequence
  Description of Artificial Sequence: Synthetic coding sequence
atggatgaagaagaagacggagcaggcgcggaggagtccggtcagcctaggtctttcatgcgattaaacgatttgtccggcgccgggggccgtcccggcccagggagcgccgagaaggaccctggatccgcagacagcgaagccgaggggttgccttatcctgcactcgctccagtggtgttcttttacctctctcaggactctcgacctcgcagttggtgtctgagaaccgtatgtaacccctggttcgaacgtatttcaatgctggtgatcctgctgaactgtgttaccctggggatgtttcgcccatgcgaagatatcgcttgtgattcacaacgatgtagaatcctgcaggcgttcgatgacttcatcttcgccttcttcgccgtggagatggtggttaagatggtagccttgggtattttcggcaagaaatgctaccttggcgatacctggaacaggctggattttttcattgtcatcgctggcatgctggagtatagcctcgacttgcagaatgtatcgtttagcgctgtacggactgttagagtgctgcgacctcttcgtgcaattaatagggtcccttctatgcgcatcctcgtgaccctcctattggacactcttcccatgctcggcaacgtgctgttattatgtttcttcgtgttcttcatttttggtatagttggagtacaactctgggccggattgctgcgcaatcgatgctttctgccagagaacttcagtttaccgctcagcgtagatctcgagagatattaccaaacagagaacgaggatgagtccccctttatttgtagccagcctagggagaacggaatgaggagctgcagaagtgtgcccactctccggggcgatggtggggggggcccaccatgcggccttgattatgaggcctacaacagcagcagtaataccacatgtgtgaactggaaccagtattacacaaactgttctgctggcgaacacaaccccttcaaaggtgcaatcaattttgataatatcggatacgcatggatcgcaatttttcaggtcattaccctggagggttgggtggatatcatgtattttgtcatggacgcccacagcttctacaacttcatctatttcatcctcctcataatcgtgggctccttctttatgattaatctgtgtcttgtcgtcatcgctacccagttctcagaaaccaagcaacgggaatcccagctgatgcgagagcagcgcgtcaggttcctgtccaatgcaagcaccctggcatccttctcagagcctggctcgtgttatgaagagctgctaaaatacctggtgtatatcctgagaaaggctgctaggaggttggctcaagtgtcccgggcagcaggcgtgcgtgtaggtctcctgtccagccctgcccccctcggcggccaggagacccaaccatctagttcttgctctcgcagtcaccgtcgtctgagcgtccatcacctggtgcatcaccatcaccatcatcatcaccactaccatctgggtaatggcacacttcgcgccccaagggcctcccccgagatccaggatagagacgcaaacgggagtcgccgactgatgctcccgccccctagtaccccagcgctctcaggcgcaccccctggcggggctgagagtgtacattccttctatcatgccgattgtcaccttgagcctgtccgatgccaggcaccaccacctagaagtccctctgaggcgagtgggaggaccgtgggttccggaaaagtgtatcctactgtgcacactagtccaccgccggaaaccctgaaggagaaagccctggtcgaggtggccgctagttctgggcctccaaccctaacctcccttaacataccacctggcccctactcatccatgcacaagctgctggaaacacaatcaactggggcttgtcagtcctcatgcaaaattagctcaccttgcttaaaagctgactccggcgcgtgtggacctgattcttgtccctactgcgcccgggctggtgccggcgaggtggagctggctgaccgggagatgcctgactcagacagtgaagcagtgtacgagttcacccaggacgcacagcactccgaccttagggatccacatagcaggaggcagaggagcctggggcccgatgccgagccatcaagcgttctggcattctggcgattgatctgtgacacattccgtaaaattgtggattctaagtattttggaagaggaattatgatcgccattctagtgaacaccttaagcatgggcatcgagtaccatgagcagcccgaagagctaacaaacgctttagagatttctaacattgtgttcacctctttgtttgctctggagatgcttctcaaacttctggtctatggtccatttgggtatataaaaaacccgtacaacatcttcgacggggtgatcgtggtgatcagtgtgtgggagatcgtgggccagcaaggaggcggcctctcagtactgcgcaccttcaggttaatgcgtgtcctcaaactggttagattcctgccggctctccagcgtcagctcgttgtgctaatgaagactatggacaacgtcgctacattttgcatgctactgatgctgtttatctttatcttttccattttaggaatgcatctgtttggctgtaagtttgcttccgagcgcgacggcgataccctgccggaccgcaagaacttcgattcactcctgtgggccatcgtgaccgtgttccaaattctgactcaggaagattggaataaggtcctctacaacggcatggcctctacatcctcctgggccgcactgtattttattgctctgatgacgttcgggaattatgtgctcttcaatctcttagttgccatcttagtggagggattccaggccgagggagatgctaataagagtgaatcagaacccgattttttcagtccatcattagatggtgatggagatagaaaaaagtgtctggcgctcgtcagtctcggcgaacatcccgaactgcgaaaaagccttctgcctccgctgatcatacacacagctgccacccctatgtccctgcccaagtctacatcgacgggcttgggggaggccctaggcccggcttcgagaagaacctccagcagcggatctgcagaaccaggcgctgctcacgagatgaaaagccccccttcagctaggtcatctccacattctccctggagcgccgcatcatcctggacatcacgcaggtcctcgagaaatagcctgggtcgggctccctccctgaagcggcggtccccttctggcgaacgccggtcccttctgtccggggagggccaggagtcacaggatgaggaggagagcagcgaggaagagcgtgcttcccctgctggaagcgaccaccggcaccgaggcagcctcgaacgcgaagctaagtcatcgttcgatctgcccgatacacttcaagtgccgggactccatcgtacagcctctgggagaggctcagcatccgaacaccaggattgcaatggcaagtcggcctccggcagattagcaagggcccttagacccgacgacccccctttggacggcgacgacgcagatgatgaggggaatctctccaagggggaaagggtgcgcgcttggataagagccagactgcccgcctgctgtcttgaaagggacagttggtcagcctacatttttccccctcagagccggttcagactgctatgccaccgcattattacccataagatgttcgaccatgtggttctcgtgatcatttttctgaactgtatcacaattgccatggagcgtcccaagatcgacccccactctgccgagagaatctttcttaccttaagtaattatatctttaccgccgtttttttagcagagatgactgttaaggtggtggctctcggatggtgtttcggtgaacaggcctacctgaggtcctcctggaatgtgctggatggcctcctggtgctgatctcagtaatcgatattctggtgtctatggtaagcgattctggcactaagatcttgggaatgcttagagtactccggcttcttagaaccctgaggcctcttcgcgtgatctctcgggcccagggactgaaactggttgtcgagacactgatgtcttccctaaaaccaattggcaatatcgtggtcatctgctgcgccttcttcattatcttcggcatactgggtgtccagctgttcaagggaaaatttttcgtatgccagggcgaagacaccaggaacatcaccaataaaagtgactgcgctgaggctagttaccgatgggttcggcacaaatacaacttcgacaatctcggacaggctctgatgagtctgttcgtgctcgcttcaaaggacggctgggtcgacattatgtacgacggcctggatgcggtgggtgttgatcagcaaaacttccacaagtgtcgtcagcaccaggaagaggaggaagcccggcgcagggaagagaagaggttacgccggctggaaaaaaagcggagaaacctgatgttagacgacgtgattgcgagcggaagcagcgcatctgccgcttccgaggcccaatgcaaaccatactactcagactactctcggttccgtctactggtgcaccatttgtgcactagccactatctcgacttattcatcactggcgtgataggcctcaacgttgtgacgatggcaatggagcattatcagcagcctcagatcttggatgaggcactcaaaatctgcaactacatctttacagttatcttcgttttggagtcagtgttcaagctggtggcgtttggtttccgccgtttcttccaggaccgctggaaccagctagacctagctatagtgttgctgagtattatgggaataactttagaagagatcgaagttaacgcgagcctgcctattaatcctacaatcattcgaattatgagggtgctacggattgcaagagtcttaaagttgttgaaaatggccgtaggcatgagagccctgctggacactgttatgcaggctcttccgcaggttggtaacctgggcctcctcttcatgttacttttcttcatttttgccgccctgggagtagagctgttcggggacttggagtgcgacgagacacacccttgcgaaggcttagggaggcacgcaacctttcgcaatttcggtatggctttcctgacattattccgtgtgtctaccggcgacaattggaatggaatcatgaaagacacactgagggattgtgatcaggaaagcacttgctacaacacagtgatatcacccatttacttcgtgagcttcgtccttactgcacagttcgttctggttaacgtggtgattgctgttttgatgaagcatcttgaggaaagcaacaaagaagctaaggaggaggccgagcttgaagccgaactcgaactcgaaatgaaaaccctgtcccctcaaccgcatagccctctgggctctccgtttctgtggcctggcgtagaagggcctgactcgccagactcaccaaagcccggcgcactacaccccgccgctcatgcccgttccgcatcccatttcagtttggagcatcccacgatgcagccacatcccaccgagctgcccgggcccgatctgctcaccgtgaggaagagtggcgtttcacgaacccatagcctccccaatgatagctacatgtgcagacacggctctacagcagagggccctctcgggcatcgtggatggggcctacccaaggctcagtccggatctgtgctatcagtacatagccaaccggctgacacatcatatattctccaactaccgaaggacgctccgcacctcctccagccccacagcgcgcctacatgggggacaattccgaagttacctcctcctggacgcagcccacttgcacagcgccctctacgtcggcaggccgccatccgcacggattctctcgacgtacaggggcttgggagtagagaagacctgcttgccgaagtctcaggcccgagcccaccgctcgcgagagcctatagtttttgggggcaatcaagcacccaggctcaacaacattcccgttcgcactccaagattagtaagcatatgactccccccgcaccatgccccggaccagagcctaattggggtaaagggcctcctgagacgaggtcttctctggagttagatactgaactttcgtggatatctggagacctcctgcctccggggggtcaggaggaacccccctctcccagggatttaaagaagtgttactctgtagaggcccagtcttgccaaaggagaccaacctcgtggctggacgagcaacgacgtcactctattgccgtcagttgccttgattcgggcagccagcctcaccttggtacagacccatctaatctgggggggcagcccctgggcgggcctgggagccggcccaagaagaagctatctccgcccagcatcaccatcgatccaccagaatcacagggcccacggaccccccccagcccaggcatatgcttgagacggcgagcaccgagtagcgactccaaagaccccctggcttctggccctccagactccatggccgctagtccatcccccaaaaaagacgtgctgtccctgagcggactgtcaagcgacccagctgacctagatccttag

SEQ ID NO: 24745 - DNA, 6855 bp, Artificial Sequence
  Description of Artificial Sequence: Synthetic coding sequence
atggacgaagaagaggacggggccggcgctgaagagagcggacagccaaggagcttcatgcgcctaaacgacttgtctggagcaggaggaaggcccggccccggaagcgcggagaaagaccccggttctgcagacagcgaggcagagggactaccctacccggctctcgcgccagtcgttttcttttacctgtcccaggactccagaccccgcagctggtgtctcaggactgtttgtaatccctggtttgagagaatctccatgctcgtgattctcctgaactgcgtgacactgggaatgtttcggccctgcgaagacattgcctgcgattcacaacgctgtagaatccttcaagcttttgatgatttcatttttgccttttttgctgtcgaaatggtggtgaagatggtggcgttagggattttcggcaagaagtgttatctgggggatacgtggaataggctggacttttttatcgtgattgcgggcatgcttgaatattccctagacctgcagaatgtttctttcagcgctgtgcgaaccgtcagagtactccggcccctacgcgccatcaatcgggtgccatccatgagaattcttgtcacactcctgctggacacactgcctatgctcgggaacgtcctcctgctgtgtttcttcgtgttcttcatctttggaatcgtgggggtccagttgtgggctggtttattgcgaaaccgctgcttcttacccgagaatttttcattaccactcagtgtcgatcttgagaggtactatcaaaccgagaatgaggatgaatcaccattcatttgctcacaaccacgagagaacggcatgcgctcgtgtaggagtgtgcctaccttgcgcggtgacgggggcggaggaccgccgtgcgggctggactacgaagcttacaactcatcctcaaatacaacctgcgtcaattggaaccagtactatacaaactgctctgctggagagcacaatccattcaagggagcaattaatttcgataacatcggctatgcgtggatcgctatcttccaagttatcacattggaagggtgggtcgacatcatgtatttcgtgatggacgcccattccttctataatttcatctactttatcctactgatcatagtgggctctttctttatgataaatctctgcctggtcgtcatagcaactcagtttagcgaaacgaaacaacgggaatcccagcttatgagagaacagcgcgtaaggtttctttccaacgcaagcacattggcaagctttagcgaacctgggtcttgctacgaagaactactgaagtatttagtgtatattttgcggaaagccgccagaagacttgcccaggtgtcccgcgcagctggagtcagagttggtctgctttccagccctgcccccttaggcggtcaggagacacaaccaagttcttcttgcagcaggagccaccgccgtctgtccgttcatcatctcgttcaccatcatcaccatcaccaccaccattatcaccttggaaacggcaccttgagagcaccacgtgcctctcctgaaattcaggacagagacgccaatggaagccggcgccttatgttaccacccccgtccacacccgccttgtctggcgccccacccggcggtgccgagagtgttcactctttctaccatgccgactgtcatctggaaccagtgaggtgccaggccccccctccaaggtcgccaagcgaggcctccggacgcacggtgggctccggcaaggtgtatcccaccgtccacacgagccctccgcctgagacactgaaagaaaaggctctggtggaggtggccgcgtcttcgggccccccaacccttacgtcgctaaacattccgccaggtccatattcctctatgcataagttactggagacacagagtacaggggcttgtcaatccagctgcaaaatatcatcaccatgtctcaaagccgattccggagcttgcggccctgacagctgtccctattgtgcaagagccggcgcaggggaagttgaattagccgatagggagatgccggacagtgatagtgaggctgtgtacgagtttactcaagacgctcagcatagcgatttaagagaccctcactcgcgacgacagaggtccctagggccggacgctgaaccgtcctccgtgctagcgttttggaggcttatttgtgacacgtttcgaaaaattgtggacagcaaatatttcggaagggggatcatgatagccatcctcgttaacactctgtctatggggatagagtatcacgagcaacctgaagaactaacaaacgcgctggagattagtaatatagtatttacctcattatttgcacttgagatgctgctaaagctgctcgtgtatggccccttcgggtatattaagaacccttacaacatcttcgatggcgtgatagtagtgataagtgtttgggagatcgtaggccagcagggagggggattgtctgttttgcggactttccggctgatgcgagtcctcaagctggtgaggttcctgccagctttacaaaggcagcttgtagttttgatgaagactatggacaacgtggcaaccttctgcatgctgctgatgttattcattttcattttcagtatcctgggcatgcatctgtttggctgtaaatttgctagtgaacgagatggcgacaccctgccagacaggaaaaattttgactcattgttgtgggccatcgtaaccgttttccagatccttacacaggaggactggaacaaggtgctttacaatgggatggcaagtaccagcagctgggcagctctgtattttatcgctttgatgaccttcgggaactatgtgttatttaatttgctggtggctatcctcgtcgagggctttcaagctgaggagatcagcaagcgcgaggatgcctcaggacagttgtcgtgtatacaattgccggttgatagccaaggaggagatgccaataagtccgagtccgaacccgattttttcagcccctcattagacggcgatggagataggaagaagtgccttgctctggtttcattgggcgaacacccagagttgcggaagtcattgcttcccccgcttattatccacactgctgcaacccctatgtccttacccaaaagtacttcaacgggcctcggagaggctcttggcccagccagcagaaggacaagctctagcggcagcgctgaacccggtgctgcccatgaaatgaaatctccgccctccgcacgatccagtcctcacagtccgtggtctgcagcatcgtcttggacgagccgcagaagctcaaggaattcgcttggacgggctccgtccctgaaacggcgctctcccagcggggagcgcagatcccttctttccggggaaggccaggagtcacaggatgaggaggagtcatccgaggaagaaagagccagtcccgccgggagcgatcatcgtcatagaggttctttggaacgagaagccaagagtagcttcgatctgccagacacgcttcaggtccctgggcttcaccgcacagcatcagggcgggggtctgcctccgagcaccaagactgtaatggtaaatcagccagcggaaggctggcacgcgccctgcgacctgacgatccccctctggatggagatgatgccgacgatgaggggaatttaagcaagggggagcgtgttcgcgcatggattcgtgcgagactgccggcttgttgtctcgagcgagattcctggtctgcttatattttccctcctcagtcccggtttcgtctgttgtgccatcggattatcacacataaaatgttcgaccacgtcgtgctggtgattatcttcctgaattgcataaccattgcgatggagcggccaaagatcgaccctcacagcgcagaaagaatctttctcacgttatcaaactacattttcacagctgtgtttctggcagagatgacagtgaaggtggtggctttaggatggtgttttggggagcaggcatacctccgatcaagctggaacgtgcttgacgggctgctcgtgctgatctccgttatcgatatactggtaagcatggtcagtgactctggcacaaagattttaggtatgctgagggtattgcgtctgctacgaactctgaggccccttcgggtgataagtcgcgctcagggcctaaaactggtcgtcgagacccttatgtcgagcctcaagccgatcgggaacatcgtggtcatttgctgtgccttcttcattattttcggcattctcggggtgcagctgttcaaaggaaagtttttcgtttgtcagggcgaggacactcggaacatcacaaacaagtccgactgtgctgaagcttcctaccgctgggtcagacacaaatacaatttcgataatttaggacaggctttgatgagtttgtttgtgctggcgtccaaagacggatgggtcgatattatgtacgatggcctggatgccgtgggtgttgaccagcagcccattatgaaccacaacccatggatgttgctttacttcatctcctttctacttatcgtggcgtttttcgtcctgaacatgttcgtcggagtggtggtggagaacttccacaaatgccgtcagcaccaggaggaggaagaggctaggcggagagaggagaaacggctgagacgactggagaagaagaggagaaacctgatgctggacgacgttatcgcctctggctctagcgccagtgctgcgagcgaggcccagtgtaagccatattactctgactattcaagattcaggctgctggtgcaccatctgtgtacatcacactatttggacctctttatcactggggtgatcggcttgaacgtggtgacgatggccatggagcactaccaacaaccacagattctggacgaggctctaaagatttgcaattacatattcactgtgattttcgttctggaaagcgtttttaaactggtcgccttcgggtttcgcaggttctttcaggaccgctggaaccagctcgatctcgccatcgtgcttttgagtatcatggggataaccctcgaggagattgaagtcaatgcaagcctcccaataaatcccacaatcattcgcatcatgagggtcttgagaatcgcacgagtcctgaagcttctcaagatggccgtgggcatgcgagcccttctggacaccgttatgcaagctctaccccaggtgggcaatctgggactgctcttcatgctcctctttttcatttttgccgccctaggggtggaactgttcggggatttagagtgcgatgaaacccacccctgtgagggattaggcagacatgcaacctttagaaatttcgggatggccttcctgacactcttcagagttagcaccggcgacaactggaatggcatcatgaaggataccctgcgggattgcgatcaggaaagcacctgctataacaccgtgatctctcccatctactttgtgtcatttgtgctgaccgcccagtttgtccttgtgaatgttgtgatcgcagtattaatgaaacacctcgaggagtccaataaggaggctaaggaagaagctgagttggaagccgaactcgagctggaaatgaagactctaagccctcagccacatagccccctcggcagtccttttctatggccaggcgttgaaggccccgacagtcccgacagtcctaaacccggggccctgcaccccgctgctcacgccaggagcgcctcccactttagcctagagcacccaacaatgcagccacatccaactgagctgcctgggcctgatttgctgaccgtcaggaagagtggggtgtctaggacccatagcctgccaaacgacagctatatgtgcagacacggtagtactgccgaaggacctctcggtcataggggatgggggttacctaaggctcaatctggttcagtgctcagtgtccactcacaaccagccgacacttcgtatatcctgcaactgcctaaggacgcgccgcacctccttcagccccatagcgcacccacttggggcaccatcccgaaattgccacccccaggacggagccctctggcccagaggcccctgagaagacaggccgccatccgaactgacagcctggatgttcaggggctggggagccgcgaggacctgctggccgaggtaagtggtccctcccctcctttggcaagagcatacagtttttggggacagagttctacccaggcccagcagcacagccgctctcattcgaaaatatcgaagcatatgaccccccccgccccttgtccgggaccagagccaaactggggaaaggggcccccagagacacgcagctcgctggagctcgacacagaactcagttggattagtggcgatttgttacctccaggaggtcaggaggaacctcccagcccgcgggacctgaaaaagtgctactccgttgaggcacagtcatgtcaacgacgacccacctcgtggctagacgagcaaaggagacatagcatcgccgtatcttgtttggattcgggaagccagccccacctgggaaccgaccccagcaacctgggcggtcaacctctgggcggacctggttcccggcctaagaaaaaactttctccacctagcataacgatcgatcccccagaatcccaggggcccagaaccccccccagtcctggcatatgcttgcgcaggcgagctccctctagtgatagcaaagatcccctggcgtctggccccccggacagcatggcagcctctccgtctcctaagaaagacgtgctctccctttcgggactgagttccgatccggccgatcttgatccttag

SEQ ID NO: 24746 - DNA, 6945 bp, Artificial Sequence
  Description of Artificial Sequence: Synthetic coding sequence
atggacgaggaagaggatggagcaggagctgaggagtccggtcagccccgctcttttatgcgcttaaatgacctgagcggcgccggcgggcgcccaggcccgggctcggctgaaaaggatcccgggagcgccgactctgaagccgagggcttaccttaccccgctctcgccccagtcgttttcttttatctgtcacaggacagtcggccaagaagctggtgcctacggaccgtgtgcaatccttggttcgagcggatctcaatgctggtaatcctacttaattgtgtaacactcgggatgtttagaccctgcgaagacatcgcttgcgatagccagaggtgccggattctgcaagcttttgacgatttcatctttgctttcttcgccgtcgagatggtggtcaagatggttgcactgggaattttcggaaagaaatgctacctgggggatacatggaaccgactcgacttttttatcgtcattgccgggatgctggagtatagtctggatctccaaaatgtgagcttttcagcggtccgaacggtccgcgttctgagacctctgagagccattaatagagtgcctagtatgcggatcctagtaactttgcttttagacacactcccgatgctgggaaacgtccttctgctctgctttttcgtattttttatcttcggcatagttggtgtccagctgtgggcgggacttcttaggaacagatgtttcctgcctgagaacttctcattgcccttgtcagtagacctggaaagatactatcagactgagaacgaggacgagagcccttttatatgctcacagcctcgggagaatgggatgagaagctgcaggagtgtaccaacactccgcggcgatggtggtggcgggcccccctgcggtctagattacgaggcctataactccagcagcaacaccacctgcgttaactggaatcagtattatacgaactgtagtgctggagaacataatcctttcaagggcgcaattaacttcgacaacataggctacgcgtggatagccatttttcaagtgattacacttgaggggtgggtggacatcatgtattttgtgatggatgctcattctttctacaatttcatctattttattcttctgatcatcgtgggctccttctttatgattaacctgtgcttggttgtgatagccacacaatttagcgaaacaaaacagagggagtcacaactgatgcgcgagcaacgagtgcggtttctttccaacgcttctaccctggctagtttcagcgagcctggatcttgttatgaggagctgctaaaatacctggtgtatatcctgagaaaagcagcacggcgcctggcgcaagtaagtagggccgctggagtgagggtggggctgctgtcaagtccagcccccctgggcggccaagagactcagccctcctcctcatgctccaggagccacagaaggctaagtgtgcatcatctcgtacaccaccatcaccaccatcatcaccactaccatctgggaaatggtacgctgcgtgcgccaagagcgagtcctgagattcaggaccgggacgctaatggcagccgccggctgatgttgccccccccctcgactccggccctttccggggccccccctgggggagctgaatctgtgcacagtttttaccatgccgactgccatctcgaacctgttaggtgtcaggcacctcccccccggtccccgtctgaggccagcgggcggactgtcggtagcggtaaggtatatcccacagtacatacttcacccccaccagagaccttaaaggaaaaggccctggttgaggtggccgccagctccggacctcccacactcacctctctgaacatcccccctgggccttactcctccatgcacaagctcctggagactcagtcaaccggcgcctgccagtcttcttgcaaaatttctagcccttgcctaaaggccgattctggagcctgcggccccgactcgtgcccatattgcgctcgcgccggtgcaggcgaggtcgagctggctgacagagagatgccggacagcgactcagaagcggtgtacgagttcacacaggacgcgcaacactcagatttgagggaccctcactcgagacgccagcggtccttagggccggacgcagagccttcttccgtcctggcgttttggcgccttatttgtgacactttcagaaagatagtcgactcaaaatacttcgggcgtgggatcatgattgccatcctcgtgaacaccctgtctatgggaattgagtaccatgagcagcctgaagaattgactaatgccctggaaatcagtaacattgtatttacaagtctgttcgccttggagatgctgcttaagctgctggtttacggaccctttggctacataaaaaatccttataatatcttcgatggagtcattgtcgtgatctctgtgtgggaaatagtgggacagcagggaggtggcctgtctgtcctgagaactttccggctcatgcgggtgctgaagctggtcagattcctccccgctcttcagcgccagctggtggtactgatgaagaccatggacaatgtggccaccttctgtatgctgctcatgctctttatctttatattcagtatcttaggaatgcacttatttggctgcaaattcgcttcggagcgtgatggcgacacactgccagaccgcaaaaactttgatagcctgctgtgggctatagttacagtgttccagatcctgacccaggaggactggaataaagtgttgtacaacggcatggcttctacatcgtcttgggcggcgctgtactttattgccttgatgaccttcggtaactacgtgctgtttaacctactggtcgccatcttggtggaaggttttcaggcagaggagattagtaagcgggaagatgcttctggccaattgtcatgtatccagctgcctgtggattcacagggtggcgatgctaataagtccgagagtgaacccgacttctttagcccgtctttagatggcgatggtgacaggaaaaagtgcctggcgctagtgtctctcggagagcatcccgagctcaggaaaagcctcctgccgccactaattatacacactgcagccacaccaatgtctcttcctaagagcactagtacaggcctaggtgaggccttgggacctgcgagtcggagaactagctcttctggctcagccgagccaggcgccgctcacgagatgaagtccccaccatcagcacggagttcccctcactccccatggagcgcagcctcttcttggacgagcagacgcagcagccgcaactccttaggcagggcaccctcccttaagcgacggagtccctccggcgaaaggagaagtctgttaagcggagagggacaggagtctcaggacgaagaagaatctagcgaggaagagagggctagcccagccgggtctgatcataggcaccggggatcgctcgagagagaagctaaatcatcatttgacctcccagacacccttcaggtaccaggactccatagaacagcttccgggaggggttctgctagtgaacaccaggattgcaacggcaagagcgctagcggccgattagctcgtgctttgaggcccgatgacccacctctcgacggtgatgatgctgatgacgagggaaacctgtccaagggagaacgagttcgcgcctggattagagcgcggctgccagcctgctgcctcgagagagattcctggagcgcttacatttttccccctcagagcagattcaggctgttatgtcacagaatcataacccataagatgttcgatcacgtggtgcttgtgatcatttttctgaactgtattacaattgccatggaaaggcccaaaatagatccacattcagccgagcgcatatttctgaccctgagtaattatattttcacggctgttttcttggctgagatgacggttaaggtggtggctttgggctggtgcttcggcgaacaggcctatctgcggtcctcctggaatgttctggacggtctcctcgtgctgatctcagttatcgatattctcgtcagtatggttagtgactctgggacgaagattctgggcatgctacgggttttgagacttcttcggaccctgagacccctccgggtaattagtagagcacagggacttaaactggtcgtcgaaactctcatgtcatcccttaagcccattgggaatatcgtagttatttgctgtgctttctttattatcttcggcatccttggagtccagctgtttaagggcaagttctttgtgtgtcagggggaagatacgaggaatattacaaacaaaagtgattgcgcagaggcatcttaccgatgggtaaggcataagtataactttgacaacttggggcaggcactgatgtctctcttcgttctggcttctaaagatggatgggttgacatcatgtacgatggtctggacgctgtgggggtggaccagcaacccataatgaatcacaatccatggatgctgctttacttcatcagtttcctcctgatcgtggcctttttcgtcctgaacatgtttgttggggtcgtagtggagaactttcataagtgccgccaacaccaggaggaagaggaggcgagaaggcgggaggaaaagaggctacggcgcttggaaaaaaagcggcgcaaggcccagtgcaagccttactacagcgattatagccgattcaggttgctggtacatcatttgtgcaccagtcattacttagacctcttcattaccggtgtgattggtctaaacgtggtcaccatggcaatggagcactatcaacagcctcagatactcgatgaagcattaaagatttgtaattatatcttcacggtgatttttgtgcttgaatcagtttttaagctggtggcgttcgggtttagacgattctttcaggatagatggaaccaacttgacctggccatagttctgctctcaattatgggaatcactttggaggagatagaggtcaatgccagtttacctattaaccccaccattattagaatcatgagggtgctacgtatagctcgggtcctgaagctgctcaaaatggcagtcggaatgagggccctgcttgacaccgtcatgcaagcactgccacaagtggggaaccttggtctccttttcatgctactgtttttcatttttgccgctctgggggtcgagttattcggcgatctagagtgcgatgagacgcacccctgtgaaggactcggccggcacgccaccttccgtaatttcggtatggccttcctaacactgtttcgggtgagcactggggacaattggaacggcatcatgaaagacaccctgagagactgtgatcaggagagtacttgctataacacagtcatttctccaatatacttcgtgagctttgttctcaccgctcagttcgtgttggtgaacgttgttattgccgtgctgatgaagcacctagaggaaagcaacaaagaagccaaagaggaggctgaactagaagccgagctggagctggagatgaagaccctctctccccagccacactcccctctgggttctccctttctgtggcctggggtagaaggtcctgattcaccggactctccgaaacctggagcccttcatccagcggctcatgcgcgctccgcatcacacttcagcttggagcaccccacagaccggcaactgtttgataccattagcctccttattcaaggctccctggagtgggaacttaagctgatggacgagttggccggtccaggtggacagcctagcgcgttcccctcggccccgtcgctgggcgggtccgatccacagatgcagccacaccccaccgaattaccaggtcccgatttgttgactgtacgaaaatccggagtgagtcggactcactccctacccaatgacagttatatgtgccgccacggctccactgcagagggcccattggggcatcgaggatggggccttccaaaagcccaatccggctcagtcttgagtgtccattcacagcctgctgacacaagctacattttacagcttcctaaggatgctccccaccttttgcagcctcactcagctcccacatggggaaccattcccaaattacccccccccggccggagtcctctggcccaacgtccgctcaggcgccaagctgcgatccgcactgacagtctcgatgtccaggggctcggatcccgcgaggatcttctggccgaagtgtctggcccctccccccccctcgcaagggcatacagtttctgggggcagagtagtactcaggcacagcagcatagtcgctcgcattccaaaatctctaagcacatgacacctccggcaccttgtcccggccccgagcctaactggggtaagggaccacccgagaccagaagctctctcgaactcgatacagaactcagttggatctccggcgatctgctccctcccggtggtcaagaagagccccctagccctcgagatctgaaaaagtgttacagcgtggaggcacagagctgtcagcgccgtcctacgtcctggttggatgaacaacggcgtcactcaatcgccgtcagctgtctcgattcgggctctcagccgcacctcggcaccgacccctccaatcttggaggacagcccctggggggcccaggcagccgccccaaaaagaagctgagccccccaagtatcacaatagacccccccgagagccagggtccgaggactcctccatcgcccgggatttgcttaagacgccgggcaccctcttctgactcaaaggacccactggcttcgggtccgcccgactccatggccgcttctccaagtcccaagaaggacgtgctatccttatcgggactcagctccgacccagcggacttggacccctag

SEQ ID NO: 24747 - DNA, 6966 bp, Artificial Sequence
  Description of Artificial Sequence: Synthetic coding sequence
atggatgaggaggaggatggggccggggctgaggagtctggccagccccgaagtttcatgcgcctgaatgacctcagcggggccggggggcggcccggccccggatccgctgaaaaagatccaggctccgcggatagcgaggccgagggcctcccctacccagcacttgcgccagtggtatttttttacttaagccaggatagccgaccacggagctggtgtctgaggacagtatgtaatccatggtttgagcgtataagcatgcttgtgattctgttaaactgcgtgactttagggatgttcaggccttgcgaagacatcgcctgcgatagtcagagatgtcgtattctgcaggctttcgatgactttatttttgccttctttgctgtggagatggtggttaagatggttgctctcggtatctttggaaagaagtgttacctgggtgacacttggaatcggctggattttttcatcgtcattgctggcatgctcgagtacagccttgacttgcagaatgtgagtttttctgcagttcgaacagtgcgtgttttgcgccctcttagagctatcaatcgggtgcccagcatgcggatcctggtgaccctgctgctggatactctgcctatgctgggcaacgtgctcctactctgtttcttcgtatttttcatcttcgggattgttggagtgcaactgtgggctggcctgctgcgcaatcggtgttttctgcccgagaatttcagtctgccactgtccgtggacctggaacggtattaccaaaccgagaatgaggatgaaagcccctttatctgctctcagcctcgtgagaatggtatgagaagctgccgaagtgtacccacactacggggcgacgggggagggggacccccttgtggcctggattacgaagcctataactccagtagcaacaccacgtgcgtgaattggaaccagtactacaccaattgtagtgcaggtgaacacaatccgtttaagggtgccatcaacttcgataacatcggatacgcctggatcgcgatcttccaggttattactttagaggggtgggtcgatattatgtactttgtcatggatgcacactccttctataactttatctactttatcctgctcattattgtgggttccttctttatgataaacctgtgtctcgtggttattgctacccagtttagcgaaaccaaacagcgcgagtctcagctcatgagggaacagcgggtgaggttcctgtctaacgcctctacactcgccagtttttccgagccaggatcttgttatgaagagctgctgaagtatctggtctatattctccggaaggcagcacggcgtctggcccaagtaagcagagcagccggagtgcgagtggggcttctctcatccccggcccccctaggcggacaggagacacagccgtcttcctcttgctcaagatcacatcgtcgcctttctgtgcatcatctggtccaccaccaccaccaccaccaccaccattatcatctcggcaacggtacactccgagctccgcgagcatctccagagatccaggatagagatgccaatggtagtagacgcctcatgctgccccccccctccacccctgcgttaagcggagcaccgcctggaggagccgaaagtgtgcattccttctaccatgccgactgccacctcgaaccggtgaggtgccaggctccgccccccagatctccctcggaggcttctggaaggacggtcggctctggtaaagtatacccaaccgtccacacaagcccccccccagagaccctgaaggagaaagctctggtcgaggtggccgcctcgagcgggcctccgactctgacgagcctgaatatccctccgggaccgtatagcagcatgcataaattgcttgagactcaatctacaggtgcgtgccagagcagttgcaagatctcctccccttgtcttaaagctgactcgggagcttgcggccccgactcttgcccatactgtgccagagctggagccggagaggttgagctggctgaccgcgagatgccagatagcgattcagaggcagtatacgaatttacccaagatgcgcagcatagtgacctcagagatcctcactccaggaggcagaggagtttaggacccgatgcagagccatccagcgtgcttgctttttggaggttaatctgcgatacatttcgcaagatcgttgacagcaagtactttggccgcggcatcatgatcgcaatattggttaataccctgtcaatgggcatcgagtaccatgaacagcccgaagaactgacaaatgctctggagatcagtaatattgtgttcactagcttgtttgcgttggagatgctcctgaaactgttggtatacgggccattcggctatatcaaaaatccgtacaacatcttcgacggcgtgatcgtggtgataagtgtgtgggagattgtgggccagcagggcggtggtttatccgtgctgcgaaccttccgattgatgcgagttttaaaactggtcagatttctgcctgcattacagagacagctggtggtgctgatgaaaaccatggacaatgttgccaccttctgcatgctgttgatgctgttcatctttatctttagcattttaggtatgcatctgtttgggtgtaaatttgccagcgagcgggacggtgatactctcccagatcgcaagaatttcgatagtctgctgtgggcgatcgtaaccgttttccaaatcctcacacaagaagattggaacaaggtgctctacaacgggatggcgtctacatcatcatgggccgcattatatttcatcgcccttatgacttttggaaactacgtcctgttcaacctgttggtcgctatactggtggagggcttccaggctgaagagatctccaagagggaggatgcctcagggcagctgagctgtattcaacttcccgtggactcccagggaggcgatgctaacaaatctgaatcggagccagatttctttagtccatctctagatggggacggggacagaaagaagtgtctcgccctggtgagcctcggcgagcatccagaactgcggaagtcccttctccctccgctgataatacataccgcggcaacccctatgtcacttccaaagagcacaagcactggcttgggcgaggcgttggggccagcctcgaggcgtacaagcagctcaggatccgcggagccgggcgccgcccatgagatgaaaagcccaccctccgctcgcagcagtccccacagcccatggtcagcagctagcagctggactagcaggcgaagctctaggaatagcctgggaagggccccatcacttaagagaaggtccccctccggtgagaggaggtcattgttgtcgggggaggggcaagaatcacaggatgaggaggagagttcagaagaggagagagcaagtcctgccggctccgaccaccgccacagaggctcattggaacgggaggcgaaatcctcatttgacttgcccgatactctccaagtacccggactccatcgcacagccagtggcaggggttccgcctcggagcatcaggattgcaatgggaaatccgccagtggcagactggcccgcgctctgcgaccagatgatccacctcttgacggcgacgacgccgacgacgagggcaatctgagtaaaggagaacgggtgcgggcctggatacgggcaaggctgcccgcctgctgcctggagagggatagttggtccgcctacatctttccacctcagagtcggttcagactgttgtgccaccgcatcattactcacaagatgtttgaccacgtagtactggtgattattttcctgaactgtataaccatcgccatggagagacctaagatcgatccccacagcgccgaacgaattttcttgactctcagcaattatattttcactgccgtttttctggcagaaatgacagtcaaggtcgtggcacttggttggtgctttggagaacaggcctacttaagatcttcttggaacgtactggatgggctgctggttcttatctccgttatcgatatcctggtttccatggtaagcgactcaggcaccaagattttgggaatgctgagagtcctgcgtctcctgcgcaccctgcggccccttagagtcatctctcgcgcacaggggttaaaactagtcgtagaaacactgatgtccagcctgaaaccaatcggtaatatagttgtcatttgctgcgcattctttatcatatttggcatcctgggggtgcaattattcaagggtaagtttttcgtctgccaaggcgaggatacgcgaaacatcacaaataaatctgattgcgccgaagcttcatatcggtgggtccgacacaagtacaatttcgacaatctaggacaggctctgatgagcctttttgtgcttgcttcaaaagatggctgggttgatatcatgtatgacgggctggatgctgtcggcgtagaccagcagcccattatgaatcacaacccgtggatgcttctctattttatttctttcctgttgatcgtagccttttttgtgctgaacatgtttgtgggagtcgtggtggagaactttcataagtgccggcagcatcaggaggaagaggaagcaaggagacgggaggaaaaacggctgcggcgccttgagaaaaagagaagaagcaaagagaagcagatggcggaggcacagtgtaagccgtattattccgattactcacgatttaggctgcttgtccatcacctttgcaccagccactatttggacctattcatcacaggagtgataggcctgaacgtcgtaacgatggccatggagcactaccaacagccacaaatcctggacgaagccctcaaaatctgtaactacattttcaccgttatcttcgtgttagaatcggtgttcaagctcgtggccttcggattcaggaggttctttcaggacaggtggaaccagttagacctggccatcgtactgctttctatcatgggcatcaccttggaagagattgaggtgaacgccagccttccaataaatccaacgattatccgaattatgcgagtcttgagaatcgcccgggttcttaaactgcttaaaatggcagttggaatgagagctctgttggacacagtcatgcaggccctgccacaggtaggcaacttgggactcctcttcatgctgctcttcttcattttcgcagccttgggagtagaactcttcggtgatttggaatgcgacgaaacacacccatgtgagggactcggcagacatgcgacattccgtaacttcgggatggctttcctcacactgttccgcgttagtaccggcgacaactggaatgggatcatgaaggacacccttagagactgcgaccaggagagtacatgctataacactgttatctcaccaatttacttcgtgtcctttgtgcttacagcccaattcgtattggtgaacgtggtaattgccgtactaatgaagcatctcgaggaaagcaacaaggaggcgaaggaagaggctgaactggaggctgagctcgaacttgagatgaagaccttgagtccacagccccattcccccctgggctcgccattcctttggcccggcgtggaaggtccagactccccggactctccgaaacccggcgcactccaccccgcagcacacgctcggtccgccagtcatttttccctcgagcatccaactgatcggcagctgttcgatacgatttcactcctgatccagggctccctggagtgggagttaaagctcatggacgaactggccgggcccggaggacagccaagcgcctttccatccgctccgagcctggggggctctgatccgcagatgcagccacaccccaccgagctccccggccctgatctgttgaccgtaagaaagtctggagtatctaggactcattctctgcccaacgacagttatatgtgcaggcatgggagcaccgccgaggggccgctgggtcaccgaggctggggtctgcctaaggctcagagcggctctgtgctgtctgttcattcacagcccgcggacacaagttacatcctgcagctgcctaaagacgcccctcatcttttacagcctcactccgccccaacgtggggcaccatcccaaaactgccaccgcccggccgatcccctctggcccagaggccattaagaaggcaggcagctatcagaactgactccctggacgtgcagggcctcggaagtcgagaggatctgctggccgaggtgtccgggccctcccccccactggcaagggcatattcattttggggccaaagctcaacacaggcccagcaacatagcaggtcccattctaaaatcagcaagcatatgacacccccggccccttgccctggccctgaaccaaattggggcaagggtccgcccgaaacaaggtccagtctggagctcgatacagagctctcttggataagcggagatttgcttccccccgggggtcaggaagagcctccttccccgcgcgacctcaagaaatgttatagtgtggaagctcaatcctgccagcggaggcccacctcttggctggacgaacagcgccgccacagtatcgcagtgtcctgcttggactcaggctcacagccacacctgggtactgacccgtcaaatctaggtggacaacctctgggcgggccagggagcaggcctaagaaaaaactttctcctccatccattactattgaccctcccgagagccagggtccacgaacccccccctccccaggcatctgcttgcgcaggcgcgcacctagctctgatagtaaggaccccttggcatccggtccccctgattcgatggccgcttccccgtctcccaagaaagacgttttaagcttatctgggctgagtagtgatcctgcagacctggacccgtag

SEQ ID NO: 24748 - DNA, 1035 bp, Artificial Sequence
  Description of Artificial Sequence: Synthetic coding sequence
atggacaagttcaggatgctctttcagcatttccaaagcagctcagagtcagtgatgaacggtatctgcttgctcttggcggccgtgactgtcaagctatacagctcattcgatttcaattgcccctgtctcgtgcattataacgctttatatgggctcggcctgcttctgaccccaccactcgcgctgtttttgtgcggcttattggccaatcggcagtctgtggtgatggtcgaagaatggaggaggcccgcagggcaccgaaggaaagatcctgggattatccgttatatgtgcagctcagtgttgcagagggcccttgcggcgcctctggtttggatcctgctggcactgttggacggtaagtgctttgtttgtgccttttcctcctctgtggatcctgaaaagttcctggactttgctaatatgaccccatcccaggtgcaactgtttttagccaaggtcccctgtaaggaggacgagctggtcagggactctccggctcgtaaggcagtctcaagatatctgcgctgcctgagtcaagccattggctggtcagttacacttcttctgatcattgcggcattcctggcaagatgtttgcgcccctgtttcgaccaaacggtgttcctgcagcggaggtactggtctaattacgtggacctcgagcagaaactgttcgatgaaacatgttgtgaacacgcccgtgatttcgctcacagatgtgttcttcacttctttgccagtatgcgaagcgagctgcaggccagagggctgcgccgggggaatgctggtagacggttagagctgccagcggttcccgaacccccagaaggacttgattcaggcagcggaaaagcacacctgcgggccatctcctcccgtgaacaggtagaccggcttctatccacttggtacagttcaaaacctccactagacctcgctgctagcccagggctttgcggaggagggctttcccaccgggcgcccacactggctctgggcactcgcttgtcacaacacactgatgtgtag

SEQ ID NO: 24749 - DNA, 1431 bp, Artificial Sequence
  Description of Artificial Sequence: Synthetic coding sequence
atggggaggaaggaagaggatgactgctccagctggaagaaacagacaaccaacattcgcaagacctttatcttcatggaggttctgggaagcggcgcattttctgaggttttcttagttaagcagagacttaccggcaaactgttcgcactgaaatgtattaagaaatccccagctttcagggactcttctctcgagaacgaaatcgcagtgctaaaaaagatcaaacatgagaacattgtgactctggaagacatatacgagagtacgacccactactatctggttatgcagttagtttccggcggagagttgtttgaccgcatcttagagcggggtgtctacacagaaaaagatgccagccttgtgatccaacaggtgctgagcgcggtgaaatatctgcacgagaacggtatcgtgcaccgagatctgaagccagaaaacctgctctacctgactcctgaggagaacagtaaaattatgatcaccgatttcggcctgtcaaaaatggagcagaatggtattatgagtactgcttgcgggacccccggctatgtcgctcctgaagttctggctcagaagccctatagcaaagcagttgactgttggagcatcggagtgattacatacatcctgctctgtggatatcccccattttacgaggaaaccgagtccaaactgtttgagaaaattaaagaaggatattatgaatttgagtctcccttttgggacgacatctcagagtccgcgaaagacttcatatgtcatttgctggagaaagacccaaacgagcgatatacatgtgagaaagctttgtcccacccgtggattgatggaaacacagcgctgcatcgagatatctaccctagcgtcagccttcagatccaaaaaaacttcgccaaaagcaaatggcgccaggcttttaatgctgcagctgtggttcaccatatgcgcaaactccacatgaacctgcattcgccaggagtcagacctgaggttgaaaacaggccccccgagacccaggctagcgaaaccagcaggccgtccagccctgagataactatcaccgaggcccctgtgctagaccactcagtggccctccctgcactcacccagctaccctgccagcacggccggcggccgactgctcctggcgggcgatcacttaactgtctagtgaacggcagtctgcatatctcctcttctctggtgcccatgcatcagggctccctcgcagccgggccgtgcggatgttgtagctcctgtctgaacatcggtagtaagggcaaaagttcgtactgtagcgaacccactctgctgaagaaggcaaacaaaaagcagaacttcaaatccgaggttatggtcccagtgaaggcgagcggctcgtcacactgtcgcgcagggcagactggcgtgtgtctcataatgtag

SEQ ID NO: 24750 - DNA, 1431 bp, Artificial Sequence
  Description of Artificial Sequence: Synthetic coding sequence
atggggaggaaggaggaagatgattgctcaagctggaagaaacaaacaacgaatatcagaaagaccttcatcttcatggaagtcctggggtccggagctttctctgaagtgttcctggtgaagcaaagattgacaggtaaactctttgctctgaaatgcattaagaaaagccccgccttcagagattcaagtttggagaacgagattgctgtgctgaaaaaaattaagcacgagaacattgtgaccctcgaggacatctatgaaagcacgactcactattatctggtgatgcagcttgtttcaggcggcgaacttttcgatcggatcctggagaggggcgtctatactgaaaaggatgcctcattggtcatccaacaagtgctgtctgccgttaagtacctgcacgagaatggcattgtacaccgcgacctgaaacctgagaatcttctgtacctcacccccgaagaaaactcgaaaatcatgatcacagacttcggtctgagtaagatggaacagaacggaattatgagcactgcctgtggcacacccggttatgtagcccctgaggtgctggctcagaagccatactccaaggctgtggattgctggtcaattggagtcattacctacatccttttgtgtgggtaccccccattctacgaggagaccgagagcaagctgtttgaaaagattaaagagggatattatgagtttgaatcacctttttgggatgatatctcagaaagcgccaaagacttcatctgtcatcttttagagaaggatcccaatgagagatatacctgcgaaaaggccctgagtcacccttggatagatgggaacacagcattgcaccgcgacatctacccgagcgtgtccctgcaaattcaaaaaaacttcgccaaaagtaaatggcgccaggccttcaatgccgctgcggtagtccaccatatgcgcaagctccacatgaatcttcactctcctggggtaagaccagaggtggaaaacaggccccctgaaacacaggcaagtgagacatcccggccctctagtcccgagattactatcacggaggcccctgtccttgaccatagcgtagctctccccgcattgacacagcttccttgccaacacggccggagacccaccgcacccggaggtcgcagtctgaactgtctggttaacggatctttgcatatcagtagctctctggtccctatgcatcagggttcacttgctgctggaccttgtggatgttgtagcagctgcttgaatattgggagcaagggaaagtccagctactgttctgagccaactctgctgaagaaggctaacaaaaagcaaaattttaagtccgaggttatggtgcccgtcaaggcctcgggctcctcccactgccgagcagggcagaccggcgtctgcctcatcatgtag

SEQ ID NO: 24751 - DNA, 654 bp, Artificial Sequence
  Description of Artificial Sequence: Synthetic coding sequence
atggtgaagctcggatgttccttcagcggtaaaccaggaaaggacccaggagaccaggacggcgccgccatggactctgttcctctaattagtccacttgacatctctcagctgcagccccctctccctgatcaggtggtgattaagacacagaccgaataccaactgtcatcccctgatcaacagaattttccagatctcgagggacaacgtcttaattgttcgcatcctgaagaaggcaggcggttgccgactgcccgcatgatcgcgtttgcaatggcactcttaggctgtgtgttgattatgtataaagccatttggtatgaccaattcacatgccccgacgggttccttctgcgccacaagatctgtaccccgttaaccctggaaatgtattacacggagatggatcctgagcgccatcgtagcatcctcgccgctatcggggcatatccactgtcacggaagcacggcactgagactcctgccgcctggggggacggttacagagccgccaaggaagagagaaagggccctacacaagccggcgctgcagctgcagcaaccgaaccacccggcaaaccgtcagccaaggccgagaaggaagctgcaaggaaggcagcaggcagcgcagcacctccccccgcccagtag

SEQ ID NO: 24752 - DNA, 477 bp, Artificial Sequence
  Description of Artificial Sequence: Synthetic coding sequence
atggtcaagctcggttgttcctttagcggaaagcccggcaaagatccgggagatcaagatggcgccgctatggattccgtacccctgatttctccgctggatatctctcaactgcagccaccactgccggaccaggtggtgatcaagactcaaacagagtatcagttatcaagccctgaccagcagaacttccccgacctggaaggccagcgcctgaattgtagtcaccctgaagaaggcaggagggtgactacacctacaccgccaactgtggggacacaggaccggcgccgtcgctggaaagccgctgggggcgcttgggttccctctcgtcctgtgtggggcccattggcacttcgggaggaaagggtggctgtgagtcatcccgcccagagctggcctcatcgccttccctgcacgcatcaggccccctcccgcggctgtagatgtaggctgactaagcagtggcggtcatag

SEQ ID NO: 24753 - DNA, 375 bp, Artificial Sequence
  Description of Artificial Sequence: Synthetic coding sequence
atggttaagctaggctgcagtttttctgggaagcctggaaaggatcctggtgatcaggacggggccgctatggactccgtcccactgattagccccttggatatctcacaactgcagcccccactgcccgaccaagtggttattaaaactcaaacagagtatcagttgtcgagtccggatcagcagaattttccagacctcgaaggccagaggctgaattgcagccacccagaggagggtcgacgcctgcctaccgcccggatgatcgcatttgcaatggctttgctaggatgcgtgctcattatgtacaaggccatctggtacgatcagtttacatgccctgatggtttcctcctgcgaggccccgagttctag

SEQ ID NO: 24754 - DNA, 375 bp, Artificial Sequence
  Description of Artificial Sequence: Synthetic coding sequence
atggtcaagcttggatgcagcttttctggaaaaccaggcaaggatcctggcgatcaagatggagccgcaatggattcggttcctctgatctctcctctggacatcagtcagcttcaaccacccctgcctgatcaagtcgtgattaagacacaaacagaataccaattatccagtcccgatcaacaaaattttcctgatctggaggggcaacggctcaactgttcccatcctgaggaaggcagacggctgcctacagcacggatgattgcgtttgccatggcccttttaggatgcgtcttaattatgtacaaagccatctggtatgaccagttcacgtgcccggatggctttctgcttcggggcccagaattctag

SEQ ID NO: 24755 - DNA, 1833 bp, Artificial Sequence
  Description of Artificial Sequence: Synthetic coding sequence
atgcacttccaggcgttctggctgtgcctaggtctcctatttatctccattaatgccgaatttatggatgatgatgtggagactgaagatttcgaagagaatagtgaagagattgacgtaaacgaatcggagttgagctcagagatcaaatacaaaacaccgcaacctattggtgaggtctacttcgccgaaacctttgactccgggcggttggcaggatgggtgttatccaaagcgaaaaaggacgacatggatgaagaaatctctatctacgacggacgttgggaaatcgaagaattgaaggagaaccaggttcccggcgacagaggcttagtacttaaatcgagggcgaaacaccacgccatctcagccgttttggccaaacctttcatattcgctgataaaccactgattgtccagtatgaagtcaattttcaagacggtattgattgtggcggagcgtacatcaagctgttagctgatacggatgatctcatcttagaaaatttctacgataaaacatcctatattattatgtttgggcccgacaaatgcggcgaggattacaagctgcacttcatcttccggcataagcatcctaaaaccggggtgtttgaggaaaaacacgctaagccccccgacgtggaccttaagaagtttttcacagataggaagactcatctctacactctggtgatgaacccagacgacacttttgaggtgcttgtagatcagacagtggtgaataaaggcagtctcttagaggacgtggtcccacctatcaagccacccaaagaaattgaagacccaaatgataaaaagccggaggaatgggatgagcgcgccaaaattcctgatccttccgccgtaaaacctgaggactgggacgagtcagagcctgcccaaatcgaggactcttccgttgtgaagcccgccggatggctcgacgacgaacccaagttcatacccgaccctaatgctgagaagccagacgactggaatgaggatacagacggagagtgggaggcgcctcagatcctaaatccagcgtgccggatcggctgtggcgagtggaaacctcctatgatcgacaaccctaagtacaaaggcgtttggcgcccaccacttgtggacaacccaaactaccaaggcatctggtctcctcggaaaattcctaatcccgattatttcgaagacgaccatcccttcttactgacttcctttagcgccctgggccttgagctgtggagtatgacttctgatatctactttgacaacttcattatttgcagcgagaaggaggtcgcagaccactgggctgcagatggttggaggtggaaaataatgatagccaatgctaacaaacctggggtgctgaagcagcttatggccgctgctgagggccacccttggctgtggctgatatacttggtcacagctggggtgcctatcgccctgatcacttcgttttgctggccaagaaaggtcaagaaaaagcacaaggataccgagtacaagaagacggatatttgcatcccacagaccaagggtgtgcttgagcaggaagaaaaagaagagaaggctgccctggagaagccaatggaccttgaagaagagaagaagcaaaacgacggggagatgcttgaaaaggaggaggaaagcgagcctgaagagaaatctgaagaggagatcgaaatcattgaaggacaggaagagagcaatcaatctaataaaagcggtagcgaggacgaaatgaaagaagcagacgaaagcacggggtcgggcgacggacctattaaaagcgtgcgcaagagacgtgtccggaaagactag

SEQ ID NO: 24756 - DNA, 1833 bp, Artificial Sequence
  Description of Artificial Sequence: Synthetic coding sequence
atgcacttccaggccttctggttatgcctgggtcttctgtttatatcaattaatgccgaattcatggatgacgacgtcgaaacagaggactttgaggaaaattcggaagaaattgatgtcaacgagtctgaactgtcgtccgagataaagtataaaacacctcagccaataggggaagtatattttgccgagactttcgactctgggcgtttagccggatgggtgctgtcaaaggcaaaaaaagacgatatggatgaggaaatttcgatttatgacgggaggtgggaaattgaggagctgaaagagaatcaggttcccggtgatcgcggtctcgtgctcaagagcagagctaagcaccatgccatttctgcagtactggcaaagcccttcatcttcgcagacaaacctctgatcgtccaatacgaagtgaacttccaagacggcatcgattgtggaggagcatatattaagcttctggcagacacagacgacctcattctggagaatttttacgataagacaagctacattatcatgttcggacccgataagtgcggagaagattacaaactgcattttatctttcgtcataagcatccaaagaccggcgtgttcgaggagaagcatgctaaacctcctgacgtggacctgaagaagttttttacggaccgcaagacccacctgtatacgctggttatgaaccccgatgacacattcgaagtgctggtggatcagacagttgtaaacaaaggatcactgctggaggacgtggtgcctcccatcaagcctcctaaggagattgaggacccaaacgacaagaaaccagaagaatgggatgaaagggcaaaaatcccggatccttctgcagtgaagccagaggattgggacgagtccgaacccgcacaaatcgaggattcctctgtggttaagccagcgggatggctggacgacgagcccaagtttattcctgatccaaacgctgagaagcccgatgactggaatgaagatacggacggtgaatgggaggccccgcagattctcaatccggcttgccggatcggatgtggagagtggaaacctcctatgatagataatccaaagtataagggggtgtggcggcctcctttggtagacaatcctaactaccagggaatctggtcccctagaaagatccccaacccagattatttcgaggacgatcacccattcctcctgacttctttctctgcccttgggctagagctctggtcaatgacctctgatatctactttgataacttcataatctgttcagagaaagaagtcgccgaccattgggccgccgacggatggagatggaaaataatgattgccaatgctaataagcccggagtgctgaagcagctaatggctgctgctgaaggtcacccctggctgtggttaatctacttagttaccgccggggttccaatcgcgctgattacatccttttgctggcccaggaaggtcaagaagaagcataaggatacagaatacaagaagaccgacatctgcataccccaaacgaagggagttctcgagcaggaggaaaaagaagaaaaggctgcccttgagaaaccaatggacctggaagaggagaagaagcagaatgacggggagatgttggaaaaggaagaggagagtgaacctgaggagaagtccgaggaggagatagagatcatcgagggacaggaagaatccaaccaatcaaataaatccggaagcgaagatgagatgaaggaagcagacgaatccacaggatcaggcgacggccccatcaaaagcgtgaggaaaaggcgggtgcgaaaggactag

SEQ ID NO: 24757 - DNA, 540 bp, Artificial Sequence
  Description of Artificial Sequence: Synthetic coding sequence
atgcattttcaggctttttggctgtgcctcgggctgctcttcatctccatcaacgcagagttcatggacgacgatgtggagacagaagactttgaagagaattctgaagagatcgacgttaacgagtccgagctgtcttcagaaatcaaatacaagacgccccagcccatcggtgaagtatacttcgcagagacctttgattccggcaggttagccggctgggtgctcagcaaggccaaaaaggatgacatggatgaagaaattagcatctatgacgggagatgggagatcgaagagctgaaggaaaatcaggttcccggagacagaggtctggtgctcaaatcacgggctaagcatcacgcgatcagcgctgtgcttgctaaaccattcatattcgccgacaagcccctcatcgtgcagtatgaagtgaacttccaggacgggattgattgcggcggggcctatattaagctactggcagataccgatgacctgattctggagaacttttacgataagacaagctacattattatgtag

SEQ ID NO: 24758 - DNA, 1833 bp, Artificial Sequence
  Description of Artificial Sequence: Synthetic coding sequence
atgcactttcaagcattctggctttgtttagggttgcttttcatttcaattaatgcagagttcatggatgatgacgtcgagactgaagatttcgaggagaattctgaggagattgacgttaacgagagcgaactgagctccgagatcaaatataagactccacagcccatcggagaagtgtacttcgccgaaaccttcgacagcggaagactggccggttgggtactatctaaggccaagaaagacgacatggatgaagagatttctatctatgacgggcggtgggagatcgaagaattgaaggagaaccaggtgcccggagaccgtggcctcgtgttaaagtcacgtgcaaaacaccacgcaatttccgctgtgctcgcaaaaccctttatcttcgctgacaagccgcttatcgttcagtacgaggtaaactttcaggacggtatcgactgcggcggcgcttatatcaagctgcttgctgacaccgacgatctcatcttagaaaatttttatgataagacatcttatattattatgtttggccctgacaagtgtggggaagattacaagctgcatttcatctttagacataagcacccaaaaaccggggtctttgaggagaaacacgctaagccccccgatgtggacctgaagaagtttttcacagaccggaagactcacttgtacactcttgtgatgaaccccgatgacacatttgaggtcctggtagatcagacagtggttaataagggaagtcttctggaagacgtggtgcctcccattaaacctcccaaggagatcgaggaccctaatgacaaaaaacctgaagagtgggacgagcgcgccaaaattccagacccaagtgcagtgaagccagaggattgggatgagagcgaacccgcccagattgaagactcgagtgtagtaaaacctgccggctggctcgacgacgagcccaagtttattcctgatcctaacgccgagaaacccgacgattggaacgaagatacagacggcgaatgggaagccccccagatcctgaaccctgcttgtaggatcggctgcggagagtggaaacctccaatgatcgacaaccccaagtacaagggagtgtggagaccgcccctggtggataatcctaactatcagggaatttggtcccctagaaaaatccccaaccccgattacttcgaggacgaccaccctttcctcctcaccagcttttcggcactggggctggagctttggagcatgacctctgacatatattttgataacttcattatatgttcagagaaggaggtcgcagatcactgggccgcagatgggtggcgatggaaaatcatgattgccaatgctaataaaccaggcgtccttaagcagctcatggcggccgccgaggggcacccatggctttggttaatatatctcgtcaccgccggcgtgcccatcgccctaatcacaagcttttgctggccccgcaaggtgaagaaaaaacataaggataccgaatacaagaagactgatatatgcatcccccagactaagggcgtactggaacaggaggaaaaggaggagaaggccgctctagagaagcctatggaccttgaagaagaaaagaaacagaatgacggtgagatgctggaaaaggaggaagaatccgagccagaggagaagagtgaggaagagatcgagatcattgagggccaggaggaatcaaaccagtcgaataaatccggcagcgaagatgaaatgaaagaggcagacgaaagcaccggctctggcgatgggcccatcaagagcgtgagaaagcgacgagtccggaaggactag

SEQ ID NO: 24759 - DNA, 1584 bp, Artificial Sequence
  Description of Artificial Sequence: Synthetic coding sequence
atggatgaagaaatcagcatttatgacggcagatgggagattgaggaactgaaagagaatcaagttccgggtgatcgcggcctggtgctaaaatctcgcgccaaacaccatgccatttctgccgtcctagctaagccatttatattcgctgataagcctcttattgtacaatatgaggtgaatttccaggacggaatcgactgtggaggcgcctacattaaactgctggccgatacagatgatttgatcctggaaaacttttatgacaagacaagttacatcataatgtttggcccagataagtgcggggaggactataagctacactttatcttccgccacaagcaccctaagactggcgtgtttgaagagaaacacgccaaacccccagatgtggacttgaagaagttcttcacagatcgcaaaacgcatctttacacactagtcatgaatcccgatgatacatttgaagttcttgtggaccagacagttgtgaacaagggatctttactcgaggatgtcgtgccccctataaaaccccccaaagagattgaggacccaaatgataagaaacccgaggaatgggatgagcgggcgaaaattccagatccctctgccgtgaaacctgaggattgggacgagagcgagcctgcccagatcgaagacagcagcgtggtgaaacccgctggctggttagatgatgagcctaagtttatacctgatccgaacgccgaaaagcccgatgattggaatgaggacaccgacggcgagtgggaagccccccagatactgaatccggcctgtagaattgggtgcggggaatggaagcccccaatgatcgataatcctaaatacaagggagtgtggagaccccctttggtagacaatccaaattaccaaggcatctggtccccaagaaaaatccccaatccagactacttcgaagacgatcaccctttcctcctgacatccttctccgcgttgggcctcgagctgtggtcaatgactagcgatatctacttcgacaactttatcatctgctcggagaaggaggtggccgatcactgggcagccgacggatggagatggaagatcatgatcgcgaacgcgaacaagcctggtgtactgaaacagttgatggcggcagccgagggccacccttggttgtggttgatatatcttgtgactgcaggggtgcctattgccctgatcacttcgttctgttggccccggaaggtgaagaaaaaacacaaagacacagaatacaagaagaccgacatatgtatcccccagaccaaaggggtcttggaacaggaggagaaggaagaaaaagctgcgcttgaaaagcccatggacctggaggaggagaagaagcaaaatgatggggaaatgctggaaaaagaggaggagtccgagccagaggaaaagtctgaggaggagatcgagatcatagaaggtcaagaggaaagtaaccagtccaataaaagcggaagcgaagacgagatgaaggaagctgacgagagtactggcagcggcgacgggcctattaaaagtgtgcggaagagacgagtgagaaaggattag

SEQ ID NO: 24760 - DNA, 3750 bp, Artificial Sequence
  Description of Artificial Sequence: Synthetic coding sequence
atggttgaagccgcccctcccggccctggcccgttgcgacgaactttcctggtgcctgaaatcaaatccctggatcagtatgacttcagccgtgccaaggccgctgccagcctggcctgggttttgcgggccgctttcggaggagcagagcacgttccaccggaactgtgggagccattttacacagaccaatatgcacaggaacatgtcaagcctcctgtgactaggctacttctgagcgcagagctgtattgtagagcctggcgccaggccttacctcagcttgaaacccctcctaatcccagtgctctacttgcactactggctcgccgcggtacggtaccagcccttcctgaacgacccgtcagagaagctgatcttcgtcaccaacctatccttatgggcgcacatctggccgttatagatgccctcatggctgccttcgccttcgagtggaccaaaaccctgccaggtcctctggctctcacaagcctggaacataaacttctgttttgggtcgacacgaccgtaaggagactgcaggaaaagacggagcaggaagcagcacagagggctagccctgcagcgcctgctgatggggccgcgcctgcccagcctagtattaggtatagaaaagacagggtggtggctcgcagagcaccctgcttccccactgtcaccagcctacaggacctggcctctggcgctgccttagcagcgacgatacactgttattgcccccagcttttgagactcgaggaagtgtgtctgaaagatcctatgtccgtggccgattcactgtacaatctccagctggtgcaggatttttgtgcctcacgtcttcctcgagggtgcccactgtcacttgaggacctactctatgtgccgccccccctgaaggttaacctcgtggttatgttagccgagctattcatgtgctttgaggtcttgaaaccagattttgtgcaagtcaaagatctgcccgatggccacgccgccagccctcgaggaactgaggctagcccccctcagaacaatagcggctcttcgagcccggtgttcacattccgccaccctctgctttcttctggcggaccccagtctcccctgagagggtctaccgggtccctgaagtctagcccatccatgagtcacatggaggctctgggcaaggcgtggaaccgacagctgagtcgccccttaagtcaggctgtatctttttccaccccctttgggcttgattcggacgtcgacgttgtgatgggagaccctgtgctgctgagatccgtaagtagcgatagcttgggtcctccacgacccgcccccgccagaaccccaactcagccccctccagaacccggggatttgccaaccatcgaggaggccctgcagataatccactctgcagaaccacgactactcccagatggggccgccgacgggagtttttacctgcatagccccgagggtccttccaaaccatctctggccagtccatatctgccggagggaacctctaagcccctgagtgatagacctaccaaagcgcccgtctatatgccacacccagaaacaccttccaaaccctccccatgtctcgtcggggaagcttccaaaccccccgcaccttccgaagggagtcctaaagctgtcgccagcagcccagcagcaacaaattcagaagttaagatgacctctttcgccgagcgcaaaaaacagctcgttaaggccgaggcagaggctggggctggctcgcctaccagtactcctgcaccccctgaagctttgtcaagcgagatgtccgagttgtcagcaaggttggaggaaaaaagacgtgccatcgaggcccagaaacgtcgtatcgaagcaattttcgcaaaacaccgccagcgcctgggaaaatcagcgtttctgcaagtccagccacgggaggcttcgggagaggccgaagccgaggccgaggaagcagacagcggacccgtgcccggcggagaacgccctgccggtgaaggccagggtgagcctacttctcgccctaaagcagtcacattttcacctgacctcggccctgtcccccatgaggggctcggcgagtataatagggcagtctccaagctctcggctgcactgagcagcctccagcgggacatgcagcggctgacagaccaacagcagagactacttgccccgccggaggccccaggttctgcacccccccccgccgcttgggtgatccctgggccaacgactggcccaaaggcagctagcccttctccagccaggagggtgccagccactcgccgtagtcctggcccaggaccatcccaatctccaagatcccccaaacatacccgtccagccgagttgcgattagccccactgactagagttctgaccccgcctcacgacgtggactccctgcctcacctgagaaagttcagccctagccaagtgccagtgcagacccgttcaagcatccttttggccgaagaaacgccaccagaagaacctgcagcacgacccgggcttatcgagattcccctgggctcattggccgaccccgctgccgaggatgaaggagacggaagcccagcgggtgcagaggatagcctcgaggaggaagcaagcagtgaaggtgagccacgtgtagggctaggcttcttctacaaggatgaggacaagcctgaagatgagatggcccagaagcgggctagccttcttgagcgtcagcagcggagagcagaggaggcccgaaggagaaaacagtggcaggaagtggaaaaagagcaaagaagggaagaggcagccagacttgcgcaggaagaggcgcctggacccgcccctctggtatctgccgtgcccatggcaacacccgcaccagcagcacgggcccctgcagaggaggaagtaggcccgaggaaaggggactttactaggcaggaatacgaaagacgggcacagctaaaactcatggacgaccttgacaaggtgttgcgaccaagagctgcggggtccggcggtcccgggaggggcggaagaagggccacccgccctagatctgggtgttgcgacgacagcgctctggcaaggagtcctgctcgaggattactaggatctcgcctctcaaaaatctatagccagtctacactaagcctttcaactgtggcgaacgaggctcataacaatctcggggttaagagacctacatctcgggctccgagtccgtccggcctcatgagcccgtccagactccctggatcacgcgaaagagattgggaaaatggcagcaatgccagcagtcctgcctcagttcccgagtacaccggcccccgcctgtataaggagcccagcgccaagtcgaacaagttcatcatccataatgctctcagccattgttgcctggccggaaaagtgaatgaaccacagaagaaccgaattctcgaagagatcgaaaaaagcaaagctaatcactttctaatcttattcagggactcaagttgtcagttcagagccctgtatactctgtccggcgaaactgaggagctttctcggctcgctgggtatggacctagaacggtgacaccggccatggttgagggaatctacaagtataacagtgatcgaaaaaggtttacacagatcccagcaaaaactatgagcatgtctgtagacgcattcacgatccagggacatctgtggcagggcaagaagccaacaacacctaaaaaggggggaggtacccctaagtag

SEQ ID NO: 24761 - DNA, 3831 bp, Artificial Sequence
  Description of Artificial Sequence: Synthetic coding sequence
atggtcgaggcagccccccctggacccgggcccctgagacgcaccttcttggtgcctgaaatcaagagcctggatcagtatgatttctcccgtgccaaagccgccgcaagcctcgcttgggtgttgagggctgccttcggaggcgctgagcatgtgcccccggagctatgggaacctttttacactgaccaatacgcccaggaacatgtcaagcctccagtaacacggctgctactcagcgccgagttatactgccgtgcctggcggcaggccctaccccaactcgaaacaccacctaatccgtccgccctgctggccctgctggcaagacggggcacagtgcctgcactcccagagcgaccggtgagggaagccgacttacgccatcagccaattctcatgggtgctcacctcgcagttatcgatgctttgatggcggcttttgcgtttgaatggactaaaactttgccgggacccctagctctcaccagtctggagcacaagttgctgttttgggtcgacaccactgtgcgccgactgcaagaaaagaccgagcaggaggctgcccagcgtgcgtcacctgcagctccagcagacggggccgctcctgcgcagccctcctgccccacccgctggtattggaaactagtgcctcatgccatcgctttctgtttaaaggagagcggatcgaaacctcccatgattcgttatcggaaggatagggtcgttgctcggcgggctccgtgctttccgactgtgacatcacttcaagatcttgcttcaggtgccgctcttgcagccacgattcattgctactgccctcagcttctgcgactggaagaagtgtgcctcaaggaccctatgtcggtagctgatagtctgtacaacctacaattggtacaggacttttgcgccagtcggctgccgcggggttgcccgctttctttggaggatctcctgtacgtgcctccacccctgaaggttaatctggtggtgatgcttgccgaattattcatgtgcttcgaggtcttaaaacccgattttgtacaagttaaggacctgcccgatgggcacgctgctagccccaggggcacagaggcgagccccccacagaacaacagtggctcaagcagcccggtgttcacattccgccatcccttgctgtcctctgggggaccgcagagccctttgcgaggctcgacaggttcccttaagtcttcgccttccatgtctcacatggaggctctgggaaaggcatggaatcgccagttgagcagaccactgtcacaggccgtaagcttttcgactccctttggactggattctgatgttgatgttgttatgggggatccggtgctgctacgttcagtctcctcagacagtctaggaccacctcgaccagcacccgcgcggactcccactcagccgccacctgagcccggcgacctgccaactattgaagaggccctgcagatcatccactctgcggagcctagactcctccctgatggggccgcagatggttccttttatctgcactccccagagggcccctctaagccttctctagcaagtccctacctgccagaaggaactagcaaacctctgagcgatcggcctacaaaggctcccgtgtacatgccacaccccgagacaccatcgaagccctccccctgtctcgtgggggaggcttcaaaacctcccgcgccttccgagggctcacccaaagccgttgcgtcaagccctgccgcaaccaattccgaggtgaagatgactagctttgccgagaggaagaaacagttggtcaaagctgaggctgaagccggtgccggcagccctacctccacaccggccccgccagaagccctctcttctgagatgagtgagttgagtgctcgtcttgaggaaaagcgcagggcaattgaggcacagaagcgcaggattgaagccatctttgcaaagcatcggcaacgcctgggaaaatcagccttcttgcaggtgcagccccgggaggctagcggcgaggccgaagcagaggcggaggaggctgattccgggcctgtccctggcggtgaacgccctgccggggaggggcaaggggagccaaccagtaggccaaaggccgtgaccttcagcccagatctcgggcccgtgcctcatgaaggcttgggagaatataaccgtgccgtcagcaaactgtccgcagcgctttcttctctgcagagggacatgcagcgattgactgaccaacaacagagactgcttgccccaccagaggcaccgggctctgcgccccccccggccgcttgggtaattcctggtccaacgactgggcctaaggcagcctccccatccccagctaggcgagtgcctgccacaaggcgtagtccaggtccgggcccttctcaaagtcctcgatccccgaagcacacgaggcccgctgaacttagactcgccccactgaccagggtcttgacccctccgcatgacgtcgattcactgccccaccttcgcaagttcagtccatcgcaggtgcctgtgcaaaccaggagcagcattttgttggcagaggagaccccccctgaggaaccggccgcgcggcccgggctgatagagattcctctgggcagcctggcggatccagcagcagaagacgagggagatggaagtcccgcaggggctgaggactccctcgaggaggaggccagctctgagggcgaacctcgcgtggggctcggcttcttttataaggacgaagacaagcccgaggatgagatggctcagaaacgagcatctctgttggaaaggcagcaaaggcgggccgaagaagccaggcgacgaaagcagtggcaggaggttgaaaaagagcaacgacgtgaggaagccgcaagacttgcacaggaagaagcaccgggacctgcgcctctcgtgagcgcagtgcccatggctaccccagcaccagccgccagggctcccgctgaagaggaagtcggacctcggaagggggactttactcggcaggagtacgagcggcgcgcgcaactcaaactaatggatgacctggacaaggtgcttaggcccagggccgctgggagcggaggccctggtagaggtggacgccgcgcaacacggcccaggtccggctgttgtgatgattccgccctggcccggtcccccgcccggggattactgggctctcgactctcgaagatctacagccagagcactttatccctttctaccgtcgccaacgaggcccataacaatctgggggtaaagagacctacttcaagggcccccagcccctctggtctcatgtctcccagccggctacctggatcaagagagcgcgactgggagaacggatccaatgccagttcaccagcatccgtgccagaatataccggaccccggctgtataaggagccgtcagccaagagcaacaaattcattatacataatgcgctgtctcactgttgcctggctggcaaggtgaacgagccacagaaaaacaggatcctggaggagatcgaaaaatccaaagccaatcacttcctgattctgtttagggactcttcttgccagttcagggccctgtacaccctgagcggagagacggaggagctgagccggcttgccggatacggcccgcggaccgtgacacctgcgatggtggagggcatctataaatacaattcggatcgtaaacgatttacacagatcccagctaaaactatgtctatgtccgtcgatgcctttactatccagggacacctatggcaaggtaagaagcctaccaccccaaagaaaggcggcggaacacccaagtag

SEQ ID NO: 24762 - DNA, 660 bp, Artificial Sequence
  Description of Artificial Sequence: Synthetic coding sequence
atgcccttccaccacgtgacagcaggccttctatataaaggaaactaccttaaccggagcctgtcagccggctcagattctgaacaacttgcaaatattagtgtcgaggaattggatgagattcgcgaagccttccgtgttcttgatcgagatggtaatggtttcatcagcaagcaggagctgggcatggccatgcgcagtttagggtatatgccttctgaagtggagctggccattataatgcagcgcctggacatggacggtgatggtcaggtggatttcgacgagtttatgacaattttgggacccaagctggttagttcagaaggaagagacggcttcctcggtaatacaatcgactcaattttctggcagtttgacatgcagcggattactctggaagaattgaaacacattctctatcacgcatttagagatcacctcaccatgaaggatatagagaacatcataatcaacgaggaagagtccttgaatgagaccagcggaaattgtcagaccgagttcgaaggtgtccattcacagaagcagaaccgtcaaacatgcgtacgaaagagcctgatctgcgcctttgccatggctttcataatcagcgttatgctcatcgctgccaatcagatacttaggagcgggatggagtag

SEQ ID NO: 24763 - DNA, 786 bp, Artificial Sequence
  Description of Artificial Sequence: Synthetic coding sequence
atgcgacttccagagcagcccggcgaggggaaacccgagaacgaaaaaaagggcgatggcggagccttgggggggggtgaggaacctccacgttcacaggctcccgatttcccaacgtgggagaagatgccctttcatcacgtcactgcaggcctgctgtataagggtaactaccttaatcgctcacttagtgcggggtcagatagtgaacaacttgccaacattagcgtagaagaactggacgaaattagggaggcctttcgcgttctggaccgtgacggcaacggcttcatttccaagcaggagttgggtatggctatgcggagtttgggatatatgccttctgaagtagaactggccattatcatgcagcgccttgatatggatggtgacggtcaagtggacttcgacgagtttatgaccatattgggcccaaagcttgtgtcaagtgagggacgagacggttttctggggaacacgattgattccatcttttggcaatttgacatgcagcggatcactttggaggagctgaagcacatcttgtatcacgctttccgggaccacctgactatgaaggacatcgaaaacattatcattaatgaggaagaatctttaaacgaaacgagcggaaattgccaaactgaattcgagggggtgcactctcagaaacaaaaccgacagacctgcgtacggaaatccctgatctgcgccttcgcaatggcttttatcataagcgttatgctgattgccgctaatcagatcctgagatcaggaatggaatag

SEQ ID NO: 24764 - DNA, 660 bp, Artificial Sequence
  Description of Artificial Sequence: Synthetic coding sequence
atgccttttcatcatgtgactgctggcctcctatataagggaaactacttaaaccgatctctgtctgcagggagtgacagcgagcaactggcaaacatttccgtggaagaactggacgaaatacgggaggcattccgggtgctggaccgcgatggtaatggctttatctcaaaacaagagctaggcatggccatgaggagcctcggatatatgcctagcgaggtggaattggccatcatcatgcagcgtctggatatggatggagatggacaggtggattttgacgagttcatgaccatcctgggaccaaagctggtgtctagcgaaggaagagacggctttttgggcaacaccatcgattcgatcttctggcagttcgacatgcagcggattacactggaggagctgaaacacatcctgtaccacgctttcagggaccacctgacgatgaaggatatagagaacattatcatcaacgaggaagagtccttaaatgagacctctgggaattgccagacggagttcgaaggcgtgcacagtcaaaagcaaaaccggcagacctgtgtgagaaaatccctcatttgtgcgttcgccatggccttcatcatatcagttatgctgatcgctgccaatcaaattttgagaagcggtatggaatag

SEQ ID NO: 24765 - DNA, 660 bp, Artificial Sequence
  Description of Artificial Sequence: Synthetic coding sequence
atgccttttcaccacgtgacagctggactgctgtacaagggaaattaccttaaccggagcctgtctgcagggtctgacagtgagcagctggctaacatatccgtcgaggaattggacgaaatacgcgaggcatttcgggtccttgatagagacggcaacggattcatatcgaaacaggaattgggcatggctatgcgctccttgggttacatgccaagtgaagtggagctggctataatcatgcagcgtctcgatatggatggagacggccaggttgatttcgacgagttcatgactattcttggccctaagctggtaagtagcgaggggcgcgacggctttcttggtaacaccatagattccattttttggcagttcgatatgcagcgcattacactcgaggaactcaagcatattttgtatcacgccttccgcgaccatctgactatgaaagacatagaaaatatcattataaatgaggaagagtcactgaacgagacttcagggaactgtcagaccgagttcgagggcgtacactctcagaagcagaatcgtcagacttgtgtacgcaagtctctgatatgtgctttcgcgatggcgttcataatttcagtaatgctgatcgcagctaaccaaatccttaggtcaggcatggaatag

SEQ ID NO: 24766 - DNA, 786 bp, Artificial Sequence
  Description of Artificial Sequence: Synthetic coding sequence
atgcgcctgcccgaacagccaggcgaaggcaagcccgagaacgaaaagaaaggggacggaggcgcactgggggggggggaggagccgcccaggagtcaggctccggatttccctacatgggagaagatgcccttccaccatgtgaccgctggactcctgtataagggcaattatcttaataggagcctgtccgcgggctctgactccgaacagctggctaacatttccgtagaagagctggacgagatccgtgaggcattcagagtgttggatcgggacggcaatggcttcattagtaaacaggaattaggaatggcaatgaggagtcttggatatatgcctagtgaggtggagctggctatcatcatgcagcgcctcgatatggacggggacgggcaagtggactttgatgaatttatgacaattctcggcccaaagctggttagctcggagggccgcgacggttttctgggaaatacaatcgactcaatcttctggcagttcgatatgcagagaatcacattagaggagctcaagcatatcctctaccacgccttccgggatcatttaaccatgaaggatatagaaaacatcattatcaatgaggaagaatctcttaatgaaacctccgggaattgccagaccgaatttgagggtgtgcactcccaaaagcagaatcggcagacatgcgtgcgaaagtcccttatatgtgcatttgcaatggcattcattatctcagtgatgttgattgccgctaatcagatactccgcagcgggatggaatag

SEQ ID NO: 24767 - DNA, 660 bp, Artificial Sequence
  Description of Artificial Sequence: Synthetic coding sequence
atgcccttccatcacgtgaccgcaggacttttatacaagggcaattatcttaacaggtcactctcagcaggatccgacagcgagcagctagccaatattagcgtggaggagctggacgaaattcgggaagccttcagagttttggacagagacggcaatggttttatttccaagcaggagctgggcatggccatgcggtctttaggttacatgccctctgaagtggagctagctatcatcatgcagaggcttgacatggacggcgacggtcaggttgatttcgatgagttcatgactatcctcggccccaagctggtctcaagtgagggcagggacggttttcttgggaatacaatagactctatcttttggcagttcgatatgcaacggattaccctggaggaactcaaacacattctttatcacgcctttcgcgatcatctcaccatgaaagacatcgagaacattattatcaacgaggaagagtccctgaatgaaacatcaggaaattgtcagactgaattcgagggagtccactcccagaaacagaaccgacagacatgtgttaggaaatcgctgatatgtgccttcgctatggctttcattatttctgtgatgctgatagcggctaaccaaattctcaggagcggaatggaatag

SEQ ID NO: 24768 - DNA, 378 bp, Artificial Sequence
  Description of Artificial Sequence: Synthetic coding sequence
atgcccttccaccacgtaaccgcggggcttctgtataagggaaattatctcaacaggagcctgagcgcaggcagcgattcggagcagctggctaatatttctgtggaggaacttgacgagatccgggaagcatttcgggtcctggaccgggatggaaacggctttatctcaaagcaggagttggggatggctatgcgctcgctgggctacatgccaagcgaagtcgaacttgccattatcatgcagcgccttgacatggatggagatgggcaggtagacttcgacgagtttatgaccatcctggggcctaaactcgtctcctccgagggccgtgatgggtttctggggaacacaattgactcgatcttttggcagtag

SEQ ID NO: 24769 - DNA, 747 bp, Artificial Sequence
  Description of Artificial Sequence: Synthetic coding sequence
atgtttctggctaaagcacttctcgagggggccgatcgcggtctcggcgaggccctgggtggcctctttggggggggaggtcaaagacgtgaaggcggtggaagaaacattggggggattgtgggcggcattgttaactttatttccgaagccgctgctgcacaatatacgcccgaacctccaccaactcaacaacacttcacaagcgtcgaggcctccgagtccgaagaagtgagacgtttcagacagcagttcactcaactggctggccccgacatggaggtcggcgccactgatcttatgaatatcttgaacaaagttctgtccaagcacaaggatctcaaaactgacgggttttcgctcgacacgtgtcggagcatagtcagtgtgatggacagcgacacgacgggaaagctgggcttcgaggaattcaagtatctatggaacaacataaaaaaatggcaatgcgtgtacaaacagtatgaccgggatcattccgggtccctcggctcctcccaacttcggggagctcttcaagccgctggctttcagcttaatgagcagctgtaccaaatgatcgtacggcgatacgctaacgaagacggcgacatggacttcaacaattttatcagttgtctggtgaggctagacgccatgttcagggctttcaagtccctggatcgcgatcgggacggcttaattcaagtatccatcaaggaatggttgcagctgaccatgtatagttag

SEQ ID NO: 24770 - DNA, 2868 bp, Artificial Sequence
  Description of Artificial Sequence: Synthetic coding sequence
atgcttcccgggaggctgtgctgggtacctctactgctggctctgggagtcggctccggctccggcggcgggggggacagccgacagcggcgactcctcgccgcaaaagtcaacaaacataagccttggattgaaacttcataccacggcgtaataaccgagaacaacgacaccgtgatactcgatcccccccttgtggcgctggataaggatgcgcctgtgccttttgccggcgaaatctgcgcattcaaaattcacggtcaggagctgccattcgaggcagtagtgttgaataaaacctccggtgaagggcgcctgcgggccaaatctcctattgactgcgaactacagaaggagtatactttcatcatccaggcctacgactgcggggcaggcccccacgagacagcgtggaagaaatctcacaaggccgtcgttcatatacaagttaaagatgtgaacgagttcgctccaacctttaaggaacctgcttataaagctgttgtgacggagggcaagatttatgacagtatcctgcaggtggaggcaatagacgaagattgctcccctcaatatagtcaaatttgcaactatgaaattgtgacgacagatgtgccattcgccatcgatcgcaatggtaacattcggaatacggaaaagctgagctacgacaaacagcatcagtacgagatactcgtgaccgcttatgactgtggccagaaacccgctgctcaggacaccctggtgcaagtcgatgtgaaacctgtctgcaaacccgggtggcaggattggaccaaacgaatcgagtaccagccaggctctggatccatgcccttgttcccctctatccacttggaaacatgcgacggggccgtttcgtccttacagatagtaaccgagctgcagaccaactatatcgggaaaggctgtgatcgcgagacctatagtgaaaaatctttacaaaaattatgcggggcctcatctgggattattgacctgctcccttccccctccgcagccacaaactggacggctgggctcctggtcgattcttccgagatgatcttcaagttcgacgggcggcagggcgcgaaagtgcccgatggtatagtgccaaagaatttgacagatcagtttacaataaccatgtggatgaaacacgggcctagccccggcgtccgcgctgagaaggagacaatcttatgcaattcggacaagactgagatgaatcggcatcattacgccctgtacgtccataactgccgccttgtgttcctgctcaggaaagactttgaccaggctgacacattcaggccagcggagttccactggaagcttgaccaaatctgcgacaaggagtggcactactatgtcatcaatgtagagtttccagtggtaacgttgtatatggacggggcaacgtacgagccgtacttggtgacaaatgattggccaatccacccttcccatatcgctatgcagttaactgttggcgcctgttggcagggaggcgaggtgaccaaaccacagttcgcacaattttttcatggaagcctggcctccttaacaatccgtccaggaaaaatggaaagccagaaggtcatttcctgtttacaggcctgcaaagaggggcttgatattaacagtctcgagtcactcggccaggggatcaagtatcacttcaatccatcccaaagtatcctcgtaatggaaggagacgatattggtaacatcaacagggcacttcagaaagtctcctatatcaacagtcgccagtttccaactgctggagtcaggcggctgaaagtcagctctaaggtgcagtgcttcggtgaggatgtatgcatcagcattccagaagttgatgcctacgtgatggtgctgcaggccatcgaacctcgcatcactctgagaggcacagatcacttttggcgccccgctgctcagttcgaaagcgctagaggagtgactctattccccgatatcaagatcgtgagcaccttcgccaaaactgaagcaccaggcgacgtgaagacaaccgaccccaaatcagaagtcctggaggagatgttgcataatctagacttctgtgacattcttgtgattggcggggacctcgacccacggcaggagtgtctggagttgaatcactccgagcttcaccagcgacacttggatgcaaccaacagcaccgccggctattccatttatggagtgggatcgatgtccagatatgagcaagtcctccaccatattagataccggaattggcgccctgcatctttagaagctcgaaggtttcggatcaaatgtagcgaactaaacggccgttatacctccaatgaatttaacctcgaagtgtccatcttacacgaggatcaggtaagcgacaaggaacacgtcaaccatcttatcgttcaaccccccttcctgcagtcagtccaccatccggaaagcaggtccagtatccagcacagcagcgtcgtcccttctatcgcgaccgtcgtgattatcatctcagtttgtatgctagtctttgtggtcgccatgggcgtctatagggtgaggatcgcccaccagcattttatacaagaaactgaggcagccaaggagagtgagatggattgggacgattccgccctaaccatcacggtaaatcctatggaaaaacacgagggcccaggacacggcgaggatgaaaccgagggcgaagaggaagaagaagcagaggaggagatgtcctcgtccagtggttccgatgattccgaggaggaagaggaagaagaaggcatgggtaggggccggcacggccagaacggtgccaggcaagcccagttggagtgggacgacagcacattgccctattag

SEQ ID NO: 24771 - DNA, 2871 bp, Artificial Sequence
  Description of Artificial Sequence: Synthetic coding sequence
atgacactattgctcttaccacttttgctggcatcactgttggcaagctgttcctgtaataaggctaataagcacaagccatggattgaagccgaataccaagggatcgtgatggagaatgataacacagtcctcctcaacccaccactgtttgcactggataaagacgcccctctgcggtatgcaggtgagatttgcggttttagattacacgggagcggggttcctttcgaggcagtgatcctagacaaggcaaccggggagggcttgattagggccaaagaaccggtggactgcgaggcacagaaggaacatacatttaccatccaggcctatgactgtggtgagggacctgacggcgctaatactaaaaaaagtcacaaggctaccgtacacgtgcgagttaatgatgtcaacgaatttgctccggtattcgtcgaaagactctaccgcgccgcggtaacagagggtaagctgtacgatcggattctccgggtggaggctattgatggtgattgtagcccacagtatagtcagatttgctactatgagatactaaccccaaacactcctttcctgatcgataacgacgggaatatcgaaaacaccgaaaagttgcagtatagcggcgagaggctttataagttcaccgtgacggcctacgattgcggaaaaaagcgggcagctgatgatgcagaagtcgaaatccaggtaaaaccaacttgtaaacccagctggcaggggtggaacaagcgcattgaatatgctcccggcgctgggagcctggcactgttccccgggataagactggagacctgcgacgagcccctttggaacatccaggcaactatcgaactccagacctctcatgtcgctaagggctgcgatagagacaattacagtgagcgggccctgagaaagctgtgtggggccgccacaggtgaggtggatctgttgccgatgcctggtcctaatgccaactggacggccgggctgtcagtccactactcacaggactcctccctgatttattggtttaatggaacccaagctgtgcaggtccccttaggtgggccttccgggctgggcagcggaccacaagattctctaagcgatcatttcaccctttccttttggatgaagcatggggtaactccaaacaaaggcaagaaggaggaggagacaatcgtgtgcaacactgtgcaaaatgaggatggcttttcccactatagccttacagttcacgggtgtaggatcgcctttctgtactggccattgctggaatccgcgaggccggtaaagttcctgtggaagcttgagcaggtctgtgacgacgagtggcaccactatgctctgaacctagagttcccaaccgtgaccctgtatactgacggcatctccttcgatcccgctctgatccatgacaatggtctcatccaccccccccgacgagagccagccctcatgataggagcctgttggacagaggaaaaaaataaagagaaggaaaagggcgacaacagcactgacaccacacagggagaccccctgtctatccatcattatttccatggctacctcgcgggctttagcgttcgaagcggccgactggagtcgagggaagtcatcgagtgtttatatgcctgtcgcgaaggactcgactatagagatttcgagagtctggggaagggaatgaaggtgcacgtcaaccctagccagagcctgttaacccttgaaggagacgatgttgaaacatttaatcacgccttgcagcacgtggcatacatgaatacattgaggtttgctactccgggagtccggcccctgagactcacgactgctgtgaaatgcttctccgaagaatcgtgtgttagcattccagaagtagagggttacgtggtcgtgcttcagcctgatgcacctcagatactgctctcaggcacagcccattttgcaaggcccgcagttgattttgaggggactaacggagtgcccttgttcccggaccttcaaatcacctgcagtattagtcatcaggtggaggcgaaaaaggacgaaagctggcagggcaccgtgacagacacacgcatgtcggacgaaatagttcataatctggacgggtgtgagatctccctcgtgggagacgaccttgaccctgaacgagaatctttgttactggataccacttcactgcagcagagaggactcgaactcacaaacactagcgcttacctcacaatcgctggggtggagtctattaccgtctacgaggaaatcctgaggcaggctcggtaccgactgcgacatggcgccgccctgtacacgcgcaaattcagactgtcatgctctgaaatgaacgggcggtacagcagcaacgaattcatcgtggaagtgaatgtcctgcactctatgaaccgagtggcccatccctcgcacgtgctcagtagtcagcagtttttgcatcgcggacaccaaccaccaccagagatggctggccatagcttggcttcttcccacagaaactccatgataccgtcagcagccacgcttattatcgtggtctgtgtgggtttcttagtactcatggtggtacttggtcttgtaaggatccactctctgcatcgccgagttagcggggcgggcgggccgccgggggccagtagtgatcccaaagatcccgacctgttttgggatgattctgccctgactataattgtgaacccaatggagagctaccaaaacagacagtcctgtgtgactggcgccgtgggagggcagcaagaggacgaagactcttccgattccgaagtagcagactcaccttcttcagacgagcgtaggatcatcgagaccccacctcatagatattag

SEQ ID NO: 24772 - DNA, 2907 bp, Artificial Sequence
  Description of Artificial Sequence: Synthetic coding sequence
atggtactgggttgtgaactctcgggttcaacgcgtgttgttgttggcgtcgaggcacttctgacaggggcttcctccccactgccaggagtcggccccgccaataagcataaaccttggattgaagccgaatatcaaggcatagtgatggaaaacgataacacagtgctgctgaatcccccactctttgcattagacaaggacgcgccactgcgctatgcaggtgagatctgcgggttcaggctccatggcagcggcgtgccattcgaggcagtgattctagacaaggccacaggcgaggggcttattagggctaaagagcctgttgactgtgaagctcagaaggagcataccttcaccatccaggcttatgactgcggcgagggcccggatggcgccaataccaagaagagccataaggctacggttcacgtccgcgttaacgatgtcaatgagttcgccccggtatttgtggagcgactctatcgggcggccgtaactgaaggaaaattatatgaccgcattctacgggtcgaggccatcgacggtgattgtagtccccagtacagccagatatgctattatgagattttaacacccaacaccccttttctgatagacaatgacggaaacattgagaataccgaaaaattacaatacagtggtgagcggctttacaagtttacggtcacggcctacgactgcggcaaaaaacgtgcagccgatgatgccgaagtggaaatacaagtcaaaccgacctgtaagccgtcctggcaaggatggaacaaaaggatcgagtacgccccaggagctggaagtctggctcttttcccggggatacgtctggagacatgcgacgagccactctggaatatccaggcgacgattgaactccaaaccagccacgtagcaaaaggatgcgatagggataattactctgagcgcgcccttaggaagctctgcggagccgccacaggagaggtcgatctgctgccaatgcctggcccaaatgccaattggacggccggtctgtcagtccactattctcaggactcaagcctgatttactggttcaatggaacgcaggcagtgcaggtacctctagggggccctagtgggctcgggtcaggaccacaagattccttgtctgaccactttaccttgagcttctggatgaagcatggagttacgccaaacaaaggaaagaaagaggaagagactatcgtttgtaacaccgtccagaacgaggatgggtttagccactatagcctgactgttcacggctgcagaatcgcctttctttattggcctttactggaatctgccagaccagtgaagttcctttggaaactggaacaggtttgcgacgacgaatggcatcactacgctctaaatttagagtttcccaccgttacactgtacacagacggcatttcctttgacccagctctcatccatgacaacggtttaatccatccaccacggcgagagcccgctttgatgatcggcgcgtgctggacagaggagaaaaataaagagaaagagaagggagataactctacagacactacacaaggcgacccgttgtcaattcaccattacttccacggatacctggccggattttccgtgcggagcgggagactagagagtagagaggttatcgagtgcttgtacgcttgcagagaggggctagactaccgcgattttgaatcccttggcaagggaatgaaggtgcatgtaaacccaagtcaaagcttgctaaccttagagggcgacgacgtggaaacattcaatcatgctctgcaacacgtagcatacatgaacactctgaggttcgctactcccggcgttcgaccacttagactgacgactgcagtaaaatgtttctcagaggagtcctgtgtctcaatccctgaggtcgaaggctatgtggtggtgctgcagccagatgccccccagattctactgagcggaacagcccactttgcacgaccagccgtcgatttcgaggggacaaacggcgtccccttgtttccggatctgcaaataacatgctcaattagccatcaggtcgaagctaaaaaagacgaatcctggcagggaactgtaaccgatacccgcatgtcagacgaaatcgtgcacaatctcgacggttgcgagatcagtcttgtgggcgacgatttagatccggaacgcgaatcgttgctgcttgacaccacctcactgcagcagcggggactagaactaacaaatacctccgcctaccttacaatcgccggagtggagtccattacggtgtacgaagaaattctcagacaggctcggtatagacttcggcacggcgccgcactctatacgcgcaagtttaggctcagctgcagcgagatgaatggacgctactcatccaacgaatttatcgtcgaggttaacgttcttcattccatgaatagagtggcccacccaagccatgtcttaagttctcagcaattccttcaccggggacaccagcctccccccgagatggctggccactctcttgcctccagccatagaaattcaatgatcccgagtgcggcgaccctcatcatcgtcgtgtgcgtcgggtttttggtgctgatggttgtccttggcttggttagaattcactcccttcaccgcagagtgtcaggcgcagggggtccacctggcgcctcctcagaccctaaagatcctgatctcttttgggacgattccgccctgactatcatcgtcaaccctatggaaagttatcagaaccggcagtcctgcgtaaccggtgccgtcgggggccaacaggaagatgaagatagctcggattcagaggtggcagactctccttcttccgacgagcgcaggattatcgaaactccccctcatcggtactag

SEQ ID NO: 24773 - DNA, 405 bp, Artificial Sequence
  Description of Artificial Sequence: Synthetic coding sequence
atgacccttttgcttttgccgctcctgttagcaagcctactcgccagctgtagctgtaacaaggccaacaagcataaaccttggatagaagctgagtaccaggggattgtaatggagaacgacaacactgtgctgctgaatcctcccctctttgccctcgacaaagacgcacccctccgctacgcgggcgagatctgcggattccgactgcatgggtccggagtgcccttcgaggccgtcatcttagataaggcgacgggtgaggggctgatcagagccaaggaacccgtggactgcgaggcccaaaaggaacacacctttactatccaggcttacgattgcggggaaggcccagatggtgctaacaccaagaaaagtcacaaagccactgtgcacgtgcgttag

SEQ ID NO: 24774 - DNA, 1422 bp, Artificial Sequence
  Description of Artificial Sequence: Synthetic coding sequence
atgccttttgggtgcgtcacccttggtgacaaaaaaaactataatcagccttctgaggtgaccgatcgatatgacctgggacaggtaattaagactgaggaattttgtgagattttccgggccaaagataaaactacaggaaaactccacacttgcaagaaatttcaaaagagagacggaagaaaagtgcggaaagctgccaagaacgagattggaattttgaagatggtgaagcaccccaacattctgcagttggtggatgtcttcgtgacccggaaggaatattttatcttcttggagctcgccaccgggagggaggtctttgattggatactggatcagggctactactctgaacgggatacttccaacgtggtgcgccaggtgcttgaagcggtagcctacctccactctctaaagattgttcaccggaatcttaaactggaaaacctggtgtactataatcggttgaagaacagcaaaatcgtcatctctgactttcaccttgcaaagcttgaaaacggtctcatcaaagagccttgtggaacacccgagtatctgggtaatccccctttttatgaggaggtggaggaggatgactacgagaaccatgataagaatttgtttagaaaaatacttgcgggtgactacgaatttgactccccgtactgggatgacatctcacaggccgctaaagatcttgtgacccgcctaatggaagttgaacaggatcagcgcatcaccgcagaagaggccatttcccacgaatggatttctggtaatgctgcctctgacaaaaatatcaaggatggggtgtgtgcccaaatagaaaagaactttgctcgggctaaatggaagaaagctgtgcgcgtcactacccttatgaaaagactgagagccccagaacaatcttccactgctgctgctcaatccgcttcagctactgacaccgccacccccggggcagccggtggagcaacagccgctgcagctagcggcgctactagtgccccggagggcgatgccgcccgcgcagctaagtctgataatgtcgcacctgctgatagatcagcgacccccgccactgatggatccgccaccccagctactgacggcagcgtcactcccgctaccgatggatcaatcaccccagccaccgatggttccgtgacccctgccaccgaccggagcgccaccccagccacagatggtagggctactcctgccactgaagagagcactgtcccaaccacccagtcaagcgccatgttagctaccaaagcagccgccacaccagagcctgcgatggctcagcctgattcaacggctccggaaggagccaccggtcaagctcctccttcatctaagggcgaggaggcagccggatacgcccaggagtctcagcgagaggaggcatcctag

SEQ ID NO: 24775 - DNA, 1506 bp, Artificial Sequence
  Description of Artificial Sequence: Synthetic coding sequence
atgcctttcggatgtgtaaccttgggcgacaagaagaattataaccaacccagtgaagtgaccgaccgctatgacctgggtcaggtgattaaaacagaagaattttgtgaaatcttccgcgccaaagacaaaaccacggggaagctgcatacatgcaaaaagttccagaagagagacggacgcaaagtgaggaaggctgccaagaacgaaatcgggatcctgaaaatggtaaagcatcccaatatcctgcaactggtcgacgttttcgttaccaggaaagagtacttcatctttcttgagctggcaaccggcagggaagtgtttgattggattctggaccagggctactactctgaacgggacacttccaatgtcgtcaggcaggtgctcgaagcggttgcctacctccactccctcaaaatagtgcatcggaacctaaaactggaaaacctggtgtactacaaccggctgaagaactcgaaaattgtgatcagcgactttcatctggccaaactggagaatggactgattaaagagccgtgcggcacccccgaatacttagcccctgaagtggtggggagacagagatacggccggcccgtggattgttgggcaatcggagtgatcatgtacatcttgttatcaggcaacccgcctttctacgaggaggtggaagaggatgattacgaaaatcacgataagaacctgtttagaaaaatcctggccggtgactatgagttcgattctccatattgggatgatattagccaggccgcaaaggacttggttactcgcctgatggaggtagaacaggaccaacgaataactgccgaagaggccatctcccatgagtggatctctggcaacgccgccagtgataaaaatattaaggacggagtgtgcgctcagatagagaagaattttgcccgggccaagtggaagaaggcagtgagagtaacaacactaatgaaacgcctgcgcgctccagaacagtcatccacagccgcagcccagtctgcaagcgctacggatacagccacaccaggagctgctggaggagctacagcggcagcggcctcaggagccacatctgcgcccgaaggtgacgcagcacgggcggcaaagtcagataacgtcgcaccagccgatagaagcgccacccccgcaacggacgggagtgccacacccgcaactgacgggtccgtgacaccagccacggacggcagcatcacacccgcaacagatgggtctgtcacgcctgccacagaccggtctgccacccccgcaacagacggcagggctacaccggcaacggaggaatcaacagttcctacaacccagtccagcgccatgttggccactaaggcagctgctacccccgaaccggcgatggcgcagcctgattcaaccgcacccgagggggccaccggccaggccccaccctcctcaaaaggtgaagaggcagccggctacgctcaagagtcccagcgggaggaagcatcttag

SEQ ID NO: 24776 - DNA, 1413 bp, Artificial Sequence
  Description of Artificial Sequence: Synthetic coding sequence
atgccctttggttgcgtgaccctcggcgacaagaagaattataaccagccctctgaagtcactgatagatatgatctcggtcaagtgattaaaacggaagaattttgtgagatcttcagggctaaagataaaaccaccgggaagctgcacacttgtaagaaatttcaaaaacgagatggcagaaaggttagaaaagccgctaaaaatgagatcggaatactcaagatggttaaacatccaaatattctgcagctggtagacgtgttcgtaacacgaaaagagtacttcattttcctggagctggccacagggcgtgaagtttttgactggatcctggatcagggatattactctgagcgcgacacatcgaacgtggtgcggcaggtcctcgaggcggttgcttacctgcactccttgaagatagttcacagaaacttaaaacttgagaatttagtctactacaacaggctcaagaattcgaaaatcgtaatcagcgactttcacctggcgaaattggaaaacggactgataaaagagccatgtgggacccctgagtatttggctcctgaggttgtgggacggcaacggtatggtcgccctgttgattgctgggccatcggtgtcatcatgtatatcctgctgtccgggaatccacccttttatgaagaggtggaggaggacgattatgaaaaccatgataagaatctgtttcgcaagatcctggccggcgactatgaattcgactctccctactgggatgatatatcccaggccgccaaagaccttgttactcgacttatggaagtcgagcaggatcagcggatcaccgcagaggaggccatctcacacgaatggatatctggcaacgcagccagcgataagaacatcaaagacggcgtttgcgcccagattgagaagaattttgctagagccaaatggaagaaggcagtccgggtcaccactttgatgaaaagactcagagctccagagcagtcaagcaccgctgccgcccagtcagcctcagctactgatactgccaccccaggcgccgctgatcgtagcgccacgcccgctacggacggcagcgctacccccgccaccgacggctccgtgacaccagcaaccgacggctctattactcccgcaaccgacggatctgtcaccccagccacggaccgtagcgctacaccagccactgacggtcgcgccaccccggctacggaagaaagtacagttcctaccacacagagttccgctatgctggcaactaaagctgccgctacacccgaaccggccatggctcaacctgattccacagccccagaaggggccaccggacaggcacccccttccagcaagggcgaggaggcagctgggtatgcccaggagtcccagagagaggaggcgagctag

SEQ ID NO: 24777 - DNA, 1560 bp, Artificial Sequence
  Description of Artificial Sequence: Synthetic coding sequence
atggatgcagtcctggaacccttccctgcagacagactgtttcctggcagctcattcttggacctcggggatctgaatgagtcggacttcctgaacaatgctcattttcccgaacacctcgatcactttacggagaacatggaggattttagtaatgatctgttctcttcgttcttcgatgatccagtactcgacgaaaaaagtcctctcctcgatatggagctggattcccctactcccggcatccaggctgaacactcttactcattgtcaggagatagcgctccccagtcccccctcgtacccatcaaaatggaggacacaactcaggacgccgagcacggagcctgggctctgggtcacaagctgtgtagcatcatggtgaagcaggaacaatctcccgaacttccagtggatcccctggccgcgccctcagctatggctgcagcagctgctatggccactaccccactccttggcctgagtcccctatcacggctgcccatcccacaccaggctcccggtgagatgacccaacttccagtaatcaaagcagagcctttggaagtgaaccagtttttaaaagttaccccagaggacctagtccagatgccccccacaccgccttcgtcacacggcagtgacagcgacggttctcagtcacctcggtccttgccaccctcatccccagttagacctatggcaaggtctagtacagctataagcacatccccccttttgactgcccctcacaagttacagggtacatctggaccactgctcctgacagaagaggagaagagaacgttgatcgccgagggttaccccatcccaacaaaattgccgctgactaaagctgaggaaaaggcactgaagcgagtccggcgcaaaatcaagaacaagatatctgcgcaggagagtcggcgcaagaaaaaggagtacgtcgagtgcctggaaaaaaaagtggagacttttacgtcggagaacaacgagctgtggaaaaaagtggaaacactcgaaaacgccaacaggacactgttgcaacaactgcagaaattgcagaccctagtcaccaataagatcagccgaccctacaagatggcagcgacacaaacaggaacctgcctgatggtcgcagcgttgtgttttgtgctggtcctgggaagcctcgtgccttgtcttcctgagttctcctcaggtagtcagactgtcaaagaggatcccctggcagcagatggggtatataccgctagtcagatgcccagcagaagtctgctcttctacgatgatggcgccggcctgtgggaggatggacggtctacacttctgccaatggaaccgcccgatggatgggaaatcaacccgggcggaccggccgagcagcggccccgcgatcatctgcaacacgatcaccttgactcaacccatgagaccacaaagtatctctccgaagcatggcccaaagatggaggcaatggcacttcaccggatttctctcattctaaagagtggtttcatgacagggatctcggcccaaacaccaccatcaagttgagctag

SEQ ID NO: 24778 - DNA, 1296 bp, Artificial Sequence
  Description of Artificial Sequence: Synthetic coding sequence
atggacgctgtactagagccatttcccgccgacagactgtttccaggtagcagtttcctcgatttaggcgatctcaacgaaagtgacttcctgaacaacgctcactttccggagcacctggaccatttcacggagaacatggaggatttctctaatgacttattctctagcttctttgatgatcctgtccttgatgagaagtctcctctcctggatatggaactagactcccctacacccggaatacaggcagaacattcttactctctgtccggtgattctgctccgcagagtccccttgtcccaataaagatggaggacacaacacaggaggatctggttcagatgcctccgacccccccatcatcccacggatctgactctgatgggtcacagagtcctagaagtcttccaccatcttctcctgtgagacctatggcaagatcttctacagcaataagtacaagcccgctactgacagctccacacaagcttcagggtacctcaggccccctcctacttactgaagaagaaaaaaggactctcatcgccgaaggctacccaattcctaccaaactgcctctgaccaaggcggaggaaaaagccttaaaacgggtgaggcggaagatcaaaaataaaatatccgcccaagaaagtaggaggaagaaaaaggaatatgtggaatgcctcgagaagaaggtagaaactttcaccagtgaaaataacgagttatggaaaaaggtggagacacttgagaatgccaatcggacacttttacaacaactgcagaagttgcagactctggtgacaaataagatttccagaccttacaaaatggcagcaacacagaccgggacctgtctaatggttgctgccctctgctttgtgcttgtgctcgggtctttggtaccttgcctgcctgagttctcatccggcagccagacagttaaggaggatcctcttgctgcggacggcgtctatacggcaagccagatgcccagtaggagtctgctcttctacgatgacggcgccggactctgggaagacgggcggtcaactctgttgcccatggagcctcccgacgggtgggagattaatcccggcgggccggctgagcagagaccacgcgatcacctccaacacgatcaccttgactccactcatgagacgacaaaatacctatccgaagcttggccaaaagacggcggtaatggcacatctcccgacttctctcactcaaaagagtggttccacgatcgagacctgggccccaatacaaccattaagctgagctag

SEQ ID NO: 24779 - DNA, 1560 bp, Artificial Sequence
  Description of Artificial Sequence: Synthetic coding sequence
atggatgctgtgctggagccttttcctgctgacaggctcttccccgggagttcctttctggatctaggagatctgaacgagtcagacttcctgaacaatgcccattttcccgagcaccttgaccattttactgagaacatggaagacttcagcaacgacctcttcagttcttttttcgatgaccccgtgctggacgaaaaaagtccgttgctagacatggagctggattcaccgacaccggggattcaggcagagcactcatattcactctcaggggattctgcccctcagagcccactggtcccgatcaagatggaggacaccacccaggatgctgaacatggtgcttgggccctgggccacaaactttgcagcatcatggtcaagcaggaacagagcccagaactgcctgtggacccccttgcagccccgtcagccatggcggcggctgcagccatggctacaacgcccctcttaggattatcccctctgtctcggctccccattccacaccaggccccaggcgagatgactcagctgcccgtgattaaggcagagcctctcgaagtcaatcaatttctgaaggtaacacctgaagaccttgtgcaaatgccgccaacaccgcccagctcgcacgggagtgacagcgacgggagtcagtcccccaggagtctgcccccctctagccccgttaggcccatggcccgaagctcaactgcgatttcaacatcaccactgttgacagcccctcacaagctccagggtactagtgggcccctccttctgactgaagaggaaaaaagaaccctgatcgcggaggggtaccctatcccgacaaagcttccacttaccaaggctgaggaaaaagcgttaaagcgtgtgagacgcaaaataaagaacaaaatctctgcacaagaatctcgccggaaaaaaaaggaatacgtagagtgcctcgagaagaaagtggaaacgtttacgagcgagaacaacgagctatggaagaaggtggagacccttgagaatgctaatcgcaccctgctacagcagcttcaaaagctgcaaacactggttaccaataagatctcacgcccctacaagatggcggccactcagactgggacctgtctcatggtggcagcactctgtttcgtgctggtgcttggaagcctcgtgccctgtctccccgagtttagtagcggctctcaaacagtcaaagaagatccgctggccgccgatggcgtgtatactgccagtcaaatgccgtctcgcagcctgcttttctatgatgacggtgcagggctctgggaggacggacgcagtactctgctcccaatggaacctccagatggctgggagattaaccctgggggacctgccgaacagagaccgcgggaccacctgcagcacgaccatctcgatagcactcacgaaaccactaagtacctgagtgaggcgtggcctaaagacggcgggaatggcacctcccctgatttctcacattccaaagagtggttccacgacagggatctggggcctaataccaccataaaactgagctag

SEQ ID NO: 24780 - DNA, 1563 bp, Artificial Sequence
  Description of Artificial Sequence: Synthetic coding sequence
atggaagttcttgagagcggtgagcagggggttctgcagtgggacagaaagctcagcgaactcagcgaacctggagacggagaagctctgatgtaccatacccacttctcagaacttctcgacgaattctcacagaacgttcttggccaactgctcaatgatcccttcctaagtgaaaaatccgtaagcatggaggtggagccatcgccaactagcccagcgccgcttattcaggctgagcactcctatagtctgtgtgaggagccacgcgcacagtcaccctttacacacatcactacatctgattccttcaatgacgatgaggtggagtccgagaagtggtatctgtccacggactttccaagcacttccataaaaactgagccggtgacagacgagccacccccaggtttggtgccaagcgtcacactgacaattactgccattagtaccccactggagaaggaggaacccccgctcgaaatgaatactggcgtcgacagctcctgtcagacaatcattccgaaaataaagcttgaacctcacgaagttgaccaattcctaaatttttcccctaaggaggctcccgttgaccacctgcacctgccacccacaccgccttccagccacgggtccgatagtgaagggagtcttagtcctaaccctaggctccacccgttcagccttccccaaactcatagcccttctagagctgccccaagagctccctcagctctcagctcctcacccttactgacagccccacacaaattgcagggctccgggccgctggtactcacagaagaagagaagcgcactctcattgccgagggctacccaatcccaaccaagctgcctctgagcaagagtgaagagaaggccctgaaaaagatcaggcggaaaattaagaataaaataagcgctcaggagagccgccgcaagaagaaagaatatatggactcactggagaaaaaagtggaatcttgcagtaccgagaacttggaactgagaaagaaagtcgaagtcctggagaacaccaaccggaccctccttcaacagctccagaaactgcagaccctcgtaatgggaaaggtgtctaggacctgtaagcttgcgggtacgcagaccggtacctgtctgatggtggtggtcctctgctttgcggtagccttcgggagcttttttcaggggtacgggccttacccatctgcgacaaagatggctctgccgtcacagcattccctgcaggagccctatactgcgagtgtggtgcgatctaggaacttactgatctatgaagagcattctccacccgaagagtcctcatctcctgggtcagcaggcgaactgggtgggtgggatcggggcagctccctgctgcgagtgtcagggctcgaaagcaggcccgatgtggaccttccacacttcattattagtaatgagaccagtctcgaaaaaagcgtgctcctggaattacagcagcatctggtgagtgctaagttggagggcaatgagacgcttaaggtcgtggagttggacaggcgcgtgaacacgacattctag

SEQ ID NO: 24781 - DNA, 528 bp, Artificial Sequence
  Description of Artificial Sequence: Synthetic coding sequence
atggaagtgttggaaagcggagaacagggcgtgcttcaatgggataggaaactctcagaactgagcgaaccgggcgacggcgaggccctgatgtaccacacccatttttccgaactcttggatgagttttcacagaatgtcctaggccagttgctcaacgaccctttcctatccgagaaaagcgtttctatggaggttgagccctccccaaccagcccggcacctctgatccaagccgagcactcttacagtctgtgtgaggagccaagggcacagtctccttttacccacatcaccacaagcgattcgttcaatgacgacgaagtggagtctgaaaaatggtacttgagtaccgatttccctagcacctcaatcaagactgagcctgtgactgatgaaccaccgcccggcttagtccccagcgtgaccctgactatcacggcaatctcaaccccgcttgagaaggaggagccaccactcgagatgaatacaggcgtcgattcaagttgccagactaacactacgtag

SEQ ID NO: 24782 - DNA, 747 bp, Artificial Sequence
  Description of Artificial Sequence: Synthetic coding sequence
atggaagtcctcgaatctggggaacaaggtgttttgcaatgggaccgcaaactgtctgagctgagtgagcctggggacggtgaggccctcatgtatcacacccactttagcgaacttcttgatgagtttagtcagaacgtgctgggacaactgctaaatgatcccttcctgtctgagaaatctgtgagcatggaggtggaaccgtcgcccacctcccctgcgcccctgatccaagccgagcactcatatagtctctgcgaggagccccgtgcccagtcacctttcacccacattactacaagcgatagtttcaatgatgatgaagttgaatccgagaagtggtacctctctaccgatttcccctcaacatccattaagaccgagcccgtgactgacgagccgcctcccggtcttgtgcccagcgtgaccttgactataacagctatcagcacaccacttgaaaaagaggagccccccctcgagatgaacactggagtggactcatcgtgtcagaccatcatacctaagattaaactggagccccacgaagtagatcaatttttaaattttagtcccaaggagggtctgtccgctctccccgtgagtttgtgggtaatggatatggtttccgggtccaccgagcgcgaatatggtgaacgcgcggggatgagtctataccataggtgctgcagctggctttacgaaatcgcgctgtttcttaagaacaaaaacttcgcttccaagtag

SEQ ID NO: 24783 - DNA, 1383 bp, Artificial Sequence
  Description of Artificial Sequence: Synthetic coding sequence
atggaggttctagaatcaggcgaacagggtgtcctacagtgggataggaagctgagtgagctttctgaaccgggggacggagaagctctcatgtatcatacccatttctccgagctactcgacgagttctcgcagaacgtgctcggtcagctgctgaacgatcccttcctgagcgagaaatccgtcagcatggaggttgaacctagtcccacgagccccgcgccattgatacaggctgagcatagctattctctgtgtgaggaaccccgagcccagagccctttcacacacatcacaacatccgattcatttaacgacgacgaggtggagtccgaaaagtggtatctaagcaccgatttcccgagcacctctattaagacggaacccgtgacagacgagcccccccctggcttagtgccttccgtgaccctcactataactgcgattagcacacccctcgagaaggaagaacctccgttggagatgaacaccggggtggatagctcctgccagaccataattcctaagatcaagctcgagcctcatgaggtagaccaattcctcaacttctctccaaaagaggcccctgtagaccatttgcaccttccgccaactcccccctcatctcatggttctgactcagagggctcactgtcacccaatccccggctccacccattcagtctcccacagactcattccccatctagggctgctccacgggcgccaagcgccctcagcagctcccctctgttgacagccccgcacaaactccaagggagtggacctctcgtgctgacagaagaagagaagcggacactaatcgccgagggctaccctatcccaaccaaactgccgttatcaaagtccgaggaaaaagccttgaagaaaatacgccgtaaaattaaaaacaaaatttccgcccaggagtctaggaggaagaagaaggagtacatggattctctggaaaagaaggtggagagctgcagcacagaaaacctggagctgcggaagaaagtcgaagtattggagaatactaatcgtaccttgctgcagcagctacaaaagttgcagacactggtcatgggcaaagtgtccaggacttgcaagctggccgggactcaaacaggaacgtgtctaatggtggttgtcctatgcttcgctgtcgctttcggatcattcttccagggttacggaccctacccaagtgcaacgaagatggccctcccttctcagcattccttgcaagagccttacaccgccagcgtggggaaaaccgcttgtggaaagctcgggcgtgtgctgttctatttccccagagctggatttctctccctgcctaagggcatattctgcgaatctcctatgttcaaaaagtggtag

SEQ ID NO: 24784 - DNA, 453 bp, Artificial Sequence
  Description of Artificial Sequence: Synthetic coding sequence
atggaagtgttagagtctggagagcaaggggtgcttcagtgggatcggaagctctctgaactctcagagcctggggacggggaagccctcatgtaccacactcatttcagcgagctgctagacgaattctctcagaacgtgctgggccaactgctcaacgacccgttcctgagcgagaagtcggtgagcatggaagtcgagccctcgccgaccagcccagcaccactgatccaggccgagcatagttattccctgtgtgaagagcccagagcgcaatcacccttcacccacattaccaccagcgattcctttaacgatgatgaagtggaaagcgaaaaatggtaccttagcacggatttcccatctacctccatatgccattcagatcaccacagtcatttgcacccagtagggaagggggggacatccagtggaaacgagcactggggctag

SEQ ID NO: 24785 - DNA, 1311 bp, Artificial Sequence
  Description of Artificial Sequence: Synthetic coding sequence
atggtgggattcggagctaatcggagggccggacgactcccctccttggtgctggtcgtgctgttagttgtcatagttgtgttagcatttaattactggtcgatcagctcacgacacgtcttgttgcaagaggaggttgctgaactgcaggggcaggtgcagcgcaccgaagtggcccgtggaagactcgaaaagaggaactctgacctgctgctgctcgtggatacgcataagaaacaaatcgaccagaaggaagccgattacggtcgcctttcctcacgactgcaagcccgcgaaggcctgggaaaacggtgcgaggatgacaaagtgaagttacagaataacatttcttaccagatggccgacatacatcacctcaaagaacaactggctgaactgagacaggagttcctccggcaggaagaccagttgcaggactacagaaagaacaatacctatcttgtcaaacgactggaatacgagtcctttcagtgtgggcagcaaatgaaggagcttcgggctcaacatgaggaaaacattaagaaattggcagatcagtttctggaggaacaaaaacaggaaacgcagaagattcagagcaatgatgggaaggaacttgacatcaataatcaggttgtcccaaagaacatcccaaaggttgctgaaaatgtagctgacaaaaacgaagagccatctagtaaccacatcccacacggcaaggaacaaattaagcgcggcggcgacgccgggatgcctggtatcgaagaaaatgatttagcaaaggtcgatgacctcccacctgctctgaggaaaccccccatctcagtgagccaacatgagtcacaccaggccatttcacacctaccgacagggcagcctttgtcccctaacatgcctcctgactcacatatcaaccacaacggcaatcccggcacatccaaacaaaaccccagctctccgctccagcgccttatcccaggctcaaatctcgattctgaacctcggatccagaccgatattctcaagcaggccaccaaggatcgcgtcagtgacttccacaaactgaaacagagcagatttttcgacgaaaacgagtctccggtggatccacagcacggcagtaaacttgctgattacaacggagatgatgggaatgttggggaatacgaggctgacaagcaggccgaactggcctacaatgaagaagaagacggagacggcggggaagaggacgtccaagatgatgaagagcgagagctacagatggaccccgccgattatggcaaacagcactttaatgacgtactgtag

SEQ ID NO: 24786 - DNA, 1143 bp, Artificial Sequence
  Description of Artificial Sequence: Synthetic coding sequence
atggtgggttttggcgccaacagacgggccggtagactgccatcactggtcctggtggtactgttggtagtaatcgttgtcttggcttttaattactggtctatttcctctcgacacgtgctccttcaggaagaagttgctgaactgcaaggtcaggtccagaggactgaagtggcacggggtagattggagaaacggaacagcgatctgctgctgctggtggatacccataagaaacaaattgatcaaaaggaggcagattatggcaggttgagcagtagacttcaggcaagagaagggctcgggaaacgctgtgaggacgacaaagtgaaactgcagaataacatctcctatcaaatggctgacatccaccatctcaaagagcaactcgcggagctcagacaggagtttttgaggcaagaggatcaactacaggactatagaaaaaacaatacgtatcttgtgaaacggctggagtacgagagctttcagtgtggacagcaaatgaaggagctgcgcgctcagcatgaggagaatatcaagaagttggccgatcagttcttggaagagcagaagcaggaaactcagaagatacagagtaacgacggcaaggaactggacataaacaatcaagtcgtcccaaaaaatattcccaaggtggctgagaacgtcgcagacaagaacgaagagccgtcaagtaatcatattcctcacgggaaagagcagatcaagcgggggggcgacgctggcatgccagggatcgaggagaacgacctggccaaggtagatgacctgccccccgcgctgaggaagcccccaatctcagtctctcagcacgaaagccatcaggcaatcagtcacttgccaacgggtcaacctctctccccaaacatgcctcctgattcccatataaaccacaacggaaaccccgggacttctaaacagaatccttcctcccctctccagcgcctgatcccgggctcaaatctggacagcgagcctaggattcagacagatattttgaagcaggctactaaagaccgtgtgtcagacttccacaaactgaaacagaacgacgaagagcgcgagctgcagatggaccctgcggactatggcaaacagcatttcaacgatgtgctctag

SEQ ID NO: 24787 - DNA, 534 bp, Artificial Sequence
  Description of Artificial Sequence: Synthetic coding sequence
atggtgggtttcggcgctaatagacgagccggtcgcctgcccagcttggtgctggtggtgcttctcgtcgttatcgtggtgctggccttcaactactggagtatttctagtagacatgtgcttctgcaggaagaggtggctgaactccagggccaagtccaaaggacggaggttgcccgggggagactcgagaagcgcaactccgacctgctgcttctggtggacactcacaaaaagcagatcgaccagaaggaggctgattacggcaggctgagttccaggctccaggcaagagagggtctgggcaaaaggtgcgaagacgataaggtaaagcttcagaacaatatttcgtaccagatggccgacatccatcatctcaaggagcagctggcggagttaagacaggaattcctgaggcaggaagaccagcttcaggattaccgcaagaacaatacctatctggttaagaggctcgagtacgagtctaagagacccaaaagatttaatcagatgatggagagaaactggatttag

SEQ ID NO: 24788 - DNA, 1248 bp, Artificial Sequence
  Description of Artificial Sequence: Synthetic coding sequence
atggtggtgattgtggtgctcgcttttaattactggagcatttcttcccgacacgtcctgcttcaggaagaggtggccgagctccagggacaggtgcagcgaactgaagtggcacgaggacgcttagagaaacgcaattcggacctccttctgctcgtggatactcacaagaaacagattgaccagaaagaagccgactacggcagactttccagccgcctccaggcccgggaggggctgggcaaacggtgcgaagatgataaagtgaaattgcagaataatatctcctaccaaatggcagacatccatcatcttaaagagcaattagcggagcttcgacaggaattcctgagacaggaagatcagctccaggattataggaaaaacaacacctacctggtcaaacgtttggaatatgagagttttcagtgcggccaacaaatgaaggagctgcgggcccaacacgaagagaatattaagaaacttgccgaccaattcttagaagagcaaaaacaagaaacccagaaaatccaatctaacgatggcaaggagctggacattaacaatcaggttgtgccaaagaacattccgaaggtggccgaaaacgtggcagataaaaatgaggagccaagttctaatcacattccccacggcaaggagcaaataaaacgtggaggtgatgcgggaatgcccggaatcgaggagaacgatttggcaaaagtagacgatctgcctccagctctccggaaacctccgatctccgtcagtcagcacgagagccaccaggccattagccatctgcccactggtcagccccttagtcctaatatgccccctgattcccacatcaatcataatggaaaccctggcacgtcaaagcagaacccctcatcacccctccagcgcttaatacccggtagcaatctcgattccgaacctaggattcagaccgatatcctcaagcaggccacgaaagaccgtgtgagcgactttcataagctgaaacagagccgatttttcgacgaaaacgaatccccggtggaccctcagcatggcagtaaactggctgactataacggggatgacggcaacgtgggcgagtacgaggctgacaaacaggctgagctggcgtacaatgaggaggaggatggcgacggtggcgaagaagatgtgcaggacgatgaggagagagaattacagatggaccctgctgactacgggaaacagcattttaacgacgtcctgtag

SEQ ID NO: 24789 - DNA, 75 bp, Artificial Sequence
  Description of Artificial Sequence: Synthetic coding sequence
caagacgacgaagagcgtgaactgcaaatggacccagcagattacggcaaacagcactttaacgacgtactgtag

SEQ ID NO: 24790 - DNA, 1302 bp, Artificial Sequence
  Description of Artificial Sequence: Synthetic coding sequence
atggtcgggttcggagcaaatcggcgtgcgggaaggctcccaagtctggttcttgtcgtgctgcttgtggtgatcgttgttctggcctttaactactggagtatctccagtcgacacgtcctgctccaggaggaagtcgcggagctgcaaggccaagtgcagcgaaccgaagtggcacggggcaggctcgaaaagaggaattctgacctcctgctgctagtggacacgcacaagaagcagatcgaccaaaaagaagccgactacgggcggctgtcgtcacgcctgcaagcccgcgaaggactcggcaagcgatgcgaggatgacaaggtcaagctacagaacaacatctcataccagatggcggacatacaccacctgaaggagcaactggccgaactgaggcaagagttccttaggcaagaagatcaactgcaggattaccgcaagaataatacttatctcgtaaaaagactggaatacgagagtttccaatgcggccagcagatgaaggagctcagagctcagcacgaggaaaacatcaaaaaattggccgaccaatttttggaggagcaaaaacaagagactcaaaagatccagagcaacgatgggaaagagctcgatattaataaccaggtggttcctaagaacatccctaaggtggccgaaaatgtggcagacaagaatgaggaacctagctcgaaccacattccgcatggcaaggagcagatcaagagaggaggcgatgctgggatgcctggtatcgaggagaatgaccttgcgaaggtggacgacctgcccccagcgctccggaagccccccatctcagtatcacagcatgagtcacaccaggccattagtcaccttcccacaggccaacctctttcccccaacatgcctccggactcgcatataaaccacaacgggaaccccggaacatccaaacaaaacccttcgagccccctgcaacgcctgataccagggtccaacttggactcagaaccaagaattcagactgacatcctcaaacaggccactaaggaccgcgtctcggatttccacaaacttaaacaatctcggttctttgatgaaaacgagtctcctgtcgatccccagcacggatctaaactcgctgattacaacggcgatgacgggaacgtcggagagtatgaggctgacaaacaggcagagttggcttataacgaggaagaggatggggacggtggtgaagaagatgtgcaaggcgagcgcggacctggccttcacgccatcacaatgaaaccaacttcaaagtttttcggttag

SEQ ID NO: 24791 - DNA, 549 bp, Artificial Sequence
  Description of Artificial Sequence: Synthetic coding sequence
atgaagggctggggctggttggcattgctgttgggagcgttgctggggacggcgtgggcccgccgaagtcaggatctacactgcggagcatgcagagcgctggtcgacgaactcgaatgggagatcgctcaggtagatcccaaaaaaaccattcagatgggatctttcaggataaatcctgacggcagccagagcgtcgtggaggtgccctacgcacgcagtgaggcccatctcaccgaactactggaggagatttgcgatcgcatgaaggagtatggagagcagatagatccgtccacccaccggaaaaattacgtgagagtggtcggccgcaacggagagtctagcgaacttgatctgcagggtatcaggatcgactctgacatcagtggaactctgaagttcgcatgtgagtcgatcgtcgaggaatatgaagacgagttgatcgagttcttctccagagaagccgataatgtgaaggacaagttgtgcagtaagcgcaccgacctgtgcgatcacgctttgcacattagtcatgacgaactgtag

SEQ ID NO: 24792 - DNA, 507 bp, Artificial Sequence
  Description of Artificial Sequence: Synthetic coding sequence
atgaaagggtggggctggctggccctccttctcggggctctgctgggaactgcttgggctcggcgtagtcaggacctgcattgcggtgcttgtagagccctggtggatgagctggagtgggagatagcccaggtggacccaaagaagacaattcagatggggtcattccgcattaatcctgatggatcacagtcagtcgtggaggtcccttatgctagatctgaggcacacctgaccgagctgcttgaagaaatttgtgaccgaatgaaggagtacggggagcagatcgacccaagcactcatcgcaaaaattatgtgcgcgttgtgggaagaaatggtgagtccagtgagcttgatctccaagggatccgtatagactcggacatttccggtacccttaagttcgcatgcgaatccatcgtggaagagtatgaagatgagctcatcgaattcttctcaagggaggcagacaatgtgaaggataagctctgtagtaagagaacatag

SEQ ID NO: 24793 - DNA, 1644 bp, Artificial Sequence
  Description of Artificial Sequence: Synthetic coding sequence
atgaccaagaccgatcctgcccccatggctccccccccgcgtggagaggaagaagaggaggaagaggaggacgagcccgtaccagaggcacccagtcctactcaggagcgccggcagaaacctgtggtacacccctcagctcccgctccccttccaaaggattacgcttttacttttttcgatccaaacgatcctgcctgtcaggaaatcctcttcgatccccagacaactattcctgagctgttcgctatagttcgccagtgggtgcctcaggtccaacacaaaatcgacgtcatcggcaacgagatacttagaagaggctgccatgtcaacgacagggacggacttacagatatgactctgctccactacgcttgcaaggccggcgctcacggagtcggagaccccgctgccgctgtgagactgagccagcaactgttggcgctcggagccgacgtcaccctgcgctctaggtggactaacatgaacgccctccattacgccgcatatttcgatgtcccagatctggttcgggtgctattgaagggcgcccgaccccgggtcgtgaactcgacgtgctcagatttcaaccatggcagtgcgctgcacattgctgctagtagtctgtgtctgggcgccgctaagtgcctgctcgaacacggcgctaaccctgcccttcgtaatagaaagggacaggtacctgctgaggtagtaccagaccctatggacatgtcccttgacaaagcagaggcagctttggttgcaaaagagttgcggacactcctcgaggaggcggtgccactatcctgtgccctgcccaaggttacactgccaaactatgataacgttcccggaaacctgatgctgtccgccctcgggctgagattaggggacagagttctcttggatggacaaaagacaggcaccctgcgattttgcggtactaccgaattcgcatccggacagtgggttggggtggaacttgacgagcccgaggggaaaaatgacggatctgtcgggggggtgaggtactttatttgcccacctaagcagggactgtttgccagcgtctcaaagatttccaaggcggtcgacgccccacccagtagcgtcacgagcacacccagaaccccccgaatggatttcagtcgagtcaccggaaagggtagacgggaacataaggggaaaaagaaaaccccgtcctcaccgagtctaggctccctccaacagcgagatggcgccaaggccgaagtgggtgaccaggtgctggtcgcagggcagaagcagggtatagtcaggttctacggcaagaccgacttcgccccaggatactggtatggcatcgaattggaccagccaacaggaaaacacgacggatcagtatttggagttcgctattttacttgccccccacggcatggagtctttgccccagcttctcggatccagagaattggaggcagcacagatagcccgggcgactctgtcggtgccaagaaagtacatcaggtgaccatgacacagcctaaacgtacttttaccaccgtgagaacacccaaggacatcgcctccgagaacagcattagcagattactgttctgttgctggtttccctggatgctgagagccgagatgcagtcatag

SEQ ID NO: 24794 - DNA, 1572 bp, Artificial Sequence
  Description of Artificial Sequence: Synthetic coding sequence
atgaatcccagcccacgccccccagctcctccccgtagcgctggtcgcagccttctttgcacacccagacatctccccccatccctgagaaccaccttgaccttttttgacccaaatgatcccgcttgccaggagatattgtttgatcctcagaccacgattccagaactgttcgctatcgtccgtcaatgggtccctcaggtgcaacacaagattgacgtgatcggcaacgagattcttcggagagggtgccacgtaaatgatcgcgatggtttaaccgacatgacactgctgcactatgcatgcaaggcgggtgcacacggcgtcggggacccagcagctgccgtgcgactaagtcaacagctgttggctctaggagctgatgtgaccttacgcagcagatggacaaatatgaatgccctgcactatgctgcttacttcgatgtgcccgacctggtcagggtgctgttgaagggtgcccgacctagagtggtcaattcgacgtgctctgattttaatcatgggagcgccctccatatcgccgcctcatccctctgtttgggagcagccaaatgcctgttggaacatggcgccaaccccgcgctgagaaaccgtaaaggacaggttcccgccgaagtggtcccagatcccatggacatgagtctagataaagcggaggccgcattggtggccaaagagctacgcaccttgttggaggaggccgttcccttgagctgtgctttgcccaaagttaccctgcctaactacgataacgtgccgggcaatctcatgctctccgctttaggtctgcgccttggagatcgggtgcttcttgatgggcaaaaaaccggcacactgcggttctgtggcactacagagtttgccagcggacagtgggttggggtagagctggatgagcccgaagggaagaacgacggcagcgtgggtggggtaaggtacttcatttgtcctccgaagcaaggactgtttgccagcgtcagtaaaattagcaaagctgtggacgccccaccatcatctgtgacatctaccccacgcacaccccggatggacttttcgcgggtgacaggcaaaggtagacgcgagcacaagggcaaaaaaaagactccctcttctccctcactaggcagcctccaacagcgcgacggtgccaaagccgaagtaggcgaccaggtcctggtcgctgggcaaaagcaaggcatcgttagattctacggaaagaccgactttgcacctggatactggtacggaatcgagttggaccaaccgacaggcaagcacgacggttcagtgttcggtgttcggtacttcacttgccctcccagacacggagtttttgcccctgcaagtcgcattcagcggattggagggtccactgatagtcccggtgactccgtaggtgctaagaaagtacaccaagtcactatgacacaacccaagcggacattcaccacagtacgtaccccaaaagacatcgctagtgagaactctatcagcagactgctgttctgctgctggtttccctggatgctgagggcagaaatgcagtcctag

SEQ ID NO: 24795 - DNA, 1290 bp, Artificial Sequence
  Description of Artificial Sequence: Synthetic coding sequence
atgacacttttgcattacgcctgtaaggccggagcacacggagttggagatcccgccgcggccgtcaggctgtctcagcagctccttgctctgggggccgatgttactcttagatctcggtggaccaatatgaatgctttacattacgctgcttatttcgacgtgccagacctagtcagagtcttgctgaagggtgctcggcctcgcgtcgttaacagcacttgcagcgactttaatcacggaagtgcactgcacatcgccgctagctctctttgcttaggcgccgctaaatgtctgctcgagcatggagccaatccagcgttgcgcaaccgtaagggtcaggtacccgctgaggttgtacccgaccccatggacatgagcctcgacaaggctgaagccgctctagtcgccaaggagctgaggaccctgctggaggaagcagtacccctgtcatgcgctctgccaaaagtcactctgccaaactacgataatgtgcctggaaacctgatgctgtctgcactgggcctccgcctcggcgatcgcgttcttctcgatggccagaaaaccggaactctaagattttgtggcacgactgaattcgcttctgggcagtgggtcggtgtcgagctggatgaacccgagggtaagaacgatggatcggtggggggcgtccgatatttcatctgtccacccaagcagggcttgtttgcctctgtatccaaaatctcaaaggccgtggacgcacccccgtcaagcgtgacttccaccccacgaaccccacggatggacttttctagagtgactgggaagggaagaagagaacacaaaggaaagaagaagacgcccagttcaccgtctctggggtcgttacagcagagagatggcgcgaaggctgaggttggcgatcaggtgctggtagccggtcagaaacagggaattgtccggttttacggcaagactgatttcgcgcccggctattggtacggaattgaactggaccagcccaccggaaaacacgatggttctgtcttcggggtcaggtactttacgtgtcccccaaggcacggggttttcgcaccggcttcgcggatccaaaggatcggtggatccaccgatagccccggggatagcgtgggagccaaaaaggtgcaccaggtcaccatgacccagcctaagcgaacgtttacgaccgtgcgaaccccaaaagacatcgcttccgagaactccatctcacgcctgcttttttgctgttggtttccctggatgctgcgagcagaaatgcagagctag

SEQ ID NO: 24796 - DNA, 1059 bp, Artificial Sequence
  Description of Artificial Sequence: Synthetic coding sequence
atgaaaccagctcttcttgaagtgatgcggatgaatcgaatttgtcgcatggtgcttgctacttgcctaggaagcttcattctcgtgatcttttactttcagtctatgctacaccccgtcatgcggcgcaacccctttggggtggacatctgctgcaggaaaggttctcggtcccctcttcaggagctgtacaaccccatacagctcgagttaagcaacaccgccgtgctgcaccagatgaggcgggaccaggtgactgacacttgccgtgcaaattccgcaaccagcaggaaacggcgagtccttacccctaatgaccttaaacacttagtggtcgacgaggaccatgagcttatatattgctatgttcctaaagtcgcttgcaccaattggaaacgccttatgatggtgcttactggacgcggcaagtactctgaccccatggagattcccgcaaatgaggctcacgtgtcggctaacttaaagacactgaatcagtacagcatcccagagattaaccacagactgaagagttacatgaaattcctgttcgtacgcgagccattcgaacgcctggtatctgcctacaggaacaagttcacccaaaagtacaatatctcctttcacaaaagatacggaactaaaatcattaagcgccagcgcaaaaatgctactcaggaagctttacgaaagggcgacgacgttaagtttgaagagttcgtggcatacctcattgatccgcacacgcaacgggaggaacccttcaacgaacattggcagactgtatattccctgtgtcatccgtgccatatccattatgatttggtgggcaaatacgagacactggaggaagactctaactatgttctccagttggcgggggtaggatcttacctgaagtttcccacgtatgcaaaatccacgcgcacgacggatgaaatgaccaccgagttctttcagaacatctccagcgaacatcagacacagctctacgaagtgtacaaactcgacttccttatgttcaactactctgtacccagttacctgaaattagagtag

SEQ ID NO: 24797 - DNA, 1044 bp, Artificial Sequence
  Description of Artificial Sequence: Synthetic coding sequence
atgaagccggctctgctcgaggtgatgcgcatgaataggatttgtcgcatggtgctcgcaacttgcctcggcagctttatcctggtcatcttctactttcaaatcatgcgacggaacccttttggagtggatatctgctgcagaaagggcagtcgcagcccgctacaagagctgtacaacccaattcagttagaactctcaaacactgcagtgttgcatcaaatgcgtcgggatcaggtgaccgacacctgtagggccaactcggccacttctcgaaaaagaagagtcctgacaccaaatgacctaaaacatctcgtggttgacgaagaccacgagttaatttattgttacgttccgaaggtggcttgtacaaattggaagcggctaatgatggtgctcactggaagaggaaagtactcggatcccatggagatccctgcaaatgaagctcacgtgagcgcgaacctgaagaccctgaatcagtattcaataccggagataaatcacagactgaagtcctacatgaagtttctcttcgtgagagaaccttttgagagacttgtatccgcatacagaaacaagtttacccagaaatataatatctctttccacaagcggtatgggactaagatcataaagagacagcgcaagaatgctactcaggaagccctccggaaaggagacgatgtgaagttcgaggaatttgtcgcatacctgattgatccccatactcagagagaagagccattcaatgagcattggcagacggtctactctctgtgccacccatgtcatattcactacgatctcgtcggcaagtacgaaaccttagaagaggactccaactacgtcctccagctcgctggcgtcggaagttatctcaagtttcctacgtacgcaaagagcacaagaacaacagatgagatgacaacagaattctttcaaaacatttcaagtgagcatcaaactcaactttacgaggtttacaagctggacttcctaatgtttaactactccgtccccagctacctgaaattggaatag

SEQ ID NO: 24798 - DNA, 1245 bp, Artificial Sequence
  Description of Artificial Sequence: Synthetic coding sequence
atgaccaaagccaggctatttcggctttggttagtgctgggtagcgtgtttatgattttgctgatcatcgtgtactgggacagtgccggtgcggcacacttctacttgcatacttcatttagtcggccccacacaggcccccctcttcccacccctggaccagatcgcgatcgcgaactgactgcagactcggatgtcgatgagttcctggataagtttctcagcgctggggtgaagcaatccgacttgcccaggaaggagaccgaacagccacctgcgcctggctctatggaagagagcgttcggggatacgactggtcaccgagggatgcccgacggtcccccgaccagggcaggcagcaggccgagaggaggagtgtactgcgcggcttttgtgctaactccagccttgccttccccacaaaggaacgagccttcgatgatatcccaaattcggaactgtcacatctgatcgtggacgacaggcatggagctatttattgctacgtccccaaggtggcctgcacgaattggaaaagagtgatgatcgtgttgtccggaagtctgttgcaccgaggagctccctaccgagaccccctccgtatcccaagagagcacgttcacaatgccagtgctcacctgacattcaacaaattctggcgccgatatgggaaactgtccagacacctgatgaaggtaaaacttaagaaatatacgaaatttctgttcgttagagacccgtttgtcagactgatcagcgcgttccggtccaaattcgagctggaaaacgaagaattttaccgcaaatttgcagttcccatgctgcggctgtatgccaaccataccagtctccccgcctctgctagggaggctttccgcgcaggcctcaaggtcagcttcgccaattttattcagtatttgctcgaccctcatactgagaaactggctcctttcaacgaacactggaggcaggtatatagactgtgccacccctgccagattgactatgattttgtcggaaaactcgaaacactcgatgaagacgctgctcagctgctccagctgctgcaggtcgacagacagcttcgatttccacccagctatcgcaataggaccgccagttcatgggaggaggattggtttgccaaaattcccctggcatggcgccagcagctgtacaagctctacgaggctgactttgtattattcggctatcccaaaccagagaacctgctccgagattag

SEQ ID NO: 24799 - DNA, 738 bp, Artificial Sequence
  Description of Artificial Sequence: Synthetic coding sequence
atgacaaaggcacgcctgttcagactgtggctggtgttaggttccgtttttatgatcttactgattattgtttattgggactctgccggcgccgcccacttctacctgcacacatcattctctagaccccatacaggacctcctctgcccacgcctgggccagatagagatcgagagctcactgccgatagcgatgtagatgagtttctggacaagttcctgagcgctggtgtcaaacagtctgatctgccaaggaaagagactgaacaaccacccgccccgggttccatggaagagagcgtaagggggtacgattggagccctcgagacgctaggcgctccccagaccaggggagacagcaggccgagcggaggagtgtgttgagagggttttgtgccaattccagtttagccttcccaactaaggagcgagctttcgatgatattcccaattcggagctctcccacctgattgtagatgataggcacggcgcaatttactgctacgtccccaaggtcgcatgcacaaactggaagcgggtgatgattgtcttatctggaagcctactacatagaggagctccgtaccgcgacccgcttcgcatacctagggaacacgttcacaacgcctcagcccacctgacttttaataaattctggaggcgctacggtaagctcagtcgacacttaatgaaagttaagctgaagaaatacaccaagtttctgttcgtgagatag

SEQ ID NO: 24800 - DNA, 1026 bp, Artificial Sequence
  Description of Artificial Sequence: Synthetic coding sequence
atgggtcggaggtgctgccgacgcagagtgctcgccgcggcgtgtctgggagccgccctgttactgttgtgcgcagcccctcgcagcctcaggccagccttcgggaatcgcgctctcggatctagctggctcggtggagaaaagagatccccacttcaaaaattgtatgatctggaccaggatcctcgctccaccctggctaaagtacacagacagagacgggacctactaaactctgcgtgttcgcgccattcccgtcggcagagactactgcagccggaggatctgcggcacgtgctggtggacgacgcgcatgggctcttatattgctacgtacccaaggtcgcttgtacaaactggaagagggtccttctggctctgagtggtcaagcgcggggcgatccacgcgctatctctgcccaagaagcacacgcacccggccgcctgccaagtctggcagattttagtcccgctgagataaatcggcgacttcgagcttacttggcttttctttttgtacgggaaccattcgagcgactggcatctgcttaccgcaataaactggcaaggccttactctgcagccttccagcggagatacggggccaggatagtccagagactccgacccagggcgttgcctgacgcacgggcaagggggcacgatgtccgatttgcagaattcttggcatacctcctggacccgcggacaaggagagaagagccattcaatgaacattgggaacgcgcgcacgcgctctgtcacccatgccgcctcagatacgacgtggtagggaagttcgaaacgcttgccgaggacgctgccttcgtgctgggacttgccggggccagcgatttatcattcccaggtccccctagacctcgtggagctgccgcctcgagggacctcgcagcccgtttattcagggatatttctcccttctaccagagacgtttattcgatctttataagatggactttcttctgttcaattactcagcaccaagctacttgcgccttctgtag

SEQ ID NO: 24801 - DNA, 678 bp, Artificial Sequence
  Description of Artificial Sequence: Synthetic coding sequence
atgggcaggcggtgttgtcgacggcgagtattggccgcagcctgtctgggcgccgcactgctcttactctgcgcggctccccgctctctcagacctgcctttggaaatcgggccttagggtcctcttggctggggggcgaaaaacgctccccccttcagaagctgtacgatttagaccaggatccgaggtccacccttgccaaagtgcatcgccaaaggagggatttgcttaactccgcgtgttccaggcacagccggcgccagcgcctgctccagcctgaagacctgaggcatgtcctggtagatgatgcacatggtctgttatactgttatgtgcccaaagttgcttgtaccaattggaaacgcgttctccttgccctatctggacaagctcggggcgatccacgggccatcagtgcccaggaggcccacgcacccggacggttaccttccctggccgacttttcccccgccgaaatcaatagaaggctgagggcttacctggcattcctctttgtgagggagcccttcgaaaggctggccagtgcataccgaaataaactcgctcggacacggagcgcgacacgcgtggctagtgctacgacttcatgggcttcttcccgtcgctggagaagaacaagaccatcatgctgggcctggcgggcccaccccacctag

SEQ ID NO: 24802 - DNA, 1161 bp, Artificial Sequence
  Description of Artificial Sequence: Synthetic coding sequence
atgctcttacctaaaaaaatgaaattgctgctgtttctggtttcacaaatggctatactagctctctttttccacatgtatagtcacaacatatcttcattgtccatgaaggcacaacccgagagaatgcacgttcttgtgctgtcttcctggcgctcaggcagctctttcgtcggacagctcttcggacagcacccggatgtgttctacctcatggagcctgcgtggcatgtttggatgacgttcaagcagtccacagcttggatgctgcacatggccgtgagggacctgattcgggccgtcttcttatgcgacatgagcgtatttgatgcttacatggaacctgggccacgccggcagtccagcctgtttcagtgggagaatagccgcgccctttgctcggctccggcctgcgacattatcccacaggatgaaatcataccccgcgcacactgtcggctgctgtgtagccagcaaccattcgaggtcgtagaaaaagcatgtaggtcttatagccatgtagtcctgaaagaagtgcggttctttaatctgcagtctttataccctctgctcaaggatccatccctcaacctgcacattgtgcatctggtgcgtgaccctcgggccgtgttccggagccgggagagaactaagggcgacctgatgattgactctcggatagtgatgggccaacacgaacagaaactgaagaaagaggaccaaccttattatgtgatgcaagtgatttgccagtctcagcttgagatctacaagacaattcaatccttgcctaaggcgctccaagagcgatacctgctggtgaggtatgaggacctcgcccgcgcccctgtggcacagactagccgtatgtatgaattcgtcggcctggagtttttgccacatctgcagacctgggtgcacaatatcacgagaggaaaagggatgggggaccatgcatttcataccaatgcacgagacgccctcaatgtttctcaggcctggcgatggtctctcccctatgagaaggtgagtcgcctccagaaggcctgcggagacgctatgaatctccttggctatagacatgtccggtccgaacaggagcagaggaaccttctacttgatctactcagcacctggaccgtccctgagcaaattcattag

SEQ ID NO: 24803 - DNA, 1161 bp, Artificial Sequence
  Description of Artificial Sequence: Synthetic coding sequence
atgctactgccgaaaaagatgaagttactgcttttcctggtgtcacaaatggcgattctggctttattctttcacatgtatagccataatatttcctccctctccatgaaagctcagcccgaaagaatgcatgtactggtgctgtctagctggagatctggatccagctttgtggggcaactctttggccagcaccccgatgtcttttacctgatggaacctgcttggcatgtgtggatgactttcaaacagtctaccgcctggatgctccacatggctgtgagagatctgattagagcagtgttcttgtgtgacatgtctgtgtttgacgcatacatggagccagggcctcggcgtcagtccagcctgttccagtgggagaatagcagggctctgtgctcagcccccgcgtgcgacattatccctcaggacgaaataattccccgcgctcattgcaggctcttatgctcccagcagccattcgaggtcgtagaaaaggcctgccggtcatactcgcacgtcgtcctgaaggaagtacgcttctttaatctccagtccctctatccccttttgaaagacccttcactaaatttacacatcgtgcacctcgtgagagatcccagagccgttttcaggtcccgggaaaggactaagggcgacttgatgattgattcacgcatcgtgatgggacagcacgagcagaagctgaaaaaggaggatcagccttactacgtcatgcaggtgatttgccagtctcagctcgaaatctacaagactattcaatcacttccaaaggcccttcaagagcgctacctcttggtgaggtacgaggatcttgcccgcgctcctgtggcccagaccagcagaatgtacgagtttgtgggacttgagtttctgccacacttgcaaacatgggtccataatatcacaaggggtaagggcatgggcgatcacgcctttcatacgaatgcccgtgatgcactgaacgtatctcaggcttggaggtggtctttgccctatgagaaagtaagtaggctccagaaagcatgcggggatgccatgaatttgttgggttatcgccacgtgagaagcgaacaggagcaaaggaacctgctgctggatctgctgagtacatggactgtgccagaacagatccactag

SEQ ID NO: 24804 - DNA, 918 bp, Artificial Sequence
  Description of Artificial Sequence: Synthetic coding sequence
atgctaggccggaatacatggaaaacatccgccttttcgttccttgtagaacaaatgtgggcaccgttatggtcaaggtccatgcggcccgggcgatggtgttcacaacgaagttgtgcttggcagactagtaacaacacactccatcctttgtggacggttccggtgtcagtccccggggggaccagacagtctccaataaatatccagtggagagattcagtctatgacccacagctgaaaccattacgtgtctcctacgaggctgcatcatgtctttacatatggaataccggatatctgtttcaggtagagtttgatgatgccaccgaagccagcggcatctctgggggtccgctcgaaaatcactataggcttaagcagttccatttccattggggtgctgtgaatgaaggcggctctgagcataccgtggacggacatgcatatccagctgagttacacctcgtccactggaacagcgtgaaataccaaaactacaaagaagcagtggttggggagaacggtttggcggtaattggtgtatttttgaagctcggggcccatcaccagacactgcagcggctggtggatattctcccagagataaagcacaaagacgccagagccgccatgcgacctttcgaccctagtacacttctcccaacttgttgggattattggacatacgcaggaagtctgaccaccccccccctgaccgaatccgtcacttggataatccaaaaggaacccgttgaagtagcaccctcccagctgagtgcatttagaacgcttctgttttccgctctcggagaggaggaaaaaatgatggtgaacaactaccgccccctccagcctctcatgaaccgcaaggtgtgggcatcattccaggccaccaacgaagggacaaggtcatag

SEQ ID NO: 24805 - DNA, 714 bp, Artificial Sequence
  Description of Artificial Sequence: Synthetic coding sequence
atggataaggtatgtgctgtcttcggagggagtcgggggattggtcgagctgtggcccagctcatggctcggaagggctatcggttagccgttatagctagaaaccttgagggcgccaaagctgccgctggggacttggggggggatcacctagcttttagctgcgacgtggccaaagaacacgatgttcagaacaccttcgaggaacttgagaaacatctcgggcgcgttaacttcctggtcaatgcagctgggatcaatagggacgggttacttgtcaggactaaaacagaggatatggtgtcccaactgcacaccaatctgctgggctctatgctgacctgtaaagcagctatgaggaccatgattcagcaacaaggaggttcaatagttaacgtcggctccatagtcggactgaaaggcaattcaggtcaatcagtgtacagcgcgtctaaggggggcctggttgggttctcacgggctcttgcgaaagaagtcgcacgtaaaaagattcgcgtgaatgtagtcgcccccggctttgtccatacagatatgacgaaagacctgaaagaggaacacctgaagaagaatatacctctaggtcggtttggggaaactattgaggtggcccatgctgtcgttttcctcctggagagcccgtacattacggggcatgttctggttgtcgacggcggcctccagctgatcctctag

SEQ ID NO: 24806 - DNA, 540 bp, Artificial Sequence
  Description of Artificial Sequence: Synthetic coding sequence
atggataaagtgtgtgccgttttcgggggttccaggggtatcggcagagctgttgctcagctaatggcgcgcaagggctaccgtctcgcagtgattgccaggaacctcgagggcgccaaggccgctgccggggatctgggcggggaccaccttgcctttagctgtgatgtagctaaagagcatgatgtgcaaaatactttcgaagagcttgagaagcatctcgggcgtgttaattttcttgtgaatgcggccgggattaatagggacggcctactcgtgagaacaaaaactgaggatatggtctcccaactgcatacaaacctcctaggatctatgctgacctgtaaggccgctatgcgaaccatgatacaacagcagggtggcagcatagtcaacgtgggaagcatcgtgggactgaaaggcaactccggccagagcgtgtacagcgcctcaaaagggggccttgttgggttctctagggctctggcaaaggaggtggctaggaaaaagatccgagtgaacgtcgtggcacctggctag

SEQ ID NO: 24807 - DNA, 1872 bp, Artificial Sequence
  Description of Artificial Sequence: Synthetic coding sequence
atgactgcccagtctaggagccctacaacccccacattcccaggcccctctcagaggacaccactgacaccttgtcctgtccaaacaccacgactgggtaaagcactaattcactgctggactgatcccggccagcctttaggcgagcagcagcgggtgcgcaggcagaggactgagacgtctgagcctaccatgcgattgcataggttgagggcacgtctttctgctgtcgcctgtgggctcctgctacttctagtccgaggccaagggcaagacagcgcttcgcctatacgaactacccacaccggccaagttcttggatccttggttcacgtcaaaggggccaatgcaggagtgcaaacatttttgggaatccctttcgcaaaaccaccactcggcccattaaggtttgccccacccgaaccccccgagagttggtccggcgtgcgtgatgggaccactcacccagcaatgtgtcttcaggatttgacagcggtggaatccgaattcctgtcacagttcaacatgaccttcccttctgattcaatgtccgaggactgcttgtatctcagcatctatacaccggctcactctcatgagggaagtaatctgcccgtgatggtgtggattcacgggggagccctcgtgttcgggatggcttctttatacgacggtagcatgctagccgctctggaaaacgtggtggttgtaatcattcagtacagattaggggtattagggtttttctctacgggcgacaaacacgctactggaaattgggggtatttggaccaggttgcagcactgcggtgggtgcagcagaacatcgcccactttggaggcaaccctgatcgggtcactatttttggggagtccgctggcgggacaagtgtttccagcctagttgtatcgccaatttctcaggggctctttcacggagctatcatggaatccggggtggctttacttcccggcctgatagcttctagcgcagatgtgatatccactgtggtggccaatctctctgcatgtgatcaggtggatagcgaagcactggtgggctgtctgcggggcaaaagcaaagaggagatcttggccatcaataagccattcaagatgatccctggagtggtggacggtgtgttcctaccccggcacccacaagagcttctggcttctgcagactttcagcctgtcccgtcgatcgttggcgtcaacaacaatgagtttggttggttgatccctaaagtgatgcgcatctatgacacacagaaggaaatggatagggaagcgtcgcaggctgcactgcagaaaatgctgactcttctcatgctcccccccacatttggcgaccttctgcgcgaagagtatataggagacaacggcgatccacagactttgcaagctcagtttcaggagatgatggcagactccatgtttgttattcccgcactgcaggtggctcatttccagtgttctcgggcgcctgtttatttctatgagtttcaacaccagccatcttggcttaagaacatcagaccaccacacatgaaagcagatcacggcgacgaacttccctttgtgtttagatctttcttcggggggaactacattaaatttacagaggaagaggagcaactttccagaaaaatgatgaaatattgggcaaatttcgcacgtaatggcaaccccaatggagagggactgccccactggccgctgttcgaccaggaggaacagtacttacagctcaaccttcagcccgcagtgggtagagctctgaaggcccatcggctgcagttctggaaaaaggccctcccacagaaaatccaggagctggaggagcccgaagaaaggcacacagaattatag

SEQ ID NO: 24808 - DNA, 1824 bp, Artificial Sequence
  Description of Artificial Sequence: Synthetic coding sequence
atgacggcccaaagccggagccctactaccccaacgttccctggaccctctcagcgaacaccactaacaccctgtcccgtgcagacacccagactcggcaaagctctcatccattgttggactgatccaggacagccccttggcgagcagcagagagtcagaagacagcgcactgagacgtccgaaccgaccatgcggcttcaccggctgcgggcgaggctcagcgcagtggcctgcggtctgcttctcctgctcgttcgtggacagggccaagattccgcttcccctatccgaacaactcacactggtcaggtgttgggttccctggtgcacgtgaaaggggctaatgcaggtgttcaaacattccttgggattcctttcgctaagcctcctcttgggccactcaggtttgcaccgcctgagcccccagagtcatggtcgggcgtgagggacggtaccacacacccagctatgtgcctgcaggatctcacagcagtggaatcagaatttctgagtcaatttaatatgactttccctagtgatagcatgtccgaagattgtctctacctgtcgatatataccccagcgcactctcacgagggcagtaacctgcctgtaatggtgtggattcatggaggcgccctagtatttggcatggccagtttatacgacgggtcaatgctcgcagcactagaaaatgtggtagtcgtgattatccagtatcgcctgggcgtgctgggattcttcagcaccggggacaagcacgctaccgggaactggggatatctggatcaagtggctgctctccggtgggttcagcagaatatagcacatttcgggggtaacccagaccgggtgacaattttcggggagtccgcgggtgggacctctgtcagctcactggtcgtgtccccgatttcacagggactttttcacggagcaattatggagtctggtgtggctctgctgcctggactgatcgcttcctcagctgatgtgatcagcaccgtcgtggcaaatctcagcgcctgtgaccaagtggacagcgaggcccttgtcggctgcctgcgaggcaagagcaaagaggaaatcttggccataaacaagccttttaaaatgatccctggtgttgtcgatggggtgtttctacccagacaccctcaggagctactggcgtccgccgactttcagcccgtgccatccatagtgggggtcaataacaacgaattcggatggctgataccgaaggtgatgagaatttatgatacccaaaaggaaatggatcgcgaggcgtcacaggcagcgctccaaaaaatgctgaccttgttgatgctgcctcccactttcggagatcttctcagggaggagtacatcggtgataatggggatccacagactttacaggcccaatttcaggagatgatggctgactcaatgtttgtcatacccgcgctgcaggttgcccactttcagtgctctagagcccctgtgtacttctacgaatttcaacatcagccttcctggctgaagaatataaggccacctcacatgaaggcagatcacgtgaagttcaccgaagaggaggaacagttgtctcggaagatgatgaaatattgggcgaactttgctaggaatgggaaccctaatggcgaggggttacctcattggcctcttttcgatcaggaagaacagtacctccagctgaacctgcaacccgctgtgggtcgggcactcaaggcacatcgtctccagttttggaagaaagctctgcctcagaaaatccaggagctggaagaacctgaggagcggcatacagaactctag

SEQ ID NO: 24809 - DNA, 903 bp, Artificial Sequence
  Description of Artificial Sequence: Synthetic coding sequence
atggaaatcccgatgggaacccagggctgcttttctaaatctctcctcctgtccgcgtctatactggtgttatggatgcttcaaggaagccaggcagccttgtacatccaaaagatccccgagcagccccaaaaaaatcaagatctcttgttgtccgtgcagggcgtccccgacactttccaggactttaattggtatctgggtgaggagacctatggcgggacccggcttttcacatatatcccaggcattcagcggccacagcgggacggaagtgcaatgggccaacgggatattgtgggattccccaacggtagtatgctgctgcgtcgcgcacagccaacagatagcggcacctaccaggtggcaatcactatcaatagcgagtggactatgaaggctaagaccgaagtgcaggtggctgaaaaaaataaagagcttccatcaacccatttgccaaccaatgccggtatccttgctgccaccattatcggctctcttgcagctggggcccttctgatttcctgcatagcctatctgctggtcacacggaattggaggggacaatcccatcgcctgcccgcccctcggggacagggctcactgtccattttgtgctcagcagtgagccctgttccatccgtgaccccaagcacgtggatggctaccaccgaaaagcctgagctcggacccgcgcacgatgccggtgataataatatctacgaagtgatgccatctcctgtgctgctggtgagtccgataagcgacacccgttctatcaacccagctagacccttgccaacacccccccatctgcaggccgagccagagaaccaccagtaccaacaagacctacttaaccccgaccctgccccttactgccagcttgtgcccaccagctag

SEQ ID NO: 24810 - DNA, 900 bp, Artificial Sequence
  Description of Artificial Sequence: Synthetic coding sequence
atggaaatccccatgggcactcaaggttgtttttcaaaaagccttctgctgagcgcgagtatcctggtgctctggatgctccaaggcagtcaggcagctctctatatccaaaaaatccccgaacagcctcagaaaaaccaggacctgctgctctctgtgcagggagtgcccgacaccttccaggacttcaactggtacctgggcgaggagacttacggtgggacgcgcctattcacctacattcccggcatccaacggccccagagggacggatccgcgatggggcagagagacattgtcgggtttccgaatggaagcatgctcttgaggagagcccagcctacagatagcggcacataccaggttgccatcactattaactctgagtggaccatgaaagccaagaccgaggtccaggtcgcagagaaaaacaaggaattacccagtacacacctgccgacaaacgcgggtatattggccgcaacgatcatcggctcattggccgctggcgctctgctgatctcttgcattgcttatctcctggtcactcgcaattggcgggggcagtcccacaggctccccgctccaagaggccagggcagtctctcaatcctttgttccgccgtctcacctgtaccatctgtcacacccagcacttggatggcaacaaccgaaaagcctgagctaggccccgcgcatgatgccggagataataatatttacgaggtgatgccttcaccagtgctccttgtctcacctatttctgatacgagatcgataaaccccgccagacccctgccgacgcctccacacctccaagccgagcctgagaaccatcagtatcaggacctcttaaatccagatcctgcaccttattgtcagcttgttcctacctcctag

SEQ ID NO: 24811 - DNA, 879 bp, Artificial Sequence
  Description of Artificial Sequence: Synthetic coding sequence
atgggaccaccgtcggcctgtccgcacagggagtgtattccctggcaggggctcctcttgactgcatccctgctcacattttggaacgccccaacaactgcttggctgttcatcgctagtgctcctttcgaggtggctgagggagagaacgtgcacctgagcgtcgtttatttaccagagaacctatacagttatggttggtataaggggaagacggtcgagcctaatcagctgattgctgcatatgtcatcgatacccacgtgagaaccccagggcctgcttactccggccgggaaacaatcagcccttccggagacttgcatttccaaaatgttacactcgaagatacaggctactacacgctccaggttacttaccgaaactcgcagattgagcaggcttcacaccacctgcgcgtctacgagagcgtggcccagccctctatccaggcctcttcaacaactgttacagagaaggggagtgtggtccttacatgtcacaccaataacaccggcactagttttcagtggatcttcaataatcaacgtctgcaggtcaccaagcgcatgaagttaagttggtttaatcatatgctgaccatcgatccgatcaggcaagaggacgccggggaatatcagtgcgaggtgtccaatcctgtttcctcaaaccggagtgaccccttgaagctgactgtgaagtatgacaatactctggggattctgatcggcgtgctcgtggggtccttgctcgtggccgcactcgtttgttttctgctcctcagaaagaccggacgggcctcagaccagagcgacttccgggaacagcagcctccggcatccacccccggacacggaccttcggattcttcaatatcttag

SEQ ID NO: 24812 - DNA, 882 bp, Artificial Sequence
  Description of Artificial Sequence: Synthetic coding sequence
atgggtcccccgtctgcttgccctcaccgcgaatgtatcccatggcagggattgcttctcaccgcttcccttttaacgttctggaacgctccaacgactgcatggctttttatagcttctgcaccattcgaggtagcagaaggcgagaatgtgcacctctcggttgtctacttgcccgagaacctgtattcgtatggttggtacaaggggaagacagtcgagcccaaccagctcattgccgcctatgtcatagatacacacgtccggacacccggtccggcttactccgggcgggagactatttccccctctggtgatttgcatttccagaatgtgacgctggaagacacgggatattacacattgcaagtgacatacagaaatagccaaatcgagcaagcaagccatcatctgagggtatacgaaagcgttgcccagcccagcatacaagcaagctctacaaccgtgacggagaaggggagcgtcgtgctgacctgccacactaataacaccggtaccagctttcagtggatcttcaataaccagaggctgcaggtgacaaaacgaatgaagctgagttggttcaaccacatgctgacaattgaccccatcaggcaggaggatgcgggagaatatcagtgcgaagtcagtaatccagtctcaagcaatagatctgatccactaaagctgactgttaagagcgacgataatacgctgggcatactgatcggagtattggttggaagcctcctcgtggctgccctggtgtgcttcttacttctgcgcaagacagggagagcgtcggaccaatcagacttcagagaacagcaaccaccagcgtccactcccggacacggcccgtcagacagctccataagttag

SEQ ID NO: 24813 - DNA, 900 bp, Artificial Sequence
  Description of Artificial Sequence: Synthetic coding sequence
atgatggcttacatgaatccgggcccccattattctgtgaatgccctcgcgctttctggccccagtgtcgacctaatgcaccaggcggtgccctacccttctgctccccggaaacaacgacgggaacgcacaactttcacgaggtcccagctcgaagaacttgaagccctgttcgccaaaacccagtaccccgacgtatacgcgagagaggaggtcgccctcaagattaacttgccagagtctagagtgcaggtgtggtttaagaataggagggcgaagtgcaggcagcagcgccaacagcaaaaacaacagcagcagcctcccggtggccaggcgaaggctcggcctgccaaacgaaaggccgggacatccccccgcccttcgactgacgtgtgtccagacccgcttgggatcagtgactcctattcaccacccttacccggaccttctggttctcctacgaccgccgtcgctacggtttcaatctggtcgcccgcgagtgagtcgcctctgccggaggctcaaagagctggtctggtcgcatccggcccaagcttgacatccgcaccgtacgccatgacctacgcccccgccagcgcattttgtagtagtcctagcgcttatggctctccaagttcgtacttttccggactagacccgtatctgagccccatggtaccgcaactgggcggccccgctttatctccattgtccggacccagcgtaggcccgtctctagcccagagcccgaccagcctatcagggcagtcatacggcgcatacagtcctgttgactctttggagttcaaagaccctacaggaacgtggaaattcacatacaatcccatggaccccctggattacaaggatcaatccgcatggaagtttcagatcctctag

SEQ ID NO: 24814 - DNA, 639 bp, Artificial Sequence
  Description of Artificial Sequence: Synthetic coding sequence
atggggcccccatctgccagcccccatcgagaatgtatcccctggcagggtttactcttaactgcaagcctcctgaatttttggaaccccccaaccacagctaaactcaccattgagtccatgcccctctccgtggccgaaggcaaggaagtgctgctgttggtgcacaatctgcctcagcatctgttcgggtattcttggtacaaaggtgagagagtagatggcaatagtctgattgtcggatatgtgattggcacccagcaagccacaccgggagccgcatatagtggccgagagaccatctacactaacgcatcactcctcattcaaaatgtgactcagaatgatatcggcttctataccctgcaagtgatcaagtctgacctcgtcaacgaagaggcaacaggtcagtttcacgtataccaagagaatgctcctggtctccctgttggcgccgtcgctgggatcgtgaccggagtcttggtgggagtggctctagtggcagcgttagtttgcttccttctgttagcaaagactggtaggccgtggtccttgcctcaactatgcctgctcgacgtccccagtttacattgccccggtcctccaactcagccgcaagacagctccttccacctttag

SEQ ID NO: 24815 - DNA, 759 bp, Artificial Sequence
  Description of Artificial Sequence: Synthetic coding sequence
atgggaccgccaagtgctagcccgcatcgtgaatgtatcccatggcaggggctgttactcaccgctagtttacttaatttttggaacccaccaaccactgctaaactgaccatcgagagcatgcctctttccgttgccgaggggaaagaggtgttgctgctggtccacaatttgccccagcacctgttcggatatagctggtataagggcgaacgggtggacggcaattcgttaattgtgggatacgtgatagggacccaacaagccacccccggggctgcctatagtgggagggaaaccatttatacaaacgcctccctcctgatccagaatgtcacacaaaacgatatagggttttatactctgcaggtcattaaaagcgatttagtgaacgaagaggcgaccgggcagttccacgtctaccaagaaaatgccccaggcctcccggtgggggcagtggccggtattgttaccggcgtactggtcggagttgccttggttgcggcactggtgtgctttctacttctggctaagaccggacgtacctctatccagagggatctgaaggaacagcaacctcaggctcttgcaccgggccgagggcctagtcattctagcgcttttagtatgtccccactgtctactgctcaggcaccgcttcctaaccctcgaacagctgcgagtatttacgaggagctactgaaacacgacacaaatatttactgtcgcatggaccataaggcggaggttgcatcgtag

SEQ ID NO: 24816 - DNA, 534 bp, Artificial Sequence
  Description of Artificial Sequence: Synthetic coding sequence
atgggccccccttcagccagccctcatagagagtgcatcccatggcaagggctcctgctgaccgcttctctcctgaatttctggaatcctccaaccactgccaaactcacaattgagtccatgcccctttccgtcgccgagggcaaggaggtgctgctgctggtccataatctccctcaacacctttttggctatagctggtacaaaggtgagcgggtggacggtaacagcctgatcgtgggatatgtcatcgggactcaacaggccacccccggcgccgcgtattccggcagagaaactatatacacaaacgctagccttcttatccagaacgtaacccagaatgatattggcttttatacacttcaagtgatcaaaagcgacctagtcaacgaggaagctaccgggcagtttcatgtgtacccggagctccccaaaccctccatctcctcaaataacagtaatcctaaagaagacaaagatgctgtggcctttacgtgcgaaccagagattcacagcactacctgcctctag

SEQ ID NO: 24817 - DNA, 774 bp, Artificial Sequence
  Description of Artificial Sequence: Synthetic coding sequence
atggcagctccatgggccagtctgcgactggttgcccctatgtggaacggtagaattaggggcattcaccgcctcggcgcagccgtggcacctgagggcaatcagaagaaaaagaggaccattctgcagttcctgacaaattatttctacgacgtcgaggccctccgcgattacctgctgcagagagaaatgtacaaagtgcacgagaagaatcgctcttatacctggctggaaaaacaacacggaccatacggcgcaggcgccttctttatcctcaagcaaggaggggcggtcaagtttcgggacaaggagtggatccggccagataagtacggtcacttctcacaagagttttggaacttttgcgaggtaccagttgaggctgtggatgctggtgactgcgatatcaactatgagggtctcgataacctgctccgactcaaggagttgcaatccctatctctgcagcgatgttgtcatgtggatgactggtgcctgtcccggctgtatccactagccgatagtctccaagagctcagtttggcgggttgtccacgtatttcagaacgcgggctcgcttgcttgcatcatttacaaaaccttcggcgcctggacatttccgatcttcccgcagtcagcaaccccggtctgacacaaatattggttgaggaaatgttgccaaattgtgaggttgtgggcgtggattgggcagaagggctgaaatctggccctgaggaacagcccagggacaccgcaagtccagtgccggcatag

SEQ ID NO: 24818 - DNA, 798 bp, Artificial Sequence
  Description of Artificial Sequence: Synthetic coding sequence
atgggatcaccctcggcctgcccctacagagtgtgtattccctggcagggactcctgctgacagcaagcctgttaactttttggaatctcccaaattccgctcagaccaatattgacgtcgttcctttcaatgtggcagaggggaaggaggtgcttttggtagtccacaatgagagtcagaacctgtacggatataattggtataagggtgagagagtgcatgccaactatcggattatcgggtacgtcaaaaacatctcacaggaaaacgcaccggggcccgctcataacggaagagagacaatctaccctaatggtacactcctgatacagaatgttactcacaatgacgccggcttctatacgcttcatgtcattaaggagaacctagtcaacgaagaggtcacgaggcagttttacgtcttttccgagcctccgaaaccctccatcacctccaataatttcaaccccgtcgagaataaagacatcgttgtcctcacatgccagcctgagactcagaacaccacatacctttggtgggtaaataaccagtctttgctggtctcccctcggctgctgctgtctaccgataacaggaccctggtgctgctctcggccaccaagaatgatattggcccctatgaatgcgaaattcagaatcccgtgggggcttcgaggtctgatcccgtgacccttaacgtgagatacgagtctgtgcaggcctcttcgcctgacttgagcgctgggaccgctgtgagcattatgatcggagtgttggccggcatggctctgatatag

SEQ ID NO: 24819 - DNA, 519 bp, Artificial Sequence
  Description of Artificial Sequence: Synthetic coding sequence
atgggatccccttcggcctgcccttatcgtgtctgcattccatggcagggcctgctcttaactgctagtttattaacgttttggaatttaccaaattcggcacagacaaacattgatgtggtaccgtttaacgttgccgagggcaaagaggtgctgcttgtggtgcataacgagtcacagaacctgtatgggtacaactggtataaaggtgagagagtgcacgccaactaccgcatcattggttacgtaaagaacatctcacaggaaaacgctccaggtccagcccataatggacgggagaccatataccccaacggcaccttgttgattcagaatgttacccacaatgatgctggcttttatactcttcacgtgatcaaggaaaacttagttaatgaggaggttaccaggcaattctatgttttctatgaatccgtccaggcaagcagccctgacctgagcgcaggcaccgccgtcagtataatgatcggagtgctcgctggaatggctctgatatag

SEQ ID NO: 24820 - DNA, 798 bp, Artificial Sequence
  Description of Artificial Sequence: Synthetic coding sequence
atgggttcaccatcagcttgtccttacagggtctgtatcccgtggcagggattgctgctaacggcctctcttctcacattttggaacctcccaaacagtgcccagactaacattgacgttgtgcccttcaacgtcgccgaaggaaaggaggttctactcgtggtccacaatgaatcgcaaaacctgtacgggtacaactggtataagggtgagagggtgcatgccaattacaggattatcggatatgtcaaaaatatcagtcaggaaaatgcaccaggtccggcacataatggccgcgagactatttatcccaacggaacgctcctgatccaaaatgtgacacataatgacgccggattctacaccctgcatgtcatcaaggagaatctggtgaatgaggaggtcacacgtcagttttatgtattcagtgagcctccaaaacctagcattacgagtaataatttcaatccagtggagaataaagatatagtcgtgctgacatgtcagccagagacacaaaataccacttatctgtggtgggtgaacaaccagtctctgttagtcagcccacgactgttactgtctaccgacaatcgcacgctggtgttgctttcagccaccaagaacgatataggaccgtatgagtgcgagatccagaacccggtgggagccagtcgcagtgaccccgttaccctgaacgtccgttacgagtctgtgcaggcgtccagtccagacctctccgcaggcacggccgttagcatcatgatcggagtgctggccggcatggcactcatctag

SEQ ID NO: 24821 - DNA, 735 bp, Artificial Sequence
  Description of Artificial Sequence: Synthetic coding sequence
atggggtcgccatcagcatgtccttaccgcgtgtgtatcccatggcagggacttctccttacagcctccctgctgaccttttggaatctgccgaatagcgcacagaccaatatagacgtggtgcccttcaacgtggctgaaggaaaggaagtgctgttggtagtgcataacgaatcccagaacttatacgggtacaactggtacaagggcgaacgcgttcacgccaacggcagggagactatctatcctaatggaactctgctgatccagaacgtcacccacaacgatgcgggcttctatactctgcacgtgatcaaggagaatctggttaatgaagaagtgacccggcagttctacgtctttagtgaaccacctaagccttcaataaccagtaacaacttcaaccctgtggagaataaagatatcgtggtactcacatgtcaaccagaaacacagaacaccacttacttatggtgggtgaacaaccaaagtctgctggtgagcccacgcctcctgctctccacagataatcgaaccctggtcctcctttcagccaccaaaaatgatattggcccatacgaatgcgaaatacagaacccagtaggggcctctaggtcagatcccgtgactcttaacgtcaggtatgagtcggtccaggcctcaagtcctgacctcagcgcgggcaccgccgtgtccattatgatcggggtgctggcaggaatggcgctgatatag

SEQ ID NO: 24822 - DNA, 2361 bp, Artificial Sequence
  Description of Artificial Sequence: Synthetic coding sequence
atgaaaggaacaggtatcatggattgtgccccaaaagcactcctggcacgcgctttatacgacaattgcccagactgctccgatgagttagcattctctcggggcgacatattgacaattctggagcagcatgttcccgaatccgaagggtggtggaagtgtctcctgcacggtcgacaagggctagcacccgcaaatcgccttcagatcctgactgaagtcgctgccgaccgcccctgccctccgttcctgagaggtctggaggaggctcctgcatcttccgaggagacttatcaggtcccaaccttgccgcggccacccactcccggaccggtctatgaacagatgcggtcttgggcagaaggccctcagccacctactgctcaggtatatgagttcccggaccccccaacaagcgcgagaattatttgcgaaaaaactctctcattccccaagcaggcaattctgactttgccaaggccagttcgcgcatcgctccccacattacccagccaggtctacgacgtcccaacacagcatagggggccagtggtgctcaaagaacccgaaaagcagcagttatatgatattcctgcaagtcctaaaaaagccggccttcaccccccggatagccaggccagcgggcagggagtgcccttaatttccgtgactactcttagacggggaggctattcaacactccctaaccctcagaagagtgaatggatttacgacacccccgttagccctgggaaggcatctgttagaaacaccccattaaccagtttcgccgaagaatcgaggccgcacgctttaccttcaagctctagtaccttttataacccaccctccggccgaagccggtccctcacaccacagctcaataacaacgtaccgatgcagaaaaagctgagcctccccgagatcccctcttatggctttctcgtgcccagaggcacgtttcctttagacgaggatgtgtcgtacaaggtgccgagctcgttcctgatcccaagagtcgagcagcaaaacaccaagcccaacatctacgacatacccaaagcgacctcctctgtatcccaggctggcaaggagctagaaaaggctaaggaggtgtcggaaaattcagcaggacacaactcgtcttggttcagcagaaggaccacatcgccaagccctgaaccggaccggctgagcggaagctcgagtgactcaagagcctccatcgtctcctcatgctctacaacgagcacagacgatagcagcagctcaagctccgaagaatctgccaaggagctaagtttggatctcgatgtggccaaggaaacagttatggcactccagcataaggtggtcagctctgtggcaggtcttatgctgtttgtgtctcggaagtggaggtttcgtgactaccttgaggcaaatatcgacgcaatccacagatccaccgaccacatcgaggagagtgttagggagttcctggactttgccaggggagtgcatggaacagcttgtaaccttacggactcaaatcttcaaaaccgcattagggatcagatgcagaccatctcaaactcttacaggatcttgctggaaacaaaggagtcgctcgacaatcgcaattggcccctggaagtgctggttacagactccgttcagaactcccccgacgaccttgaacggtttgtgatggtggcgagaatgctccctgaagatatcaagcggtttgcatctatcgtcatcgctaacgggcgactgctgttcaagcggaactgtgaaaaagaagaaacagtacagttaacaccgaatgctgagtttaagtgcgaaaaatatatccaacctccccagcgcgagacggagtcccaccagaaatccactccgagcactaagcagcgggaggacgaacatagcagtgagctcctaaaaaagaaccgcgcgaatatttgtgggcagaacccaggccctctcatcccacagcctagttcacagcagacccccgagcgcaagcctagactgagtgagcactgccggctttactttggggcactctttaaggccatttctgccttccacgggagcctttcaagctcacagccagccgagatcattacgcagtccaagctagttattatggtgggccagaagctggtggataccctttgtatggaaacccaggaacgagatgtcaggaacgaaatcctgaggggatctagccacctttgcagtcttttaaaagacgtcgctcttgccaccaaaaacgcagttctgacatacccctcaccagccgctctggggcacctccaagccgaagctgagaagctggagcaacatactaggcagtttcgtgggaccctgggctag

SEQ ID NO: 24823 - DNA, 2361 bp, Artificial Sequence
  Description of Artificial Sequence: Synthetic coding sequence
atgaagggaactggcatcatggactgtgctccaaaagccctccttgctagagcactttatgacaattgtccggactgttcggatgagctggccttctcaaggggtgatatccttaccatactggaacaacacgtgccagagagcgagggctggtggaaatgtctattgcatggacggcaagggctggccccagcgaacaggttgcagattctcactgaggtcgctgccgatcgcccgtgcccgccatttctacgggggctggaagaagcacctgcgagctctgaagagacctaccaagtgcccacgctccccaggccgccaacccccgggcccgtgtatgaacaaatgcgcagctgggccgaggggccgcagcctccaaccgcccaggtctacgaattccctgatccacccacatcagctagaattatttgtgagaagacacttagcttcccaaagcaagcaattctgacattgcctcgacccgtgagggcttctttgcctactctccctagtcaggtgtacgatgttccaactcagcatcgaggtcccgtcgtgctgaaggagccagaaaagcagcagctgtatgatattcccgcaagtccgaagaaggccgggcttcaccccccagactcccaagcatctgggcagggagtacctctcatctcagtgaccaccttgaggaggggcggctactcaactctgcctaacccacagaaaagcgaatggatttatgacacacccgtctcccctggcaaagcaagcgtgcgtaacacaccacttacttctttcgctgaggagtccagaccacacgcactgccttccagtagtagcacattttacaatcccccttccgggcgttccaggtctttgaccccacagctaaacaacaatgtgcctatgcagaagaagctgtccctacccgagataccctcttatggtttcctggtgcctcggggcacctttcccctggacgaagacgttagctataaggtgccgtcatccttcttgatccccagggtggagcagcagaacaccaagcctaatatttacgatatccctaaggctacctcctctgtttctcaggccggaaaggagctggaaaaggccaaggaggtgagtgagaacagcgccggacataactcctcttggttcagtcggaggactacctcaccctctcccgagccggatcgattatctggatcgtcttcagactcaagggcaagcatcgtgtcaagctgttccactaccagtacagacgatagctcatcgtcaagctccgaggagtcagcaaaggaactttctttggatctcgatgttgcaaaagagacagtgatggcactgcagcataaagtggtgtcgtcagtggctggcctcatgctgtttgtcagcagaaaatggcgttttagagactacctggaggccaacattgatgccattcaccgctctactgatcacatcgaggagtccgtgcgggagttcctggactttgcccgcggcgtgcacggcactgcatgcaatctgaccgattcaaatttgcaaaatagaattcgggaccagatgcagactattagtaattcttataggattctgctcgagacgaaggaaagtctggacaatcgaaactggcccctggaagtcttagtcactgactcggtgcaaaatagccccgacgacctcgaacgcttcgtgatggtggccaggatgctccccgaagatattaaacgatttgccagtattgtcatagccaacgggcgcctcttgttcaagcggaattgcgagaaggaagagactgtgcagcttacgcctaatgcagagttcaagtgcgagaagtacattcaaccgccacagagagaaacggagagccaccagaagtcaaccccatccaccaagcagcgcgaggatgaacacagtagtgaacttctgaagaagaacagggccaatatctgcggacagaacccagggcctcttatcccccagccatccagccagcagactcctgagcgtaagccgcgactctccgagcactgtcggctctactttggagccctgtttaaggcaatctcagcattccacggatccttgtcaagctcccagccggctgaaatcatcacccagtctaaactggtcataatggttgggcagaaactggtcgatacgctctgcatggaaacgcaggagcgcgacgttcgaaacgagattcttcgaggctcaagccatctatgtagccttcttaaggacgtggccctcgccaccaagaatgccgtcctgacctatccttcgccagcagccttaggccatctgcaggcagaagcagagaagctcgaacaacacacacgtcaattcaggggtactctggggtag

SEQ ID NO: 24824 - DNA, 1050 bp, Artificial Sequence
  Description of Artificial Sequence: Synthetic coding sequence
atgaagggcacggggatcatggattgtgcccctaaagccctgttggcacgggctctgtatgataattgccctgattgcagcgatgaactcgctttttctaggggtgatatcttaactatcctggagcagcacgtgccagaaagtgagggttggtggaaatgcttgcttcacggccgacaaggactggctcctgcaaacagactccagattttgaccgaagtagctgccgatcgaccctgcccaccatttctgcgcgggctggaggaagcacccgcgtcttcagaagagacctaccaagttcctacattacctcgccctcccacgcccggccctgtgtacgagcagatgaggtcctgggccgaaggaccccagcccccgacagcgcaagtgtatgagtttcctgatccgccaacgtcagctcgtattatttgtgagaaaactctgtctttccccaagcaggctatcctgaccctccctagacctgtgcgcgcatcactcccgactctgccctctcaagtctacgacgttccaacccagcaccgtggaccagtggtccttaaagagccagaaaagcaacagctgtacgacatcccagcgagcccgaaaaaggccggactacacccaccggacagtcaagcctcaaatcctgggcctcttattccacagccctccagccagcagacccccgagcgcaaaccaaggcttagtgagcactgccggctgtattttggcgccttattcaaggctatttccgcgttccacggcagcctttcctcatcacagccagccgagatcattacccaaagtaaattagtgattatggtcggccagaagttggtagacacgttgtgtatggagacgcaggagcgtgatgtaaggaatgagatacttcgtggaagcagccatctgtgcagtttactgaaggacgttgctctcgccaccaaaaacgcagtgctgacatacccctcccctgcagcgctcggccatttgcaggcagaggccgaaaagctcgagcaacacacgcgccagtttcgaggcacgcttggttag

SEQ ID NO: 24825 - DNA, 687 bp, Artificial Sequence
  Description of Artificial Sequence: Synthetic coding sequence
atgagtagctcagaagaggtaagttggatctcatggttctgtggcctgcggggaaacgaatttttttgcgaggtcgacgaggactatatccaagacaaatttaaccttacaggtttgaatgagcaggtacctcactaccgccaagctctggacatgatactggatctggaaccagacgaggagctggaagataatcctaatcagagcgacctgatcgagcaggccgccgagatgctgtacgggctgattcacgcgcgttatatactgacaaatcggggcattgcgcagatgttagagaagtaccagcaaggggatttcggctattgtccccgagtatactgtgaaaaccagcctatgctccccatcggactgtctgatattcccggcgaagccatggtcaaactatactgcccgaaatgcatggatgtgtacacccctaaatcttctagacatcatcacactgatggggcctatttcgggaccggatttccacatatgctgttcatggtgcacccggaatacagacccaagaggcccgcgaaccaattcgtgccatcctcctgttctcggcatcccgatgttcccctgctgcctcgaagacgccccttttgtcgtatgcactttagattaagagaagtttaccatcaacagcttatccccgtgcacggcgaccatcatcttctgtag

SEQ ID NO: 24826 - DNA, 1182 bp, Artificial Sequence
  Description of Artificial Sequence: Synthetic coding sequence
atgtacgcctggttcttcctgccaagcttcagtcagagtccacccaccttcggtttcctgttggatatcgacggagttctggttcggggccaccgggttattccggccgctctaaaagcctttcgcagactggtaaatagtcaggggcagctccgcgtgcctgtggtgtttgtgaccaacgctggcaacatcctgcagcatagcaaggcacaggaactgtctgcgctcctgggatgtgaggtagatgcagatcaagtgatcctatctcattctcctatgaagctgttttctgagtaccatgaaaaacgcatgcttgttagcggtcaggggccggttatggaaaatgcccagggccttgggtttcgcaatgtcgtaacagtcgacgagttgcggatggccttcccgctgttggacatggtcgatctggagaggcgactcaaaaccacgcccctgccccgcaatgatttccctcggattgaaggcgtactgctgctaggtgagccggtgcgttgggagacctctctccagctcattatggacgtgttgttgagtaacggctctccaggcgcgggattggccacgcccccgtatccccatttgccagtgttagccagcaacatggatctcctttggatggcagaagctaagatgcccagatttggacacggcaccttcctgttgtgcctagaaacaatctaccagaaagtgacggggaaggaactgcgctacgaagggctaatgggaaagccctccattctgacctatcagtatgcggaagacttgattcgccgccaggccgagcggcgagggtgggcggcaccaatccgaaagctctacgctgttggggataacccaatgtccgacgtctacggtgcaaatcttttccatcagtatctccaaaaggccacccacgacggagccccagagcttggcgctggtgggacacgacaacagcagccctcagcgagccaaagttgcatatccatcctggtgtgcaccggcgtttacaaccccaggaatccccagtctaccgaacccgtgctcgggggaggggaacccccgttccacggtcaccgcgacctgtgtttctctcccggacttatggaggcatcacatgtcgttaatgacgttaatgaggctgtgcagctggtttttcgaaaggaaggctgggccctggagtag

SEQ ID NO: 24827 - DNA, 1272 bp, Artificial Sequence
  Description of Artificial Sequence: Synthetic coding sequence
atggccgcttggggttgtgtggcagctctgggtgcggcgagaggactctgctggcgtgccgccagggcagcggccgggttgcagggccgccccgcccgtaggtgttatgccgttggtcctgcgcagtcaccccctacttttggattcttgctagatatagacggtgttctcgtgcggggacacagggttatcccagcggcactgaaagctttccgccgcttggtgaattcgcagggccaacttcgggtgcccgtcgtgtttgttactaacgccggcaacatcctgcagcactcaaaggcacaggagctgagtgccctgctgggctgtgaggtagacgctgaccaggtgatcctgtcccacagtcccatgaaactctttagcgagtaccacgagaagagaatgcttgtcagtggtcagggacccgtcatggagaacgctcaggggctgggatttagaaacgtggtgaccgtggacgagctccgtatggcctttccactgttagacatggtcgacctggaacggcggttaaagactacccctttgcctcgcaatgacttccctaggatcgaaggcgttctgctgctgggtgagccagtgcggtgggaaacctcactgcaactgataatggacgtgctgctgtccaacggaagccctggagcaggcctggccacaccgccatatcctcatcttcccgtactagcatcaaatatggacctgttatggatggcggaggccaagatgcctagattcggtcatggtactttccttctgtgcttggaaaccatataccagaaagtaacaggcaaggagctccgatacgagggtttgatggggaagcccagcatcctgacttaccagtatgctgaggacctgatccgcaggcaagcagagaggaggggatgggccgcacccattcgcaagctatacgctgttggcgataaccctatgtcagacgtttacggcgccaacctttttcaccagtacttacagaaggctacccatgacggagcaccagagctaggagccggcggtacgagacagcagcagccctctgcaagccagtcctgcatcagtatccttgtctgtactggggtttacaacccaaggaacccccaatccacagaaccagtgctgggcggcggcgagcccccttttcatgggcaccgagacctgtgtttctctcctggcttaatggaagctagtcacgttgttaatgacgtgaacgaagcggtgcagctcgttttccgcaaggagggatgggcgctggagtag

SEQ ID NO: 24828 - DNA, 789 bp, Artificial Sequence
  Description of Artificial Sequence: Synthetic coding sequence
atgactcagccagttccccgcctgagcgttccagccgccctggcactcgggtccgccgcccttggggcagcgttcgctactggcttgtttttggggcgccgctgcccaccctggcggggtagacgggaacaatgcctgctacctcctgaggacagcagactgtggcaatatcttctctcaaggtctatgagggagcatcccgcgctcaggagtctgcgtttactgacactggagcagccacagggtgattcaatgatgacctgtgagcaggcacagcttctggcgaacctggcgcgcttgatccaggccaagaaggccctggacctcggcaccttcacaggctactcagctctggccctggctctggcacttccagcagacggccgggttgtaacctgtgaggttgatgcccagccgccagaacttggcaggccactgtggcggcaggccgaggcggagcacaagatagatttgcggttgaaacctgccctagagacacttgatgagctcctggccgccggagaggccggaactttcgacgtcgctgtggtggacgccgataaagaaaactgtagcgcctactatgaaaggtgtttgcaactgctgcgaccaggaggaattttggcagtgttgcgggtgctgtggagaggtaaggtactccagccacccaagggggatgtcgcagctgaatgcgtcaggaatctcaacgagagaatcaggcgggatgtaagagtctatatctccttgttgccacttggcgacggactgactttagcttttaagatttag

SEQ ID NO: 24829 - DNA, 864 bp, Artificial Sequence
  Description of Artificial Sequence: Synthetic coding sequence
atgacgcagccagtgccccgcctttccgtcccagccgccctggccctcggcagtgccgctcttggagccgccttcgcaaccggactcttccttgggcgacgctgtccaccatggagagggcgccgagaacaatgtctactccctccggaggacagcaggttgtggcagtatctgctgtctcggtcaatgcgagaacatccagccctgagaagtctcaggctgttgacactcgagcagccccagggcgactcaatgatgacttgcgagcaggcccagctgctggccaacctagcccgccttattcaagctaagaaggctctggacctgggaacctttaccggctactccgcgctagccctggcactggccctgcctgctgacggcagagtcgtaacctgtgaggtggacgccggccgtgggggagctcaagaccgtccccctgcagaggcacgcttaggggatcccggacgtgctgcagggggtggccgtggtcgccatttacgtcggggccgcgggggctgtggccagggggaactgctccgcctcttgcgggctctccctgcagccgccgctacaagaaggcaccctcggagaccgcaaagtcccgtcgcgcgtgagggggccgcgacgagcgagaggggtcgaggcggccgtgtatgtgctaaacccaagcgcacacaccccgcaggtaggcagggactgcatcaaccgcccgctcccggccggtggacccacctcgggctacaggacttaggtctagctccaagtgagtgggccaggggccgcgtggcctgggagccccaggagttgacactcagctttaagttcgagaataaggtcggtcttggacacaccaccagctag

SEQ ID NO: 24830 - DNA, 966 bp, Artificial Sequence
  Description of Artificial Sequence: Synthetic coding sequence
atggacgtcagggccttgccttggctcccatggctgttgtggttactatgccggggaggaggcgacgccgactcgcgcgcaccctttactccaacctggccaaggtcacgcgaacgtgaggccgcggcttttagggaaagcctgaaccgccatcggtacttaaactccctcttccccagcgaaaactccaccgccttttacggtattaaccaattttcatatctgtttccagaagagtttaaagcaatttatcttcgtagcaagcccagtaaatttcctagatattcagcagaggtgcacatgtccatcccgaacgtctccctgccactgcggtttgactggcgggataaacaggtcgtgactcaggttcgtaatcaacagatgtgcggagggtgctgggcgtttagcgtggtgggagccgtcgagtctgcctacgctattaaggggaagcctctagaagacctgagcgttcagcaggtgattgattgctcatataacaactacgggtgcaacggcggatcgaccctgaacgccctaaattggttgaacaaaatgcaggtgaagctggtaaaagactctgagtaccctttcaaagcccagaatggactttgtcattacttctccgggtctcacagtggctttagcattaaaggatactccgcttacgatttttctgatcaggaggatgagatggccaaggcccttttgactttcggaccccttgttgtgatcgttgacgctgtgtcctggcaggattacttgggaggtataattcagcaccattgttcttccggagaggccaatcacgcggttttgataactggctttgacaagactggctctacaccctattggatcgtaaggaactcatggggcagcagttggggcgtcgacggttacgcgcatgttaaaatgggatcaaacgtatgtggaatcgccgatagcgtgagctccatctttgtgtag

SEQ ID NO: 24831 - DNA, 1593 bp, Artificial Sequence
  Description of Artificial Sequence: Synthetic coding sequence
atggccgcataccagcaggaggaacagatgcagctgccacgagcggacgctatacgctctcgcctgatcgacaccttttctttaatcgagcacctgcaaggcttgagccaggcagttccacgccacaccattcgggagctgctggacccttctaggcaaaagaagcttgtgctcggggatcagcatcagttggtcaggttctctattaaacctcaacgtattgaacaaatctctcatgcccaaaggctactgagccgactgcacgtgaggtgctctcagcgacctccgctgtctctctgggccggctgggtcctggagtgccctctgttcaagaactttataattttcctcgtctttctgaatacgattattcttatggtggaaattgagctgctagaatccacaaacactaagttgtggcccctgaaactcacgctggaagtggcagcctggtttatactgctgatctttatattggagattctcctcaaatggctgtctaatttcagtgtattctggaagagcgcatggaacgtcttcgattttgtggtaacgatgctgtccttactgccagaagtagtggtcctggtaggcgttaccggtcagagcgtgtggctccaattactgcggatctgtcgggtcctccggagcttgaagttgctggctcagtttcggcaaatccagatcatcattttggtcctcgtgcgggcactgaaatctatgaccttcttgctgatgctcctgctgatctttttctatatttttgcagtaactggagtatatgtattcagcgagtatacacgctctccccgtcaggacctagaataccacgtgttcttcagtgatctgcctaactcactagtgacagtgtttatcctgttcacgttggatcattggtatgctttgctgcaagatgtgtggaaggtgcctgaggtatcccgaatcttcagctccatttacttcattctgtggcttcttctgggatctatcattttcagaagtataatcgttgctatgatggtaaccaacttccagaacatccggaaagaactgaatgaagaaatggcacggcgcgaggtccagctgaaagcagacatgtttaagcggcagattattcagagacggaaaaacatgtcccatgaggccctgactagcagtcactcaaagatcgaagatagtagccgcggtgcctctcagcaacgggaatcacttgacctatcagaagtgagtgaagtcgagtctaattacggcgctaccgaggaagatctgatcaccagtgccagcaaaaccgaagagaccttgagcaagaaaagagagtaccagtcatcctcgtgcgtatcatccacatcatcctcatactcaagtagctcagaatctcgtttctctgagagtatcggacggctggactgggagacactggttcacgagaaccttcctggcctgatggaaatggatcaggacgacagagtctggcctcgcgacagtctgttccgctactttgagctgttggaaaagttgcagtacaatctcgaggaacgcaagaaactgcaggaatttgccgtccaggcactgatgaatctggaagacaagtag

SEQ ID NO: 24832 - DNA, 1593 bp, Artificial Sequence
  Description of Artificial Sequence: Synthetic coding sequence
atggctgcttatcagcaagaggagcagatgcagttgccccgggccgacgctatcaggagtagacttattgacaccttctccctgatcgaacatctgcaaggtctcagtcaggctgttccccgacatacaatccgggagctcttggacccttctcggcagaaaaagctggtcttaggcgatcaacaccaactcgtgagattctctatcaagccgcagcgtattgagcagatctcgcacgcgcagcggttgctcagtagactccacgttcgttgcagccagcggccacctctctcgctgtgggccggatgggttctggagtgtccgctgtttaaaaattttatcatttttctcgttttcctgaacaccattatcctgatggtagaaattgagctgctagaatctactaataccaaattatggccactgaagttgacactggaggtcgctgcgtggttcattctgctcatttttatcttggagatccttctcaaatggttgtccaatttctctgtgttctggaagtccgcttggaatgttttcgacttcgtcgttaccatgctctctctcttgcctgaggtggtggtgctggtaggggtcaccggccagtccgtgtggttacaactgcttagaatttgccgagtgctgagatcactgaaattgctcgcgcaatttagacagatccagattattattctggttcttgtgagagccctaaagtctatgacttttctactgatgttgctccttatattcttttacatttttgccgtgactggggtctacgtgttctccgaatacacacggtcaccccgccaggacttggaataccacgttttctttagcgatctgcctaactcacttgtgaccgtgttcatcctttttaccctcgatcattggtacgctctgctccaggatgtttggaaggtgcctgaggtttcccgcatcttctcatcaatctactttatcctctggctgttgctcggcagcatcatcttccgcagtattatcgtggccatgatggtcacaaactttcaaaatatccgcaaagagctgaacgaggagatggctagacgcgaggttcagttgaaagctgatatgtttaagaggcagattattcagagacgcaaaaacatgagccatgaagcattaacaagttcacatagtaaaatcgaggactcaagcaggggggcttctcagcagcgcgaatccctggaccttagtgaggtgagcgaggtggagagtaactacggggcaaccgaggaagatctcataaccagcgccagcaagactgaggagactctgtctaagaagagggagtatcaaagcagctcttgcgtttcaagcactagttccagctactcttcatccagtgagtctcgctttagcgagtcaattggacggttagattgggagacgctcgtgcacgagaatctccctggcctgatggaaatggatcaagacgacagagtttggccccgtgattcactgtttcgttatttcgaactgcttgagaagttgcagtataatctcgaagaacggaagaaattacaggaattcgccgtacaggcgctgatgaatctcgaagataaatag

SEQ ID NO: 24833 - DNA, 1587 bp, Artificial Sequence
  Description of Artificial Sequence: Synthetic coding sequence
atggccgcttaccaacaggaagagcagatgcagttgccccgggcggacgctattcggtcgcgtcttattgatacatttagcctaatcgaacacttgcagggactgtcccaggcagtcccccgtcacaccataagagagctgctggatccctctcgccagaaaaagctggtgcttggcgatcaacatcagctggtgaggttttcgattaagccccagcgaatcgagcagatctctcacgctcagcgactgctgtctcggctgcacgtgagatgctcacagagacctcctcttagcctatgggcgggttgggtgctcgagtgccccctgtttaagaactttatcatattcctcgtgtttctgaacaccattattctaatggtggagattgaacttctggagagcacaaacacaaaactgtggccactgaagctcaccctagaggtagcagcctggttcattttactgatctttattctggaaatattgctgaaatggttgtcgaatttctctgttttttggaagagcgcttggaacgtgttcgacttcgtcgtcaccatgttgagtttgctgccggaggttgtggtcctggtaggggtgaccggacagtcagtgtggttgcagctgttacgcatttgcagagttttacgatccctgaagcttcttgcgcagtttcgtcagatacaaattattattttggtactagtcagagccctaaagtctatgactttcttgttgatgttgctactgatattcttttacatctttgccgttaccggcgtgtatgttttttcagagtacaccagaagcccacgccaggatctagagtatcacgtgtttttctctgatttacctaactctttagtgacagtgttcatcctctttaccctagatcattggtatgcacttctgcaagatgtctggaaggtgccagaggtctctaggattttttccagtatctacttcatactttggctgctgctcggctccattatctttcgaagcataatagtcgcaatgatggtgacaaactttcagaatattcgaaaggagctgaatgaggaaatggcaaggagagaagtgcagttgaaggcggacatgtttaaaaggcaaattatccagcggaggaagaatatgtctcatgaagcgctgaccagctcacattcaaaaattgaggatcggggtgcctcacagcagcgggaatccctagatctatcagaggtgtccgaagtggagagtaactacggtgcaacagaggaagacttaatcacaagtgcctcaaagaccgaggagaccctgtctaagaagcgggaataccagagttcctcctgcgtgtcttccaccagttcatcatattcaagttcctcagagagtcgtttttctgagagcatcggaaggctcgactgggagacacttgtccatgaaaatcttcccggtctcatggagatggaccaagatgatcgcgtctggccccgcgactccttgttcaggtacttcgagctgttggaaaagctgcagtataatctggaagaaaggaaaaaattgcaggaattcgccgtgcaggcactcatgaacttggaagacaagtag

SEQ ID NO: 24834 - DNA, 1245 bp, Artificial Sequence
  Description of Artificial Sequence: Synthetic coding sequence
atggccgcctaccagcaagaagaacaaatgcaactgcccagggcagacgcaatacgttcacgtctcatagatacattttcactcatcgaacacctgcaagggctcagtcaagctgtgcccaggcatactatcagagaacttttggaccctagccgccagaagaagctggtgctgggcgaccagcaccagttagtccggttttcaatcaaacctcaaaggatcgaacagatctcacacgcacagaggcttctcagccgtttacatgtgcggtgtagtcagcgccctcccctgtccttatgggctggctgggtgcttgaatgccctctctttaagaacttcatcatctttttggtttttctgaacactatcatcctcatggtcgaaattgagctcctggagtctacaaataccaaattgtggcccctcaaactcaccctggaggttgctgcatggtttatcctgctaatatttatcctggaaattcttctgaaatggttgtctaactttagcgtgttctggaagagtgcttggaatgtttttgacttcgtagtcaccatgctgtccctgctaccggaagtagtagtgctggtgggcgttacaggccagagtgtttggctccaactattaagaatctgcagagtcctgcgctctctgaaacttttagcacagttcagacagattcagatcattattctggtgctcgtccgggctctgaagtccatgacattcctgctcatgctgctcttaatcttcttctatatcttcgcggtcacgggagtctacgtcttcagcgagtatacacgctcaccccggcaagatctggagtaccacgttttcttctcggacctgcccaactccctggtgactgtgttcatcctgtttacacttgatcactggtacgctctcctccaggacgtctggaaggttccagaagtctccaggatattctccagcatctatttcatactgtggctgctgttagggagtatcatatttagaagtattatcgtggcaatgatggtgacaaattttcagaacattaggaaagaactgaatgaggagatggcccggcgcgaggtgcagcttaaagccgatatgttcaaaaggcagattatccagagaagaaagaatatgagtcacgaggctctgacctcctcccatagcaagattgaagacagatctttcggactgggagactcatgtgctaggaagagtgccagagcaaacggcaatggctcaggctag

SEQ ID NO: 24835 - DNA, 1587 bp, Artificial Sequence
  Description of Artificial Sequence: Synthetic coding sequence
atggccgcctatcagcaggaggagcaaatgcagttaccccgtgcagatgcaattaggagtagattgatcgatacgttctccttgatcgagcacttgcagggcctgtcccaagctgtcccccgccacaccattcgcgagcttctggacccatcacggcagaagaaattggtgctgggagatcagcaccagctcgtgcgctttagtatcaaacctcaaagaattgaacagatctcgcacgcccagagactactctctcggctccacgtacgttgttctcagcggcctcccctgagcctgtgggccggttgggttctggagtgtccactgtttaaaaacttcatcatcttccttgtatttctgaataccattatcctgatggtggagattgagctgttggagtccaccaatacaaagctatggccccttaaactgaccctcgaagtggctgcatggttcatccttctcatatttatattggagatccttctcaagtggttatctaacttcagcgtcttctggaaatctgcttggaatgtctttgatttcgttgttactatgctgagcctcctgcccgaagttgtggttttggtgggcgtcacgggccagagtgtgtggctgcagctcctccggatttgccgggtactgcgaagcctgaaactcctggcgcagtttcgtcagatccagattattatcttggtgctagtgcgtgcactgaaaagcatgacctttctgcttatgctgctgcttatctttttttatatctttgcagtcacaggagtctacgtgttcagcgagtacactagaagcccacggcaagatctagaatatcatgtgttctttagcgatttgcccaactccctcgtgactgtgtttatcctgtttaccctggaccattggtatgctttacttcaggacgtgtggaaggtgccagaagttagcaggatcttttcctccatttattttatcctctggctactccttggatccatcatcttccgaagcatcatagttgccatgatggtgacaaacttccagaatattcgtaaagagctgaacgaggagatggctcggagggaggtgcagctcaaggccgacatgtttaagcgccaaatcattcagcgtagaaagaacatgagtcacgaagccctgacatcctcacacagcaagattgaagatagaggcgcctcgcagcagagggagtcactggacctgagtgaagtttctgaggtggaatccaactacggggccacagaggaggatctgatcaccagcgcctccaagacagaggagaccctgtccaagaagagggaatatcagtcatcatcctgtgtatcctctactagttctagttactcttcctcatctgagtctcgattctcagaatccataggacgcctggattgggagactctggtccatgagaacttacccggccttatggagatggaccaggacgacagagtatggccgagggatagcctttttaggtactttgagttactggaaaaactccagtacaatctggaggaaaggaagaagctgcaggagttcgctgttcaggctctcatgaacctagaagacaaatag

SEQ ID NO: 24836 - DNA, 195 bp, Artificial Sequence
  Description of Artificial Sequence: Synthetic coding sequence
atggccgcttaccagcaggaagaacagatgcagctcccccgcgccgatgccattagatccagactgatcgacacattctccctgattgagcatctgcagggcctgtcacaggctgttccgcgccatacgatccgggaacttcttgacccatcacgccaaaagaaattggtgctcggcgaccagcaccagctgtag

SEQ ID NO: 24837 - DNA, 147 bp, Artificial Sequence
  Description of Artificial Sequence: Synthetic coding sequence
atggctgcatatcagcaggaggagcagatgcaactgccaagggccgatgctatccggtccagacttattgacacattctctctcatcgagcacctccagggtctcagccaggcagtcccacgacataccatccgggaactcctctag

SEQ ID NO: 24838 - DNA, 243 bp, Artificial Sequence
  Description of Artificial Sequence: Synthetic coding sequence
atggccgcttatcagcaggaagaacagatgcagctgccaagagcggatgccatccgctcgcgactgattgatacattttccctgattgaacacctgcaggggctgtctcaggccgttccaagacacaccatacgggagctgctagatccttcaagacaaaaaaaactggttctgggagatcaacatcagctggtgcgattcagtattaaaccccagagaatcgagcagatctcccacgcctag

SEQ ID NO: 24839 - DNA, 1449 bp, Artificial Sequence
  Description of Artificial Sequence: Synthetic coding sequence
atggctgccgcggccgccggggctggttctggcccctgggcggctcaagagaagcagtttcctcctgccctcctttccttctttatctacaacccgagattcggccccagggaagggcaggaagagaacaaaattctattttaccaccccaacgaggttgaaaagaacgaaaagatcagaaatgtgggactgtgtgaagctatcgtccagtttaccagaacattcagcccgagcaagcccgctaaatccctgcatacccagaagaatcggcagttttttaacgagcctgaagagaatttctggatggtgatggttgttcgtaatccaataattgagaagcagagtaaagatggaaaacctgtgatcgagtatcaggaagaagagctcctcgacaaagtgtactcgtccgtgttgagacagtgctacagcatgtataaattattcaatggaaccttcttgaaggctatggaggatgggggcgtgaaactgctgaaggagaggctggaaaagtttttccatcggtaccttcagaccctccacttgcaatcctgcgacctgttggacatttttggcggtatcagcttttttcctctcgacaagatgacatacctgaagattcaatcctttattaatcgtatggaggagtccctgaatatagtcaagtacacggctttcttgtacaatgatcagttgatctggagcggtttggaacaggacgacatgcgaattctgtacaagtacctaacgacatccttatttcctcgccatattgaacccgagctcgcaggtagagactccccgattcgagctgagatgccaggcaatctccagcactatggacggtttctgacggggcctctaaacctgaacgaccccgatgccaaatgccgctttcctaagattttcgtgaataccgatgatacctacgaagaactgcacctgattgtttacaaagccatgtccgccgctgtctgctttatgatcgacgcttccgttcaccccaccctggacttctgtcgacggctggatagcatcgtgggcccacagctgacggtcctggccagtgacatttgtgagcagtttaacattaacaagagaatgtccggttctgagaaggagcctcagttcaaattcatctattttaatcacatgaatctggcagaaaagtcgacagttcacatgagaaagaccccgtccgtcagtctgacatcagttcacccagatttgatgaagatcctcggagatatcaacagtgatttcactcgagtcgacgaggacgaggaaattatcgtcaaggctatgtctgattactgggtggtaggcaagaagtccgaccggcgggaactttacgtgatcctgaatcaaaagaacgctaacctcattgaggtgaatgaagaagtgaaaaaactatgcgccactcagtttaacaatattttcttcctggactag

SEQ ID NO: 24840 - DNA, 1020 bp, Artificial Sequence
  Description of Artificial Sequence: Synthetic coding sequence
atgtataaactgtttaacggcacatttctcaaggccatggaggatggtggcgtgaagctcttgaaggaacgcctggaaaagttcttccacaggtacttacaaacgctgcacttgcagagctgtgacctcttagatatctttggaggcatttctttcttcccgttagacaagatgacgtatctcaagatccagtcgtttattaatcggatggaggagtctctgaacattgtgaagtatactgccttcctgtataacgaccagctgatttggagtggactggaacaggatgatatgcggatcctgtacaaatatctcaccacctccctattccctcgccacatagaaccagaactggccgggcgggatagccccattcgagctgagatgccaggtaacctgcagcattacggcagattcttgaccggcccgctgaatctaaacgaccccgatgccaagtgccgcttcccaaagatatttgtgaatactgacgatacgtatgaagaactgcacctcattgtctacaaagcaatgagtgctgcagtctgctttatgattgacgcctccgtgcatccaaccctggatttttgcaggagactagactccatcgtcggaccccagctgaccgtcttggcatctgacatttgcgagcaattcaatattaacaaacggatgagtggaagtgagaaagagccacaattcaaattcatttatttcaatcacatgaacctcgctgaaaaatctacagtgcacatgcgtaagactccatcagtcagcctaacgagtgtgcaccctgacctaatgaagatcctaggagacattaattctgattttactcgagtggatgaggacgaggagatcatcgtcaaagccatgagcgactattgggtggtcgggaaaaagtctgatcgcagagagctgtatgtgatactgaaccagaaaaatgccaacttgattgaggtaaacgaagaggttaagaaactgtgcgccacccaatttaacaacatcttcttccttgactag

SEQ ID NO: 24841 - DNA, 1449 bp, Artificial Sequence
  Description of Artificial Sequence: Synthetic coding sequence
atggcggccgctgccgctggcgccggatctggtccttgggcagcacaggaaaagcagtttcccccagctctgcttagtttcttcatttacaatccaagattcgggccccgagagggacaggaggaaaataaaattctcttctatcaccctaatgaagtggagaagaacgagaaaatccgcaatgtgggtctgtgcgaggctatcgtccaatttaccaggacattctccccctccaagccagctaagtcattacatacacagaaaaacaggcaattcttcaatgagcccgaagagaacttctggatggtcatggtggtgagaaatccgatcatagaaaaacaaagcaaggatggtaagcccgtgatcgaatatcaggaagaagagctacttgacaaggtgtactcatccgtgctacgtcaatgctactctatgtacaagctcttcaacgggacctttcttaaggcaatggaggacggaggcgtgaagttactcaaagaacgcctggagaaattctttcatcgctacctgcagacccttcatctgcagagctgtgacttgctcgacatatttggcgggatctcgttttttccccttgataaaatgacgtacttaaagattcagtctttcattaatcggatggaagagagtcttaacatcgtcaagtacacagcgtttctgtacaacgatcaattgatttggtccggcctagaacaggacgacatgcgaatcctgtataaatatcttaccacttccctgttcccaagacacattgaaccagaactggcaggcagagattctccgatccgcgcggagatgccaggcaatttacagcactacggccggttcttgacaggcccattgaacctgaatgacccagacgcaaaatgcaggttcccaaagatttttgttaacactgatgacacctatgaagaactgcatctcattgtttataaggcaatgtcagcagcggtttgcttcatgatcgacgcctccgtccacccaaccctggacttttgccggcgcctggattccatagtcggcccccaattaaccgtgctcgctagtgatatctgcgagcagtttaatattaacaaaaggatgtccgggagcgagaaggagccgcagttcaagtttatctatttcaaccatatgaatctcgctgaaaagtccactgtacatatgagaaagaccccttcggtgtcgctgacaagtgtgcaccctgacctgatgaagattttgggtgatatcaactcagattttacacgggtggacgaggacgaggagattattgttaaggcaatgagtgattattgggtcgtcggcaagaaaagcgatcgaagagagctgtatgtgattttaaaccagaaaaatgctaacctcatcgaggtgaacgaagaggtgaagaaactttgcgctacacagttcaataatattttttttctcgactag

SEQ ID NO: 24842 - DNA, 1020 bp, Artificial Sequence
  Description of Artificial Sequence: Synthetic coding sequence
atgtacaaattgtttaacggaacttttctgaaagccatggaggacggcggagtgaaactgttaaaagagaggctcgaaaaattttttcacaggtaccttcagacactccacctgcagtcctgtgatctgttggacatattcggtggaatttccttcttccctttagataagatgacatacctcaagatccaatcttttatcaaccggatggaggaatctttaaacatcgtcaaatacacagctttcctgtacaacgatcaactcatttggagcggactggagcaggacgatatgagaatcctgtataagtatctcaccaccagcctgttcccccgccacattgaacccgagctcgctgggcgcgattcacccattagggcggagatgcctggtaacttacagcactacggcagatttctcaccggccctttaaacctcaacgatcctgacgcaaagtgccgcttccccaagatctttgttaataccgacgacacatacgaggagctacacctgattgtgtataaggctatgtccgctgccgtttgttttatgattgacgcgtctgttcaccccactctggacttttgccgaaggctggactctatcgtaggtccacagctgactgttctcgcctctgatatctgcgagcagttcaacattaacaagcgaatgtcaggttccgaaaaggagccccagttcaagttcatctacttcaatcacatgaaccttgctgaaaagagcacagtccatatgaggaagacccctagcgtctcattaactagtgtgcaccccgacctgatgaaaatcctgggggacatcaactctgattttacccgggtggatgaggacgaggagatcattgtgaaagccatgagtgactattgggtggtcggtaaaaagtctgataggagagaactctatgtgattctcaaccagaagaatgctaacctcatcgaggtaaacgaggaagtcaaaaagctgtgcgccacacaattcaataacattttctttctcgactag

SEQ ID NO: 24843 - DNA, 3066 bp, Artificial Sequence
  Description of Artificial Sequence: Synthetic coding sequence
atggctggcatttcctatgtcgcgagctttttcctgttgttaaccaagctttccatcggccagagagaagtcacagtgcaaaagggtcccctgttcagagccgaaggatatcccgtgagcatcgggtgcaacgtgactgggcatcagggcccctcagaacaacatttccaatggtccgtatacctgcctacgaacccaactcaggaggtgcagataatttccaccaaagatgctgcctttagctatgccgtctacacgcagagggttcgttctggagacgtgtacgttgagcgtgtgcagggaaatagtgttttgttgcatatcagtaagctgcagatgaaagacgcgggcgaatacgagtgccacacacctaatactgatgagaaatattatgggtcttacagcgccaaaacaaacctgatcgttatccctgataccctgtcagccaccatgtccagccagaccctaggcaaggaggaaggtgaaccacttgcactcacatgcgaagctagcaaggcaacagcacagcatacacacctctccgtaacgtggtacctcactcaagacgggggcggttcacaggcaaccgagattatttccttgagtaaagactttattcttgttcccggaccactttataccgaaagatttgcagccagtgatgtgcaactgaataaattagggcctacaacctttaggctgtctatcgaacgcctacaaagctctgatcaaggacaactgttttgtgaggcaactgaatggattcaggaccctgacgagacctggatgtttatcacaaagaaacaaacggatcagaccactctccgcatccagcctgccgtgaaagattttcaggtaaacatcacagccgattcgctgttcgccgaaggaaagcccctcgaactcgtgtgcctcgttgttagctccgggagagatccacagctgcaaggtatttggttcttcaacggaacagagattgcccatattgacgctggaggagttctcggtctgaaaaatgactataaagagcgagcatcacagggcgaactgcaggtctctaaattaggccctaaagcgttcagcctgaaaatcttctcactggggcccgaagatgaaggggcctaccggtgcgtggtggctgaggtaatgaaaacccgaactggcagttggcaggttttgcagcggaagcagagccctgattcgcacgtccacctccgtaaacccgccgcaaggagcgtcgtcatgagcaccaagaataaacagcaggtggtgtgggagggcgaaactctggctttcctttgtaaggctggaggcgccgaatctccgctttcagtctcttggtggcatattccacgagatcagacccagcccgaatttgtggccggcatgggtcaggatgggattgtgcaactcggagcatcctacggcgttccaagctatcacgggaatactcggcttgagaaaatggattgggccaccttccaacttgagattaccttcaccgctattaccgattccggtacctatgaatgcagagtgtctgagaaaagtcgcaaccaagcacgcgatctcagctggacgcagaaaataagtgtcacagtgaagtctttagaatcttctcttcaagtgtctttgatgtctaggcagcctcaggtcatgttgactaacacattcgatctcagctgtgtcgtgagggctgggtactcagatctcaaggtgcctctgaccgttacatggcaattccagcccgcctcttcccatatctttcaccagctcattcgcataacacataacggcaccattgaatggggcaattttctgtcacgctttcagaaaaagaccaaagtgtcccagagcttgtttagatcgcagttattagtgcacgacgcaactgaggaggagaccggtgtgtaccagtgcgaggtggaagtttacgatagaaacagcttatataacaaccgccccccacgcgcatctgctatcagtcaccccctcaggattgccgttaccctcccagagtctaagttaaaggtgaacagtaggtctcaggtgcaggagctaagcataaattccaatacggacatcgaatgttccattttgtctcgtagtaacggcaacctccagctcgccatcatatggtatttttcccctgtcagcactaatgccagctggctgaagattctcgaaatggaccaaaccaatgtgataaaaacgggtgatgagttccataccccacaacgtaaacagaagttccacacagagaaagtgtcacaggacctcttccagctccatattctgaatgtcgaggatagtgatcgaggcaagtaccattgcgccgtagaggaatggttactgtctactaatggaacctggcataagctgggagaaaagaagtcaggacttaccgaattgaaattgaagcctaccggctcaaaggtgagagtgagcaaggtttattggactgaaaatgttaccgagcacagggaagtggcaatcagatgcagcctcgaaagtgtagggagtagcgccacgctgtatagcgtcatgtggtattggaacagagagaattctggaagcaaactccttgtacatcttcaacacgacggactcctggagtacggagaagagggactgagacgacatcttcactgctaccggtccagcagcacggatttcgtgctgaaactacatcaggtagagatggaagatgcaggcatgtattggtgcagagtcgcggaatggcagctgcatgggcacccttctaaatggatcaaccaggccagcgacgagtcacaacgaatggtgctgaccgtgctcccttccgaacctacattaccgtcaagaatttgttctagcgcccctctcctttatttcttgttcatttgtccatttgtcctgctactgctgttactgatctcattactgtgcctgtattggaaggctcggaaactgtccaccctgagaagcaacacgaggaaagaaaaagccctttgggtcgacctaaaggaggctggcggggtcacaacaaatagaagagaagacgaggaggaggatgaaggtaactag

SEQ ID NO: 24844 - DNA, 3066 bp, Artificial Sequence
  Description of Artificial Sequence: Synthetic coding sequence
atggctgggatttcatacgtggccagttttttccttttactcacaaaactctcaattggtcaacgggaagttacagtgcagaaggggccattattccgggctgagggttatcccgtgtcaatcggttgcaatgtgacgggccatcagggaccctccgagcagcattttcagtggagtgtttacctgccaacaaacccgacacaggaagttcagatcatcagcacaaaagacgcagcattttcctacgcagtttacactcagagggtacggagtggagatgtctatgtggagcgcgtgcaagggaactctgttctgctccacatatccaaactgcagatgaaagatgcgggcgaatatgagtgccacaccccaaatacggatgaaaagtactacgggtcctatagcgcaaagaccaatctcatcgtgatccctgataccctcagtgccaccatgtcttcccagaccttgggtaaggaggaaggggagccactggcattaacgtgtgaagcaagtaaggcgacagctcaacatacccatctctcagtcacatggtacttaacacaagatggaggcggcagtcaggccacggagatcatttcattgagtaaggattttatactcgtgccagggcctctgtacaccgaacggtttgccgcttctgatgtccaactcaacaagctcggaccaaccacgttccgactcagtattgaacgtctacagtcaagcgaccaaggccaattattctgcgaggccacagagtggatccaagacccagatgaaacatggatgttcattacgaagaagcaaactgatcagacaacgctgcgcatacaaccagcagtgaaagacttccaggtgaacatcactgccgattctttgtttgctgaaggcaagccacttgagctggtatgtctagtcgtctccagtgggcgcgatcctcagctgcaggggatttggttctttaacggaacagaaattgcccacatcgacgctggtggcgtgctcggcctgaaaaatgattacaaggaaagagcaagccagggagaactgcaggtgtcaaaactgggccccaaagcgttcagcctgaagatcttttcactgggtcccgaagatgagggcgcttatcggtgcgtggtggcagaggtgatgaaaactaggacaggatcctggcaggtgcttcagaggaagcagtcccccgactcccacgtacacctgcggaagcctgccgctcggagcgtggtaatgtcaaccaagaataaacaacaggtggtgtgggagggcgaaaccctcgcctttttatgtaaagccggcggcgcagagtctcccctgagcgtatcttggtggcacatcccaagggaccaaacacagcctgagttcgtagcaggtatgggccaggatggtatcgtgcagttgggtgccagctatggagtgcctagctaccacggcaatacccgcttagagaagatggattgggccaccttccagttagaaatcacattcacggctatcaccgactcggggacctatgaatgtcgggtgtctgagaagagtagaaaccaggctagagatctgagttggacccagaaaatcagcgtaactgttaagagtctcgaatccagcttacaggtctcgcttatgtctcggcagcctcaggtgatgcttaccaataccttcgatctgtcgtgtgtcgtgcgtgcaggttactcggacctgaaggtccctctgaccgtaacttggcagtttcagccagcaagcagtcacatttttcaccaactcattcggattacgcataatggaacaatcgaatggggcaacttcctctctcggtttcaaaagaagaccaaggtgtcacaaagcttgttccggtcacaactgctagtgcacgatgcaactgaagaggagactggagtgtaccagtgcgaagtagaagtatatgacaggaacagcctctacaacaatagacccccacgagcctcggcaatcagtcacccattgcgaatcgccgtgaccctcccggagagcaaacttaaggtaaattcaagaagtcaagtgcaagagctcagcatcaattccaataccgacatagagtgcagcatcctgagccggtctaatggtaacctgcagctggcgatcatctggtatttctctcctgtgagtacaaatgcatcatggcttaagatccttgagatggatcaaaccaacgtcattaagacaggcgacgagtttcacacacctcaacggaagcagaaattccatactgagaaagtgtcccaggacttgtttcaattacatatcctgaatgtcgaggactctgacaggggtaagtatcactgcgccgttgaggaatggctcctgagcaccaacggaacctggcataagctgggagagaagaaaagtggtctgacagaattaaagctgaagcctaccggtagcaaagtccgggtaagtaaggtgtactggactgagaatgtgacagagcaccgagaagtggcgatcaggtgctcccttgagagcgtggggagtagcgcgaccctgtacagcgtgatgtggtactggaacagagagaacagtggttccaaattactagtgcatctacaacatgacggcctgttggagtacggggaagaaggcctacggcggcacctccactgttatcgatcatcctctaccgacttcgtgcttaaactgcatcaggtggagatggaggacgccgggatgtattggtgcagggttgcagaatggcagttgcacggacaccctagtaagtggataaaccaggcgtctgacgaaagccaacggatggtgctcactgtgctcccttcagagcccactctgccctctcgaatttgttcaagtgcgcccctgttgtatttcctctttatatgtcccttcgtgctgttattgcttctgcttatcagtctgctgtgcctatactggaaagcaagaaagctttctacactgagatccaataccaggaaagagaaggccctgtgggtggatctgaaggaagccggcggcgttacaacgaatagacgcgaagacgaagaagaggatgagggcaactag

SEQ ID NO: 24845 - DNA, 546 bp, Artificial Sequence
  Description of Artificial Sequence: Synthetic coding sequence
atgctactggaacccggtcgcggatgttgcgccctggccatcctcctggccatcgtggatatccagagcggggggtgcattaacattacatctagcgctagccaggaagggactaggctgaatttaatctgcacagtttggcacaagaaggaggaagctgaaggatttgtggtgtttctttgtaaggatcgctctggcgattgtagtccagaaacttctctgaagcaacttcggctaaagcgagacccaggaattgacggagttggagaaatcagctctcagttaatgtttacaatatcccaagtgaccccactgcacagcggtacctatcaatgctgcgctagaagtcaaaaatcaggaatcagactacaagggcacttcttctctatactctttacagaaacaggcaactacacggtcaccggtcttaagcagagacagcacctagagttttcccacaacgagggcacgttgtcatcagggtttttacaggaaaaggtctgggtgatgctcgtgaccagtctagtggcgctgcaagcactctag

SEQ ID NO: 24846 - DNA, 546 bp, Artificial Sequence
  Description of Artificial Sequence: Synthetic coding sequence
atgctgttggaacccggccggggttgttgcgcccttgcaatacttcttgcaatcgtggatatccagtctgggggctgtattaacattacctcaagtgcatcccaggagggaacccgtctaaacttaatctgcacagtgtggcacaaaaaagaggaagccgagggattcgtggtattcctatgtaaagataggagtggcgattgctctcctgagacaagcctgaaacagctgcgcctaaagagggaccctggcatagacggcgtaggggagatatcttcacagcttatgttcaccatatcacaggtgaccccgttgcactccgggacctatcagtgctgcgccaggagccagaagtccggcattcgcctgcaggggcactttttttctatcttgtttactgagacaggcaactacaccgtgacaggacttaaacagcgacaacatctggagttttctcacaacgaaggcactctttcctctggatttctgcaagaaaaagtctgggtgatgctggtcacaagcctggtcgccttgcaggcactgtag

SEQ ID NO: 24847 - DNA, 378 bp, Artificial Sequence
  Description of Artificial Sequence: Synthetic coding sequence
atgctgctggaacccggtaggggctgctgtgcattggcaatacttctggcaattgtggatatccaatctggcgaaacaggcaattatacagtgaccggcttaaagcagcggcagcatctggagttttctcataatgaggggaccctgagtagcggttttctccaggagaaagtttgggtaatgctggtaacaagtctggtggccctgcagggcatgagcaaacgggcagtctctaccccctccaatgagggcgcaataattttcctccccccttggctcttctccagaagacgtagactggagcgtatgtcgcgaggtagagaaaaatgttattccagtccgggctacccgcaagagtccagcaatcagtttcactag

SEQ ID NO: 24848 - DNA, 546 bp, Artificial Sequence
  Description of Artificial Sequence: Synthetic coding sequence
atgctgcttgaacctggtagagggtgctgtgctttggccattttgctggctatcgtggacatccagtctgggggatgcattaatatcaccagcagtgcatcgcaggagggaacccggctgaacttgatctgcactgtgtggcacaagaaagaggaggccgaggggttcgtcgttttcctctgtaaggatcgaagcggagactgctcgcccgaaaccagccttaagcagctacggctgaaacgcgatcctggcattgatggagtcggcgaaatctctagtcagctcatgtttaccattagtcaagtcacacccttgcattctggcacttatcaatgttgtgcccggtcacaaaaatcaggcatccgcctgcaaggacacttcttttctattttgttcaccgagaccggcaattacacagttacagggctgaaacagcggcagcacctggagttctctcacaatgagggaaccttaagtagcggattcctgcaggagaaggtctgggtgatgctggttacatccctggtggcattgcaggccctctag

SEQ ID NO: 24849 - DNA, 516 bp, Artificial Sequence
  Description of Artificial Sequence: Synthetic coding sequence
atggaagcacccgggccacgtgccctgagaactgccctgtgtggcgggtgttgctgtctacttctgtgcgcccaactggctgtggccgggaagggcgcccgtggattcggcaggggggccttgattcgactcaacatctggcctgctgtgcaaggtgcgtgtaagcagctggaggtgtgtgagcactgcgtcgagggtgaccgggcccggaatctgtccagctgcatgtgggagcagtgccgtcccgaggagcccgggcattgcgtcgcccagagcgaggtcgtcaaagaaggatgtagcatttataaccgaagcgaggcctgtccagggaaaggagtcctggctcccaagccttcctgcatggggctgccctcacactccctgcctcccaggcggaaacagcccttatcaggaggcgggttttgttcacccatccctgggcctgggataagttctgcctttagcagcctgcgctctcctctgctcagtctgcccatatccagctccgagaattag

SEQ ID NO: 24850 - DNA, 522 bp, Artificial Sequence
  Description of Artificial Sequence: Synthetic coding sequence
atggaggctccaggtcctcgggccttgcgaactgctctgtgcggggggtgttgctgcctcctgctctgcgctcaacttgccgtggccggcaaaggcgcccgtggatttgggcgtggcgccttaataaggctgaatatctggcctgccgttcagggagcatgcaagcagctggaggtgtgtgaacattgcgtcgaaggcgaccgggcacgtaacctttcgagctgcatgtgggaacagtgccgcccagaggagcctggccactgcgtcgcgcaaagtgaagtcgtgaaagagggctgtagtatctacaataggtccgaggcctgccctgctgctcatcaccatcctacatacgagcctaagactgtgactaccgggagcccacccgtgcctgaggcacattcccccggtttcgacggagcctccttcatcgggggcgtagttctagtgctttcactccaggctgtggccttctttgtgctgcatttccttaaggccaaggactctacgtatcaaacgctgtag

SEQ ID NO: 24851 - DNA, 525 bp, Artificial Sequence
  Description of Artificial Sequence: Synthetic coding sequence
atggaggccccaggaccccgcgcccttcggaccgctctctgtggcggctgctgctgtttgctgctgtgtgcccaattggcagtggctggcaaaggggccaggggattcggcagaggggcattgattcggctgaatatctggccagccgttcagggggcttgcaaacagctggaagtgtgcgagcactgcgtggaaggcgatagggcccggaatctgagcagttgcatgtgggagcagtgccgcccagaggagcccggacattgcgtggctcagtcagaggtggtcaaggaagggtgtagtatatacaacaggagcgaagcctgtcctgccgcccatcaccatccaacctacgaacccaaaactgtgacaaccggtagtcctcccgtaccagaagcccattcgccggggttcgatggagccagcttcatcggcggagtcgtgttggtactgagcctgcaggcggttgccttctttgtgctccacttcctcaaagcaaaagacagcacttatcagacacttatatag

SEQ ID NO: 24852 - DNA, 1986 bp, Artificial Sequence
  Description of Artificial Sequence: Synthetic coding sequence
atggcattcgatgtgtcttgcttcttctgggtagtactgttctcggcaggatgcaaggtgatcacctcctgggaccagatgtgcattgaaaaggaggctaataaaacatataattgcgaaaacctaggcctctccgagatccctgacaccctgcccaacacgacggaatttctggagttctcctttaatttccttccaacaattcacaatcggaccttctccagactgatgaatttgacctttctggacctgacccgttgccagattaactggattcatgaagatacattccagtcccatcatcagctgagcaccctggtcctgactgggaatcctctgatttttatggccgaaacaagcctgaatggccccaagagtctgaagcacttatttcttatccagaccggcatatcaaatctggaattcattcctgtgcacaatctggagaatctggaatctctgtatctggggagcaatcacatcagctctatcaaattcccaaaggacttccctgcccggaaccttaaagtcctcgattttcagaacaatgcaatacattatatctcccgagaggatatgcgcagcctagaacaggccatcaaccttagtctgaattttaacggcaataatgtgaaaggaattgaactgggcgcattcgactcaactatatttcagtctctgaacttcggcggtacaccaaatctttctgttattttcaacggcctgcaaaacagcacaacccagtctctgtggttgggaacctttgaggacatagacgatgaagacatcagcagcgccatgctgaagggtctgtgcgagatgtctgtagaaagcctgaacttgcaggagcaccgtttctctgacatttcctcaacgacttttcagtgtttcactcaactccaagaactggacctcacagcgacccacctgaagggactgccctcaggcatgaaggggttgaacttgctgaagaaactcgttttaagtgtcaaccacttcgatcaactctgccagatcagtgccgctaactttccaagccttactcatctttacatacgcggaaatgtcaagaagctgcatctgggtgtgggctgcttggaaaaactggggaatctgcagactttggacctgagccataacgatattgaagcaagcgactgttgtagcttgcagctcaaaaatttgagtcacctgcagactttgaacctgtctcacaatgaaccacttggcttgcagtcacaggcttttaaggaatgccctcagttagagctcttagacctggcctttactagactgcacatcaacgccccccagtccccgtttcaaaatcttcacttcctgcaggttttaaacctaacttactgttttttagacacatcaaaccaacacctgctggcaggactgccagtactccgtcatctgaacctaaaaggtaatcattttcaagatggcactattacgaagacaaacctgctccagacggtggggtctctggaagttctgattctgtcatcctgtggtctgctgtcaattgatcaacaggcttttcattcactcggcaagatgtcacacgtggatctgtctcacaatagcttaacatgcgattctatcgactctctgtctcacctgaaaggcatttacttaaacctggctgcgaactcaatcaatattatctcaccgagacttttgcccattctaagccagcagagtactattaacctgtcccacaatcctctcgactgtacctgctcaaacattcacttccttacttggtacaaggaaaacctccacaaactggaggggagtgaagagaccacctgcgcaaacccgccctcgttaagaggggtgaaactctcagacgtaaagctctcgtgtgggattactgcgatcgggatatttttcttgatcgtattcctgctcctgctcgccatcctactgtttttcgcagttaaatatcttctcagatggaagtatcagcacatctag

SEQ ID NO: 24853 - DNA, 816 bp, Artificial Sequence
  Description of Artificial Sequence: Synthetic coding sequence
atgtccgccccacggctgctgatttccattatcatcatggtctccgcgtcatcttcttcttgcatgggcggcaaacagatgacacagaattatagtactatcttcgcggagggtaacatatcccagccggtcttaatggacattaatgccgtattatgctgtccccctatcgccttgagaaacttgatcattattacctgggagataattctcagagggcagccttcttgcaccaaggcctacaaaaaggaaaccaacgaaaccaaggagaccaactgtacagtggagagaatcacatgggtcagccgaccagatcaaaacagcgatttacagatacgtcccgtcgacacaactcacgatggctactatcgaggcattgtggtgacccccgacggaaactttcatcgcggctatcatctgcaggtactcgtgactccagaagttaatctattccagagccggaatattaccgccgtgtgtaaggcggtaactggtaagccagcggcacagatctcctggatccccgagggtagcatattggcaaccaagcaggagtattggggaaacggcacggtcactgttaaatccacctgtccatgggaaggtcacaagagcacggtcacctgtcacgtatcgcatctgactggcaataagtccctcagcgtgaaactgaactccggactgcgcacctctggcagtcctgcgctcagtctgctgatcatactgtacgtaaagctaagtctgttcgtcgtaatcctggttactaccggatttgtcttcttccagaggattaatcacgtgaggaaggtgctctag

SEQ ID NO: 24854 - DNA, 753 bp, Artificial Sequence
  Description of Artificial Sequence: Synthetic coding sequence
atgggtgggaaacagatgactcagaattactcaactatctttgcagaaggaaacatctctcagccagtgttaatggacatcaatgccgtcctgtgctgcccccccattgcactgcgtaatctgattattatcacctgggaaattatccttaggggtcaaccttcctgtaccaaagcttacaaaaaagagactaacgagactaaagagaccaattgcactgttgagcggattacctgggtgtccaggcccgatcagaatagcgatttgcaaatccgccccgttgacacgacccatgacgggtactaccgcggaatcgtggtgaccccagacggaaacttccatcggggttatcacctgcaagtgcttgtcacacccgaagtcaatctgtttcaatccaggaacattacggccgtttgtaaagccgttacagggaaacctgccgcccagatttcttggatcccagaaggttccattctggctaccaaacaggagtattgggggaacggtacggtgaccgtcaagagtacatgcccctgggagggccacaaatcaacagtgacctgccacgtgagtcatctcacaggaaacaaaagcttatcggttaaattgaattctggcctccggaccagtggctcacctgctctgtccctgcttatcatcctttacgtgaagctgtctttattcgttgtgattttggtaaccacaggattcgttttctttcaacgtatcaaccacgtccggaaagtgctgtag

SEQ ID NO: 24855 - DNA, 753 bp, Artificial Sequence
  Description of Artificial Sequence: Synthetic coding sequence
atggggggtaaacagatgacacaaaattatagtacgatcttcgcagaaggaaacatttcacaacccgtgctcatggacattaatgctgtgctctgttgccctcctatagctctgaggaacctaatcattataacctgggagatcatcctgcgcgggcagccctcctgcactaaagcatataagaaggagactaacgaaaccaaagaaaccaattgcactgtagaacgcatcacttgggtgtcccgacctgaccagaactccgatttgcagattcgaccagtcgatacaacccacgacggttattatcgaggtatcgtggtcacacctgatggaaatttccaccggggatatcatttgcaagttctggttactcctgaggttaatctcttccaatctaggaatattacagccgtgtgcaaagctgtcacgggcaaaccagcagcccagatctcttggattcccgaaggatccatacttgctaccaagcaggagtattggggtaatggcaccgtgacggtgaaaagcacctgcccctgggagggacacaagtccacggtcacttgtcatgtgtctcacttgaccggtaacaagagcctatcagtgaagctaaacagcggattgaggacctctggaagcccagccctgagcctgctgattattctctacgtcaaattgagcttgttcgtagtcatcctggtcacaacaggctttgttttctttcagcgaattaatcacgttcgaaaggtcctgtag

SEQ ID NO: 24856 - DNA, 531 bp, Artificial Sequence
  Description of Artificial Sequence: Synthetic coding sequence
atgcggatctttgcagtgtttattttcatgacttattggcaccttttgaacgctccttacaataagattaatcagcggatactcgtcgtggatcccgtaacaagtgaacacgagctgacatgtcaggctgaagggtaccctaaggctgaggttatctggacatccagcgaccaccaggtgctatcaggaaaaacaactaccacaaatagcaagcgcgaggagaagcttttcaatgtgacatctacactgcgaattaatacgacaacgaatgagattttttactgtacattcagaagacttgatccggaggagaatcacacagccgagctcgttattccggagctgccactggcacatccgcccaacgagcgcacacacctagttattctcggcgctatacttctttgtcttggtgtagcattaacctttatcttccgcctacgcaaaggccgcatgatggatgtcaagaagtgcgggatccaagatacgaattcgaaaaaacagtccgacacccacctcgaagaaacttag

SEQ ID NO: 24857 - DNA, 873 bp, Artificial Sequence
  Description of Artificial Sequence: Synthetic coding sequence
atgaggatctttgcggtgttcatattcatgacctactggcacctgctgaatgcattcacagtcaccgtacccaaagacctatacgtggttgagtatggctccaacatgaccattgaatgtaagtttcctgttgagaaacagctcgatctggccgccctgattgtttattgggagatggaggacaaaaatatcattcaattcgtgcacggcgaggaggatttaaaagttcaacactccagttatcgtcaaagggcccgtctcctcaaggatcaattatccctgggaaacgcggccctccagattacggatgtcaaactacaagacgccggggtttacagatgcatgatatcatatggtggggccgactacaaacggatcactgtgaaggtcaatgctccatacaacaaaatcaatcaacgtatcctggtggtggacccagtcacatctgagcatgaactgacttgccaggctgagggatatcctaaagccgaggtaatttggaccagttcagaccaccaagtcctgtctggcaagacaacgaccacaaattctaaacgtgaagagaagcttttcaatgtcacaagtacattgcgtatcaatactactaccaatgagatcttctattgtacctttcgccgactggatccagaggaaaatcacaccgcagagttagtgatccccgaactgccacttgcacatccacctaacgagagaacccacctcgtcattctaggtgctattctcctgtgcctcggggtcgcattgacattcatcttcagattgaggaaagggaggatgatggacgtcaagaaatgtgggatccaggacacaaactcgaaaaaacaatccgacactcaccttgaagaaacttag

SEQ ID NO: 24858 - DNA, 585 bp, Artificial Sequence
  Description of Artificial Sequence: Synthetic coding sequence
atgtggctgtcaccttccctcctgctcctgatactgcccggatatagcatcgctgctaagattaccgggccaactacagtgaatggcagtgagcaggggtccttgacagtgcagtgcgcctatggcagcgggtgggagacctacttgaagtggcggtgccaaggcgccgactggaactactgcaacatcttggtgaagaccaacggtagcgaacaggaggtaaagaagaacagggtatctattcgcgataaccagaagaatcatgtattcactgtgacaatggaaaatctgaagcgggatgacgcagattcctactggtgcggaactgaaaggcctggcatcgacctaggggttaaagtacaggtgacaattaatccgggaacccaaactgcagtatcggaatggacaaccaccacagccagccttgccttcacagcggcagctacacaaaaaacctcttcacctctgacaagaagcccccttaaatccacacattttctgtttttgttcctgttggaactgcctctgctcctgtcgatgttaggcacagtgctctgggtgaaccggccgcagagacgaagctag

SEQ ID NO: 24859 - DNA, 702 bp, Artificial Sequence
  Description of Artificial Sequence: Synthetic coding sequence
atgagactccttgtactgctgtggggttgtctcctgctccccggatatgaggctttggaggggccagaggagatctccggctttgagggggatacagtgagcctgcagtgcacgtatcgcgaggagctgagagaccaccgtaagtactggtgccgcaagggagggattctcttttccagatgttcaggtacaatctacgcggaggaagaagggcaggagacaatgaaggggcgggtgtctatccgcgactcacgacaggaattgtccctcatcgtgacgctgtggaacctaacacttcaggatgccggagaatactggtgtggggtcgaaaagcgtggtccagatgaatctctgctcatctccctctttgttttcccaggttcttcccgaccccctatgcagttagatagcacgtctgccgaagatacatcccccgccctttcaagcggatcaagcaaaccacgggtctccattcccatggtcagaatactcgcccctgtccttgtactgctttccctgttaagcgctgctggcttgatcgctttctgttcccacctattgctctggcgtaaggaagctcagcaggccaccgaaacccagcgcaacgagaagttctgtctttccagacttaaccatagaacctccgaactcgaccctgacgaagcttttgagattagttcgctgacttttttatctgtgtag

SEQ ID NO: 24860 - DNA, 999 bp, Artificial Sequence
  Description of Artificial Sequence: Synthetic coding sequence
atgcgattgctggtactcctttggggctgcctgttgctcccgggctatgaggcccttgaagggccagaggagattagcgggttcgagggcgacactgtttccttgcagtgtacatacagggaagagttgagagaccataggaaatattggtgtaggaagggagggatactgttctcccggtgctccggcactatctatgctgaagaggaggggcaggagactatgaagggcagggtctctatcagagattcaaggcaggagctgtccctgatcgtgactctctggaatctgacactccaggacgctggcgagtactggtgtggggtggaaaagcgaggacctgacgaaagtcttctaatttcccttttcgtgttcccaggaccatgctgcccgccctctccgagtccgactttccagccactggccaccacgcgattgcagccaaaggcgaaagcccagcagacacaacccccgggcctgacttcccccggcctctaccccgcagctacgacagccaagcagggcaagacaggcgcagaggcacccccgctaccagggacctcccagtatggtcacgaaagaacctcccagtatacgggcacatcaccccaccctgcaacctcaccgccggctggctctagccggccgccaatgcagttggatagtacctcagcagaagacacttcgcccgcactgtcttcaggaagttccaagccaagggtcagcatcccaatggtccgaatcctagcccccgtgctggttttgctttcattactctctgctgcaggtttgatagctttctgctcccatcttctcctttggcggaaggaagctcagcaagccaccgagacgcaacgcaacgagaagttttgtctcagccggctgacagccgaggaaaaagaagctccatctcaagctcccgagggagatgtcatctccatgccgcccctacacacatccgaggaagaactgggcttctccaaatttgtgagtgcttag

SEQ ID NO: 24861 - DNA, 822 bp, Artificial Sequence
  Description of Artificial Sequence: Synthetic coding sequence
atgcggttgctggtcctcctgtgggggtgcctgctgcttcccggatatgaggccctggaggggcctgaagagatctctggattcgaaggcgacacagttagccttcagtgcacatacagggaggagttgcgggaccacagaaaatactggtgcaggaaaggtggaatactctttagccgatgtagtgggacgatctacgcggaggaagagggacaggagaccatgaagggaagggtttcaatccgggattccaggcaggagctgagcctgatagtgactttgtggaacctgactctgcaggacgcaggagaatactggtgcggtgttgagaagagaggccccgacgaaagcctgctgatctccctgtttgtatttcctgcatcacccggcttatatccagctgcaactaccgcgaagcagggcaaaacaggcgctgaagcgccgccgttgcctgggacatcccagtatgggcacgagcggacgtctcaatacactgggacgagtccgcatccagcaacatctccaccagctgggagtagccgaccccctatgcaacttgactctacatcagctgaggataccagccctgccctgtcttccggcagctcaaaaccgagagtgagtatccccatggtgcgtatccttgcccctgtgctggtgctactgagtcttttgagcgccgccggacttatcgccttttgctcccacttactgctctggcgtaaggaggctcagcaagccaccgagacgcagaggaatgagaagttctgtcttagtagactcaattcactgatgtttagcctctctttgccgtggctatag

SEQ ID NO: 24862 - DNA, 924 bp, Artificial Sequence
  Description of Artificial Sequence: Synthetic coding sequence
atgagattgctggtgctgctctggggctgtctcctgctgccaggatacgaggctttagaagggcccgaggaaatttcaggatttgagggggacacggtgagcctgcagtgcacataccgtgaggagttgcgtgatcatagaaagtattggtgcagaaagggcggcatcctcttctccagatgttcgggcacaatctatgcagaagaggagggccaagagacaatgaaaggacgagtgagcattagggatagtaggcaggaactgagcctgatagtgactctgtggaatctgactctgcaggacgccggtgaatattggtgtggggtggagaagcgtgggcctgatgagtctctcttaatctccctgttcgtattcccaggaccatgttgcccaccctcaccttctcccactttccagccactcgcaactacgaggctacagcctaaggccaaggcccaacagacacagccaccaggtctaacatctcccggtctttacccagcggcaacaaccgccaagcaaggaaagacaggggccgaagcacctccattgcctgggaccagccagtatggacatgagaggacatctcagtataccggaacatcgccccatccagctacttctccgcccgcaggcagctcaaggccccctatgcagctggattccacctccgccgaggacaccagtccagccctatcttccgggagttcaaagccaagagtcagcattcctatggtccgcatactagcaccagtactggtattgctatctcttctatcagctgctgggctcatcgcgttttgttcacatctcctcttgtggcgcaaggaagctcagcaagcaaccgaaactcagcggaatgagaaattctgccttagccgcctgaattctctcatgttctccttgtccctcccatggttgtag

SEQ ID NO: 24863 - DNA, 561 bp, Artificial Sequence
  Description of Artificial Sequence: Synthetic coding sequence
atgtggctgccatgggcactcctgttgctgtgggtgccggctagtaccagcatgacgcccgcttcgattactgccgccaagactagcactatcaccacagccttcccaccagtgtcctccactacactgttcgcagtcggggccacgcatagtgcgagtatccaggaagaaacggaagaagtggtgaattcacaattgcccctgctactgagtttgctcgcactactgctattactgctggtgggtgccagcctattggcttggaggatgtttcagaagtggataaaggccggtgaccactccgagctgagccaaaaccccaagcaggcggctacacaaagcgagttgcactacgccaatctggaactactgatgtggccgctgcaagaaaaacccgctccccccagagaggtcgaagtagaatattctactgtggcctctccacgcgaggaactccactacgcaagcgtagttttcgacagtaacaccaatcgcattgcagcgcagcggccaagagaagaagaacccgactccgattacagcgtgatccgcaaaacttag

SEQ ID NO: 24864 - DNA, 900 bp, Artificial Sequence
  Description of Artificial Sequence: Synthetic coding sequence
atgtggcttccatgggctctattgctgttatgggtaccgggctgctttgcgctgagtaagtgtcgcactgtggctggacctgttggcggctcgctctctgtccagtgcccctatgagaaggaacatcggaccctgaacaagtactggtgtcggcctcctcagattttcttgtgtgataagatcgtcgaaacgaaagggagtgcgggaaaacgcaacggtagagtatcgattcgggattcccccgcaaacctcagcttcactgtcaccctcgagaatttaaccgaggaagatgccggaacctattggtgtggagttgacacaccgtggttgagagacttccatgatccggtagtggaggttgaagtgtctgtgtttcctgcatctacatccatgacgccggcttctattacagccgctaaaacatccaccatcacaactgcttttccccctgtgagctcaacaacactatttgctgtgggcgctacccacagtgcatccatccaagaggaaaccgaagaagtagtcaactcccagttaccgctgctcttgtccctgctagctctgctgttgctgttgctggttggggctagcctgctggcatggagaatgtttcaaaagtggatcaaggccggtgaccactctgagctctcacagaatccgaagcaggcagcaacccaaagtgaacttcactacgccaatttagaactgctaatgtggccccttcaggaaaagcccgccccgcctcgcgaagtagaggttgagtatagtactgtggcatcgccgcgtgaggagctgcactacgcttctgtagttttcgattccaacaccaacaggatcgccgctcaacggccccgcgaagaggaacccgacagtgactattccgtaattcgcaagacttag

SEQ ID NO: 24865 - DNA, 312 bp, Artificial Sequence
  Description of Artificial Sequence: Synthetic coding sequence
atgtggttgccatgggcactgttattactgtgggtgcccgccggcgaccactccgagttatcccagaaccccaaacaggcggccacacaatcagaacttcattacgcgaatcttgagctactgatgtggcccctgcaggagaaacctgctccgccgcgggaagtagaagtggagtattccaccgttgcttctccccgcgaggagctgcattacgcaagcgtggtgtttgattccaacacgaatcgcatagctgctcagcgcccaagagaggaggagccagactctgactattcagtgatcagaaaaacctag

SEQ ID NO: 24866 - DNA, 453 bp, Artificial Sequence
  Description of Artificial Sequence: Synthetic coding sequence
atgtggctcccatgggcactcctcctcctctgggttccagcttccacatccatgacccctgctagcatcaccgctgccaaaacttctaccattacaactgctttcccaccggtatcatcaactaccctttttgcagtgggggccactcattcagcaagtattcaggaggagaccgaagaagtagtgaactcacaactgcctctccttttgagcctgttggcgttgctgttgctgctcctggttggagcatctctgcttgcctggcgcatgttccagaaatggataaaggctggggaccatagcgagctgagccaaaaccccaaacaagcctcacctcgagaagaactgcactacgcatcagtggtcttcgattctaacaccaataggattgcagcccaaaggccacgagaggaagaacccgattccgactattccgtgattcgaaagacctag

SEQ ID NO: 24867 - DNA, 675 bp, Artificial Sequence
  Description of Artificial Sequence: Synthetic coding sequence
atgaccgcacgcgcgtgggcttcctggagatcttctgcccttctgctcttactggtaccaggatacttccccctttcgcaccccatgaccgttgccggacccgtgggcggaagtttatctgtgcagtgtcgttacgaaaaggagcaccgcacgttgaacaagttctggtgccgtccgccccagattctgcggtgtgataaaattgtggagaccaaagggagcgccgggaaacggaatggccgagtcagcatccgagactctcccgcgaacctcagctttacagtaacgttggagaatcttacagaggaggatgccggaacatactggtgtggggtagacaccccctggctccgagactttcacgatcctattgtggaagttgaggtgtctgtatttccagccgggactaccacagcctcgtcccctcagtcatccatgggtacttcggggccaccaacgaaactgcccgtgcatacttggccatcggttacaaggaaagactcaccagagcccagcccccatcccggttcgctgttctctaatgtgagattcttgctcctggttctgctggagctaccgctgctgctgtcgatgctaggggctgtgctctgggtgaacagaccgcagagatcctcccgaagcaggcagaactggccgaaaggagagaaccagtag

SEQ ID NO: 24868 - DNA, 618 bp, Artificial Sequence
  Description of Artificial Sequence: Synthetic coding sequence
atgtggctgctgcctgccctcctgctgttatgcctctccgggtgtctgtcgctgaaggggcccgggtccgtgacggggactgcaggcgattcattgactgtctggtgtcagtacgaatccatgtacaagggctacaacaaatattggtgtaggggacagtacgatacatcatgtgagagtattgtcgaaactaagggcgaagaaaaagtcgagcgaaacggacgagtttcaatcagggatcatccagaggccctcgcctttacagttacgatgcagaatctgaacgaagatgatgcaggcagttattggtgtaagattcagacagtgtgggtgctggacagctggagccgcgacccttcagacttggtgagagtctatgtttctcccgccattaccaccccacgcaggaccacacatcctgcgaccccaccaatattcttggttgtgaacccaggcagaaacctctctaccggggaagtattgacacagaatagcggattccgcctgtcttcccctcactttctcctggtagtgctgttaaaattacctctattgctctccatgctgggcgccgtgttttgggtcaatagacctcagtgggctccacccggcaggtag

SEQ ID NO: 24869 - DNA, 699 bp, Artificial Sequence
  Description of Artificial Sequence: Synthetic coding sequence
atgacacaagccccactgcacatcttaggctttcagctgggaccaaggttcgcggaagatggaagccagggggacagaaacatgtggctcctgccagctctgttattactctgcctgagcggatgtttgtcccttaaagggcctgggagcgtgacaggaacggcaggcgatagcctcacagtgtggtgtcaatatgaatcaatgtataaaggctacaataagtattggtgtagggggcaatatgacacttcctgcgagagcattgtagaaaccaagggcgaagagaaggtcgaaaggaacgggagagtcagtattagggatcaccctgaagcactggcattcactgttacaatgcagaatctgaatgaagatgatgccggttcctactggtgtaagatccagactgtctgggttttggattcctggtccagggacccaagcgacttggttagagtttacgtgtcacctgcaatcactacccctcgccgtactacgcatccagccacaccccccatttttctcgtggtcaacccaggaaggaacctgtcgacaggggaggtgttgacccagaatagcggcttccgactgtcttctccccatttcttactggtggttttactgaagctgcctctccttctgagcatgttaggagcagtattctgggtcaacagaccccagtgggctcctccaggccgctag

SEQ ID NO: 24870 - DNA, 369 bp, Artificial Sequence
  Description of Artificial Sequence: Synthetic coding sequence
atgtgtcatctgcaggaagaagctggaggacggtggaagggggggggatgtctgagcttaaaaggccccggaagcgtaacggggaccgcaggcgattctctgactgtttggtgtcagtacgaatcaatgtataaggggtacaataagtactggtgtaggggacaatacgatacatcatgtgagagtatcgtggagaccaaaggggaagaaaaggtcgaacggaacggccgcgtgagcatccgggatcaccccgaggccctggcttttaccgtgaccatgcagaatttgaacgaggacgatgctggtagctattggtgcaagatacaaacagtttgggtactggacagctggtcacgcgatccatcctag

SEQ ID NO: 24871 - DNA, 741 bp, Artificial Sequence
  Description of Artificial Sequence: Synthetic coding sequence
atgagcgagaatacaaaagaaacctggacctctcgtaaatggatgacccaggcccccttacacatcctggggtttcagctcgggcccagattcgcagaagacggatctcagggcgatcgtaatatgtggctacttcccgcactgctcctcctgtgtttatctggctgcctcagcctcaaggggcctggatcagtgacaggcaccgccggggatagcctaaccgtttggtgccaatacgaatcgatgtacaaagggtacaacaaatactggtgccggggacaatacgatacatcctgtgaaagcattgtggaaaccaagggtgaggagaaagtggagaggaatggccgcgtgtccatacgtgaccatcctgaggcattggcctttacagtcactatgcagaacctcaatgaggatgacgcaggaagttactggtgtaagattcagacggtgtgggtcctcgattcttggagtagagatcccagcgacttggtccgcgtgtatgtttcccctgcaatcacgacgcctcgtaggaccacccaccctgctactcctcccatcttcctggtggtgaatcctggccggaacctgagcacaggggaggtgctgacccagaacagtggcttccgattgtcaagccctcatttcttgttggtggtgctgttaaaactgccactgctactgtccatgttaggggcagtgttctgggtgaacaggcctcagtgggctccgcctggacggtag

SEQ ID NO: 24872 - DNA, 300 bp, Artificial Sequence
  Description of Artificial Sequence: Synthetic coding sequence
atgggatgtgaccggaactgtgggcttatcgccggggccgtaataggcgcggtgctggcagttttcggaggaattctgatgcctgttggggatttgctgatccaaaagactattaaaaagcaagtcgtgctagaggagggaaccatcgctttcaagaattgggtgaaaacggggacggaggtataccggcagttttggatattcgacgttcaaaatccccaggaagtcatgatgaatagcagttgcattccctacttgtccaaatccatctgttccaacgatcctcagtttacctattag

SEQ ID NO: 24873 - DNA, 186 bp, Artificial Sequence
  Description of Artificial Sequence: Synthetic coding sequence
atgaaaagatttctcttcctactcttgactatttcacttctggtgatggtccagatccagacaggccttagcgggcagaacgatacaagccaaacctcctcgccatccgcttccagtaatatttcggggggaattttcctctttttcgtagccaatgccattatccacctcttttgcttttcatag

SEQ ID NO: 24874 - DNA, 1038 bp, Artificial Sequence
  Description of Artificial Sequence: Synthetic coding sequence
atggcacagcaccacctgtggatactgctcctctgcctacagacatggcctgaagccgccggcaaggactcagaaatctttacagtgaacggcatactgggagaatccgtcacatttccggttaatatccaggagccccgtcaggttaagatcattgcctggacgtcgaagactagcgtggcttacgtcacacccggagattctgagactgccccagtagtgaccgtcacccatcgaaactactacgaaagaatccacgccctggggccgaactataacctggttatctccgatctccggatggaagatgcaggagactacaaagccgacatcaatacccaggccgatccctacacgactaccaaaagatataatcttcaaatctatcggcgcttagggaaacctaagatcactcagagcttgatggctagtgtgaacagtacttgcaacgtaaccctcacgtgctcggtggaaaaggaagagaagaacgtcacgtacaattggagccccctgggtgaggagggaaatgtgctgcaaattttccaaacaccggaggaccaggagcttacatatacctgcaccgcccagaatcccgtgagtaacaatagcgactccatttcggctaggcagctctgtgcggatattgccatggggtttcggacacaccacactggattgcttagtgtgctcgctatgtttttccttctcgtactgatcctgtcttcagtttttctctttcggctgttcaaaagaaggcagggcagaattttccccgaggggtcctgcctgaatacgttcactaagaacccatatgccgctagtaaaaagaccatctatacctatatcatggcatccagaaacacccagcccgccgagagccgcatctatgatgagattctgcaaagcaaggtgttgccctcgaaagaagagcctgttaacacagtgtatagcgaggtccaattcgccgataaaatgggaaaggcgtctacccaggacagcaaacctcccggcacatctagttacgagatcgtaatttag

SEQ ID NO: 24875 - DNA, 843 bp, Artificial Sequence
  Description of Artificial Sequence: Synthetic coding sequence
atggcccagcaccacctatggatcctgctgctgtgtctccagacatggccagaggccgctggaaaagactccgagatctttacagtgaatggtatcttgggagaatctgtgacttttcccgtaaacatccaggaacctcgccaggttaaaataatcgcgtggacgagcaagacctctgtcgcttatgtgacaccgggggatagcgaaacagcacccgttgtaaccgtgacccacagaaactattatgagcgcatacatgcccttggccccaattacaacctggtaattagtgatctccggatggaggacgccggcgattataaggccgatattaacacccaggcggacccttacactacaaccaaaaggtacaatctgcagatttacagaagactcggaaagccaaagatcacgcagagcctgatggcgagtgtaaattccacttgcaacgtcacccttacttgctcagtggagaaagaggaaaagaatgtgacttacaactggagcccccttggtgaggagggaaacgtgttgcaaatctttcaaacacctgaagaccaggaacttacctacacttgcaccgctcagaatcccgtgagtaacaattccgactctatttctgcaaggcagctgtgtgctgacattgccatgggctttcgaacccatcacacaggactgctcagtgtgctggctatgttcttcttgctcgttctcatcctgagttctgtgttcctcttccggctgttcaagagacggcaggggagaatattccccgaagggaagatgtggaaactgacgttcagtcctcctggaactgaggccatctaccccagattttcatag

SEQ ID NO: 24876 - DNA, 726 bp, Artificial Sequence
  Description of Artificial Sequence: Synthetic coding sequence
atggcgcagcatcatctgtggattctgctcctctgcctgcagacatggccagaggcagccggcaaggatagcgaaatttttaccgtcaatggcatccttggggagagtgttacatttcccgtgaatattcaagaaccacgtcaggtgaagatcattgcatggacctctaagacttcagttgcctatgtgactcctggggactccgaaacagctcctgtggtgaccgtgactcacagaaattattacgagcgtatacatgccctcggtcccaattacaacctggtgatttcagacctgagaatggaagatgcaggcgattataaagcggacatcaatacgcaggccgacccctataccacaactaaaagatacaatttacagatttatcggagactgggaaaaccaaagatcacacaaagtctcatggccagtgtgaactcaacttgcaacgtcaccctgacctgcagtgtggaaaaagaagagaagaatgttacgtataattggagtcccctcggggaggaggggaacgtccttcagatttttcagaccccagaagaccaggagctcacatacacgtgcacggcccagaacccagttagcaataattccgactcaatatccgcacgccaactgtgtgcagggaatcagctatgtccctcacttcttgttagcttgagagatcactccgaggaactgcagggcctgaatgttgggcacatcctttag

SEQ ID NO: 24877 - DNA, 1020 bp, Artificial Sequence
  Description of Artificial Sequence: Synthetic coding sequence
atggcgcagcaccacctttggatcctgctcttgtgcctccagacctggcccgaggccgcagggaaggactctgaaattttcacagtaaatggcattctcggtgagtccgtgaccttccccgttaatattcaagagccacgtcaggtgaaaattatcgcatggaccagcaaaacatccgtggcttacgtcaccccaggcgactccgagaccgcacccgtggtgacggtgactcataggaactattacgagcgaatccatgccttaggcccaaactacaatttggtgatttccgatctacggatggaggacgctggagactataaagcagacatcaatacccaagctgatccatacacaaccaccaagcgatacaacctgcagatctatcgccgcctgggcaagccaaagattacccagagcctcatggccagcgttaattctacttgtaatgtgacattgacctgttcagttgagaaggaggagaagaatgtgacctacaattggagtccactcggtgaagagggcaatgtgctgcagatttttcagacgcccgaggatcaggaactgacttacacctgcaccgcccagaatcccgtgtccaataacagcgacagtatttcggcgcgacagctgtgcgccgacatcgccatgggctttaggacacaccatacaggcctgcttagtgtgttggctatgttttttctgctggtcctgattctgtccagcgtgttcctgtttagacttttcaagaggcggcaggggagctgcctgaatacgtttacgaagaacccctacgctgcaagcaagaaaacaatctatacatacataatggccagtaggaacacccagccagccgagagccgcatctatgatgaaatattgcagagtaaggtattgccgagcaaagaagaacccgtgaataccgtgtattctgaagtacagttcgcggacaagatggggaaggccagtacacaggacagcaaacccccaggaacgagctcatacgaaatcgtgatctag

SEQ ID NO: 24878 - DNA, 819 bp, Artificial Sequence
  Description of Artificial Sequence: Synthetic coding sequence
atggcacagcatcatctgtggatacttctcctgtgcctgcagacctggcccgaagccgcaggcaaagatagtgaaattttcaccgtgaacggcatcttgggggagagcgtcacttttcccgtgaacatacaggaaccacggcaggtgaaaataattgcttggacatcaaagacgtctgtagcctacgtcactcccggcgatagcgagactgcccctgtggttacagtgacacaccggaactattatgaacgaatccacgccctggggccgaactataatctggtgatctctgacctgcgcatggaggacgcaggcgactataaggccgatataaacacacaggccgatccctataccaccactaagaggtataatctccagatatatcgcaggctgggcaagccaaagatcactcagtcactgatggcaagtgtaaatagcacttgtaacgtcaccctgacgtgctcggttgagaaggaggaaaaaaatgtgacatataactggagcccactcggagaggaaggcaatgtgctacaaatctttcagacccccgaggaccaggagctgacctacacatgcactgcccagaatccggtgtctaacaactctgattcaatctccgcgagacagctctgtgccgacattgccatgggcttccgaacccatcacacaggccttttatccgtactggcaatgttttttcttttagttctcattttgagttctgtcttcctgttcagactgtttaaacgccgtcagggggccagcctgcaggggcgggcctccgaacactctttgtttagatctgctgtctgctag

SEQ ID NO: 24879 - DNA, 987 bp, Artificial Sequence
  Description of Artificial Sequence: Synthetic coding sequence
atggcacagcaccacttatggattctgcttctttgccttcaaacctggccagaagcagctgggaaggactcagagatttttactgtgaatgggatcttaggggaaagcgttacctttcctgttaacatacaagagccacggcaggtgaagatcatcgcttggacttctaagacctcagttgcatacgtgactcccggtgacagcgagaccgcccctgtcgtgactgtaacgcaccgcaattattacgagagaatacacgccctcggtcccaattacaacctggttatttccgacttgcgaatggaagatgccggtgattacaaggctgacatcaatacccaggccgacccatataccaccaccaagaggtataacctacagatttaccgacggctcgggaaaccaaaaatcacgcagtctttaatggcgagcgtcaattccacttgtaacgtgaccctaacttgctccgtggaaaaggaggagaagaatgtgacctacaactggtcccccttgggagaggagggcaatgtcctgcagatatttcagacacccgaagatcaggaactgacctacacatgcaccgcccagaatcccgtgagtaacaattccgatagtattagcgccaggcagctctgcgccgacatagctatgggatttcgcacccaccacaccgggctcctgtccgtgctagccatgttctttctgctcgtgttgatcctatcaagcgtgtttctttttagattgttcaaacgacgacaagacgcggccagcaaaaaaaccatctacacttacataatggcaagtcgaaatacccagcccgccgaatcacgaatctacgacgaaattctccagtctaaagtcctgccaagcaaagaagagcccgtcaatactgtgtattctgaagtgcaatttgctgataagatgggcaaagctagcacgcaggactctaagcctcctggcacaagctcttacgagatcgtgatttag

SEQ ID NO: 24880 - DNA, 645 bp, Artificial Sequence
  Description of Artificial Sequence: Synthetic coding sequence
atggctcaacatcacctgtggatccttctgctatgcctacaaacctgtagactgggcaagccaaagatcactcagagcctgatggcaagcgtgaactccacttgcaatgtgaccctcacgtgttccgttgaaaaagaggagaaaaacgtgacatacaactggtcgccgctcggagaggagggtaacgttctgcagatcttccaaaccccggaggaccaggagctgacatacacgtgtacagcgcagaaccccgtaagcaacaacagcgacagcatcagcgccagacagctttgtgcagacatcgctatgggcttccgcacacaccataccggcctgctttctgtactagccatgttctttcttctggtactcatcttatcaagcgtatttttatttcgtctctttaagaggcggcaggatgcggcatccaaaaagactatctatacatacattatggctagtagaaatacccagccagctgagtcccgtatttatgacgagatcctgcagtcaaaggtcttaccttcgaaggaggagccagtgaatactgtctactctgaggttcagtttgccgataaaatgggcaaggcctctacacaggattccaaacccccaggtacatctagctacgagatcgtcatttag

SEQ ID NO: 24881 - DNA, 1959 bp, Artificial Sequence
  Description of Artificial Sequence: Synthetic coding sequence
atggccacttccatgggactgctactcctactgctattgctgcttacgcaaccgggggcagggacgggcgcggataccgaggctgtggtgtgtgtcggcaccgcctgttacaccgcccatagcggaaagctaagcgcggcagaggcccagaaccattgcaatcagaacggaggtaacctggccaccgtgaaatccaaggaagaggcccagcacgtccagcgtgtcctggcccaactactgcgccgagaggccgcattgactgctaggatgagcaagttttggatcggtttacagcgcgaaaagggtaagtgtctggatccctctctgcccctgaagggtttcagctgggtgggcggcggggaggacactccatactctaattggcacaaagaacttcggaactcctgcatttccaaaagatgtgtaagtctgctcctcgatctctcacagcctctcttgccaagcaggctgccgaaatggtccgaaggcccctgcggaagccctggatcgcctggatctaacattgaagggttcgtgtgtaagttttcttttaagggcatgtgccgacccttggctttaggtggccccggacaggtcacatataccactccattccagactacttcttcgtctctagaagccgtaccctttgcttctgcagcaaacgttgcttgtggtgaaggtgacaaggatgagacccaatctcactattttctctgcaaggaaaaggctcccgatgtttttgactggggttccagcggaccactatgcgtttccccaaaatacggatgtaattttaataacggcgggtgccatcaggattgttttgaggggggcgacgggtccttcctatgcggatgtcgacccggcttcaggctgctcgacgatctggtgacatgcgcttctcgcaacccttgctcttcctcaccttgtagaggaggcgccacctgtgtgctgggtccacacggcaaaaactatacctgccggtgtccacaagggtatcaactcgactccagtcagttggattgtgtggatgtggatgaatgtcaagacagcccttgcgcccaggaatgcgtgaataccccaggcggttttaggtgcgagtgctgggtgggttacgagcccggcggaccaggcgaaggagcctgccaggatgtggacgagtgcgcgctggggagatcgccttgtgcacagggctgtacgaacacagacgggagctttcattgctcgtgtgaggaggggtatgtgctcgctggagaggacggaacccagtgccaggatgtggatgagtgtgttggtccagggggacctctgtgtgacagtctatgctttaacactcaggggagcttccattgcgggtgccttcccggttgggtccttgcacctaacggggtgtcgtgtacaatgggtcctgtcagcctcgggcccccatctggtcctcctgacgaagaggacaagggggagaaggaaggttccacggtgcctagagctgccactgcctcccccacaagaggtccggaagggacaccgaaagcaacccccactaccagcaggccatccttatcttccgacgcaccaatcacatctgctcccctcaaaatgctagccccctctggctcccccggagtgtggagggagccatctattcaccacgccactgccgccagcggcccacaggagcccgccggaggagatagttcggttgctacacagaataacgatggtaccgatgggcagaaactccttctgttctacattctgggcacagttgtggctattttgttactgctggctctcgccctggggctccttgtctataggaagcggcgggctaaacgagaagagaaaaaagagaagaagcctcagaacgccgcggacagctattcttgggtcccggagcgtgccgagagtcgagcgatggagaaccaatactcccccacacctggaacagactgttag

SEQ ID NO: 24882 - DNA, 1044 bp, Artificial Sequence
  Description of Artificial Sequence: Synthetic coding sequence
atggccacaagcatgggtctccttttgctgctcctgctgttgctcacccagcctggggccggaacaggagccgacacggaggcagtggtttgtgtcggcactgcctgttacacagcccactcgggaaagctgtccgccgccgaggctcagaaccattgtaatcaaaatggcggcaatcttgcaaccgtgaagtcgaaggaggaagcacagcacgtgcagcgggtgctggcccaactgcttagacgggaggctgccctcacggcgcgcatgagcaaattttggataggcctgcagcgcgagaaggggaagtgtctagatccttccttgccactaaaagggtttagctgggtcggcggtggtgaggacacgccatattcaaattggcacaaagaacttcgaaactcatgcatctcaaaaagatgtgtttccctgttgttggacttgagccagcctctgctccctagccgattgcccaagtggtctgagggcccatgcgggagtcccggcagccccggttccaatattgagggttttgtctgtaagttttcctttaagggaatgtgccgtccattggccctgggaggccccggtcaggtcacttatacaacccccttccagaccacctcatccagcctcgaggccgtgccgttcgcatcagccgccaatgtagcttgtggcgaaggcgacaaggatgagacacaaagccattattttttgtgtaaagaaaaggctccggacgtttttgactggggctcttccggacctctctgcgtgagcccgaaatatggatgcaacttcaataacggaggctgtcatcaggactgtttcgaaggcggtgacggctctttcctctgcggatgcagacctgggttcaggctactggatgacctggtaacctgcgccagccggaatccctgcagcagctcaccctgccgtgggggagcgacgggtttgagtcaggctgagagtgaagagggaggggaagaaggcgaggaggctcctgaatgcgggagacagctgctcttgggctcccgggcaagctag

SEQ ID NO: 24883 - DNA, 447 bp, Artificial Sequence
  Description of Artificial Sequence: Synthetic coding sequence
atgccagtcctgaaacagctcggccctgcgcagcctaagaaacggcctgatcgtggagccctctctataagtgcacctctgggcgactttcgtcacaccctgcatgtgggtcgtggaggtgacgcctttggagatacttccttcctcagtaggcacggtggcggcccaccaccagagccgcgagccccgcccgctggagccccacgaagtccccctccccccgcagtaccacagtcagccgctccctcccctgcggatccgctcctgtcgtttcacctggatttgggccccagcatgctggatgccgttctgggcgttatggatgctgctcgccccgaggccgcagcggctaaacccgacgccgagccacgccctggcacacagccccctcaggctagatgtcggcctaatgcagatctggaactaaacgatgtcatcgggctttag

SEQ ID NO: 24884 - DNA, 240 bp, Artificial Sequence
  Description of Artificial Sequence: Synthetic coding sequence
atgagcgagttctggcataaactgggatgctgcgtggtcgaaaaaccccagcccaagaaaaagcgaaggcggatagatcgcactatgatcggagagcctatgaatttcgtccacctcacccacatcggctctggggagatgggggcgggtgatggactggctatgacaggcgctgttcaagagcagatgaggtcgaagggcaatcgagaccgcccgtggtccaactcgagaggcctctag

SEQ ID NO: 24885 - DNA, 240 bp, Artificial Sequence
  Description of Artificial Sequence: Synthetic coding sequence
atgagtgagttctggcacaaactagggtgctgcgtggttgaaaaaccccaaccaaagaagaagagacgccgtatcgacagaactatgatcggagagccaatgaactttgtgcacctgacacacatcggctccggcgagatgggagctggcgatggcttggctatgaccggagcggtgcaggaacagatgagatcaaaaggcaaccgggatagaccgtggtccaactctagaggattgtag

SEQ ID NO: 24886 - DNA, 255 bp, Artificial Sequence
  Description of Artificial Sequence: Synthetic coding sequence
atgtctgagttttggttgtgcttcaactgttgtatcgctgaacagcctcagccaaaacggaggcggaggattgaccgatcgatgattggggagcccaccaactttgttcataccgctcacgtgggaagcggggatctcttttccgggatgaactccgtgtcgtctatccagaatcagatgcagtctaagggagggtacggggggggaatgccggctaacgtgcagatgcagctggttgatactaaagcaggctag

SEQ ID NO: 24887 - DNA, 255 bp, Artificial Sequence
  Description of Artificial Sequence: Synthetic coding sequence
atgagcgagttctggctgtgttttaactgctgtatagcagaacagccacagcctaagcgtagacgtagaatcgacagaagcatgattggagagcctacgaacttcgtgcatactgcccatgttggctccggcgatctctttagcgggatgaactcagtgtcctccatccaaaatcaaatgcaatccaaaggaggttatggcgggggtatgcccgcaaatgtgcaaatgcaactcgtcgacaccaaagccggctag

SEQ ID NO: 24888 - DNA, 255 bp, Artificial Sequence
  Description of Artificial Sequence: Synthetic coding sequence
atgagcgagttttggctctgcttcaactgctgcatcgcggagcagccccagcctaagagaaggcgcagaattgacaggagtatgatcggggagccaaccaatttcgtgcatactgctcacgtcgggtccggcgatctgttctcagggatgaatagcgtttcaagcatccagaatcagatgcagagcaagggaggctacggagggggtatgcccgcaaatgtacagatgcagctcgttgatacaaaagcggggtag

SEQ ID NO: 24889 - DNA, 1482 bp, Artificial Sequence
  Description of Artificial Sequence: Synthetic coding sequence
atgttccctgtgttcccatgcacattgttggccccgcccttccctgtcctcggcttagacagtcgcggtgtgggcggactgatgaattcattcccgccacctcaggggcacgcccagaaccctctgcaggttggggccgaactccagagccggttcttcgcctcccaaggttgcgctcagagtccattccaggccgcgcccgcacccccgcccacacctcaggccccggctgctgaacctctgcaagtcgatctgttgcctgtgctcgcggctgcacaggagtctgctgcagctgctgccgctgccgcagccgcagccgcggccgttgccgctgcccccccagcaccagctgccgcatctaccgtcgacaccgccgctcttaagcaaccccctgctcctcctcccccgccaccccccgtgagtgctcctgccgccgaagcagcacctccagcgtccgcggctactattgcggctgctgcagccacagctgtggtggctccaacctcaacagttgctgtggcccccgttgcttcggccctggagaaaaaaactaagagcaaaggaccttacatttgtgcactgtgcgctaaagagtttaagaacgggtacaatctccgccgtcacgaggccattcacaccggtgcaaaggctggcagggtgccgtcaggtgcgatgaaaatgccaaccatggttcccctatctctcctgagtgttccccagttgagtggtgccggaggtggcggtggtgaggccggcgcgggggggggtgccgccgccgtggctgccgggggggttgttacaaccacagcctcaggcaaacgcattaggaagaatcacgcttgcgagatgtgtggtaaagcctttcgcgacgtctatcatctgaaccgacataagctgtcccatagcgatgaaaagccctatcagtgccccgtgtgccagcaaaggtttaagagaaaagatcgaatgtcctatcatgtcagatcccatgacggcgccgtgcataaaccttataactgtagtcattgcggaaaaagcttttcccgccctgatcacttgaattcccacgtgcgccaggtgcactccaccgaaagaccttttaagtgcgagaagtgcgaggctgccttcgcaaccaaagatagactgagggctcacaccgtgaggcacgaagaaaaagtaccgtgccacgtctgtggaaaaatgctgagctctgcatacatcagcgatcacatgaaggtgcactcccaggggcctcatcacgtctgcgaactttgcaacaagggattcacgaccgctgcctatctacgcatccatgccgtgaaggatcatggtttacaggcccccagagccgaccgcatcttgtgtaagctgtgctccgtgcattgtaagactcctgcacagctagccgggcacatgcagacgcaccttggcggggctgcgccgccagtccctggtgacgccccccagccacagcctacatgttag

SEQ ID NO: 24890 - DNA, 549 bp, Artificial Sequence
  Description of Artificial Sequence: Synthetic coding sequence
atgttgccaactgccgccggctttagcatatggggtcagccaggcgctgccagggaggcaccaaggtgccaaaccaaaatatcaagctgctcctgcccaacatcctccgtgtccgccgcccacggaccaggtccgaacgagagagcccggggcctgggaggtctaccagatccagccctttctccccgggtgcccttccagggttatgccaggatcgtgtttgcgatcataagcttctactttatgccctgctgccccctcactgcatcatccttctatctgcttagtggtctgctcgacgcgtttgatggccacgctgctcgggctttaaaccagggcacaaggtttggggcaatgctcgatatgcttaccgatagatgcagcacgatgtgcctcctggtgaatctggccctgctgtacccaggcgctaccctgttcttccaaataagcatgagcctggacgttgcatctcactggctccacctgcacagatcggccgcaatccttggtgcgtgggcaacctggcgtcattactctggagtcggttag

SEQ ID NO: 24891 - DNA, 1215 bp, Artificial Sequence
  Description of Artificial Sequence: Synthetic coding sequence
atgatttggaaaagatcagcagtgctgcggttctattccgtgtgcggactgctgctgcaggctgcggccagtaagaacaaagtcaaaggcagccagggacaattccctctgacacagaacgtgacagtcgtcgaggggggcaccgctatattgacatgtagggtcgaccagaatgacaacacctcgttacagtggtcaaatccagctcagcagacattgtactttgatgataaaaaggcccttcgcgacaaccggattgaactcgtccgggcctcttggcacgaactgtcaatttccgtttcagacgtttcactctcagatgagggccagtatacctgtagcctgtttacaatgccggtgaaaactagcaaggcctacctcacggtgctgggggtgcctgagaagccccagattagtgggttctcttcccctgtgatggagggggacctgatgcaacttacttgtaaaaccagtggctcaaaacccgctgccgacataaggtggtttaaaaacgacaaagaaatcaaagatgtcaaataccttaaggaagaagacgcaaacagaaagactttcaccgtatcttcaaccctggacttcagggtggatcggtccgacgacggagttgccgtcatttgtcgcgtggaccacgaatcgcttaacgctaccccacaagttgcgatgcaggttctcgagattcactatacaccatccgtgaaaataattccttccacacccttcccccaggagggccagcctctgatcctgacctgtgagagcaagggtaaaccactcccggaacctgtcttatggactaaagacggtggtgagttgccggaccctgacaggatggtggtgtcaggccgcgagctcaacatcttgttcctcaataagactgataatgggacctatcgatgcgaagccacaaataccatcggccagtccagtgccgagtatgtgctgatcgtgcatgatccaaacgccctcgccgggcagaacggcccagaccatgcactgatcggaggcatcgtagcagtcgttgtctttgtgacactgtgcagtatatttctgctagggaggtacctcgctcgacacaaaggcacctacctgacaaacgaggcaaaaggcgcagaggatgcaccagacgccgacacagccataatcaacgcggaaggttcccaggtgaatgcggaggagaagaaggaatattttatctag

SEQ ID NO: 24892 - DNA, 1314 bp, Artificial Sequence
  Description of Artificial Sequence: Synthetic coding sequence
atgtttgtgctctttctgtgcaacttgagcctagttccagcagccgcttccaagaataaggtgaagggaagccagggtcagttcccgctgacgcagaacgtgactgtggtggaaggcggaacagcgatcctcacctgccgggtcgatcaaaacgataatacgtccctacaatggagcaatcctgcccagcagactctgtatttcgatgataaaaaggctctgagggacaatcgcattgaactagtgcgggcgtcttggcacgaattaagcatcagtgtatccgacgtgtctttatcagatgaaggtcagtatacatgtagtttgttcacgatgcctgtgaaaaccagtaaagcatacctcacagtgctcggcgtccctgaaaagcctcagatatccgggttcagctcccccgtaatggaaggagacctgatgcagctgacctgtaagacctccgggagcaaacctgccgccgacatacgttggtttaaaaacgacaaggagattaaagacgtgaaatacttgaaagaggaggatgccaaccgcaaaacattcacagtatcgtccacccttgactttagggtggacagaagcgacgatggtgtagccgtgatttgcagagtagatcatgagagcctgaatgccacaccgcaggttgccatgcaagtgcttgagatccattatacccctagtgttaagataatcccatccacaccatttcctcaagaaggacagcccctcatcctgacctgtgaatccaagggaaaaccattacccgaacccgtgctctggaccaaggatggaggggagttaccagaccccgatcggatggttgtaagtggtagggaactcaatatactgttcctgaacaaaacagataacggcacctaccggtgtgaagcaaccaataccattggccagtctagcgcagaatacgtactgatcgtacacgacgtgcctaacaccctgctgccaaccaccattatcccttctctgaccacggcaaccgttacaactactgttgccatcactacctctccgacaacttctgcaaccacatcctctattagggaccccaatgcgctggccggccaaaatggtcccgatcatgcattgatcggcggaatcgtggcagtggtggtgttcgtgaccctttgttccatcttcctgctgggccgctacctggcgagacataagggtacctatctcaccaacgaggctaaaggcgcagaggacgcacctgacgcagacacagctatcatcaatgccgagggaagccaagtgaacgccgaggaaaagaaggagtacttcatctag

SEQ ID NO: 24893 - DNA, 1308 bp, Artificial Sequence
  Description of Artificial Sequence: Synthetic coding sequence
atgatctggaagcggtccgctgtgctcaggttctattccgtttgtggtctcttattacagggatctcagggtcaattcccccttactcaaaacgtgacggtcgtcgaaggtggcacagccatcctgacatgtcgagtcgaccagaacgacaatactagcctgcaatggtcgaatccagcacaacagacactttattttgacgataaaaaggcactgcgtgacaacagaattgaattagtcagagcctcttggcatgaactgtctattagcgtgtccgatgtctcgctcagtgatgaagggcagtatacttgctccctgttcactatgccagttaaaacttcaaaggcgtatttaacagtacttggtgtccccgagaagccacagatttctggcttcagttcacctgtgatggagggggatctgatgcagcttacttgtaaaacatctggtagcaaacccgctgcagacatacggtggtttaagaacgacaaggaaatcaaggacgtgaaatacttaaaagaagaggacgccaatcgcaagacctttacagtctcctctacattggactttagggttgaccgatctgatgacggtgttgctgttatttgtagagtggatcacgagtccctaaacgccacaccccaggtagccatgcaggttttggaaattcactacactccttccgttaaaatcatcccctcaacaccattcccgcaggaaggacagccactgatcctgacctgcgaatccaaaggaaaaccgctccccgagcccgttctgtggacgaaagatgggggtgagttgcctgatccggaccggatggtcgtgtccgggagggagctcaatattctgtttctgaacaaaacagataacgggacttataggtgcgaagccactaataccataggccagagcagcgccgaatatgtgctcatagtccatgatgtgccgaacacccttttgcctacgacaattattccatccttgacaaccgccaccgtaaccacaacggttgcgatcactacttctcccaccacctcagcaactacctctagtatacgggatcccaatgctttggcagggcagaacgggccagaccatgctttgatcggcgggatcgtcgcagtggtggttttcgttaccctttgcagtatcttcctgctggggagatacttggctcggcacaagggcacatatttaacaaatgaggccaagggcgctgaggacgcacctgatgcagacaccgcgatcataaatgccgagggatcacaggttaatgccgaagaaaaaaaggagtactttatctag

SEQ ID NO: 24894 - DNA, 1299 bp, Artificial Sequence
  Description of Artificial Sequence: Synthetic coding sequence
atgggagctccagctgcgtctttgttgctgttactcctgctgtttgcctgctgctgggcacctggtggtgctaaccttagtcaggatgggtactggcaggagcaagatctcgagctgggtacactggccccattggacgaggcaatctcatcgacagtatggtctagtccagatatgttggccagccaggattcgcagccctggacctcagatgagactgtggtggcaggcggaacagtggtcctcaagtgccaagtgaaggaccacgaggacagtagtctgcaatggagtaatccagctcaacagacactttacttcggagagaagcgggcactccgagataacaggatccagttagtgacatccactccccatgaactgtccattagcattagtaacgtcgctctggcagacgaaggagaatacacgtgcagcatattcactatgccagtaagaaccgcaaagagtctcgttactgtgctgggcattccgcaaaagccaatcatcacaggctataagtcttccctccgcgagaaggataccgccacgctaaactgtcagtcttccgggagtaaaccggcagccaggctgacatggagaaaaggcgatcaggagctgcacggggagcccactcgtatccaggaggatccgaacgggaagactttcaccgtgtccagctctgtcacattccaggtcacgcgagaggacgatggtgcctcaatcgtatgctcggtgaatcacgagtctctgaaaggagcagatcgcagcaccagccagcgcatcgaggtcttgtatacgccaacagcaatgatacgccccgatcctcctcacccccgcgagggccagaagttactccttcactgtgagggccggggaaatcccgtgcctcagcagtacctatgggagaaggagggatccgtcccacctctcaagatgacgcaggaatccgctctcattttccccttcttgaacaaaagcgattctggaacctatgggtgcacagctacgagcaatatggggtcttacaaggcctactatacacttaacgtgaacgatccaagtccagtgccatcgagttcttccacgtatcacgctattattgggggaattgttgcctttatcgtttttcttctactgattatgttaatatttctgggccattacctgatcaggcacaagggaacgtatttgacacatgaggccaaggggtctgatgacgcacctgatgctgatacagctataataaacgccgagggcgggcagtccggtggagatgataaaaaagagtactttatctag

SEQ ID NO: 24895 - DNA, 1197 bp, Artificial Sequence
  Description of Artificial Sequence: Synthetic coding sequence
atgggcgctcccgccgcctcccttctgctgttattacttctgttcgcgtgctgctgggccccaggcggcgccaacctgtcccaggatgatagccagccatggacatccgatgagacagtcgtagccggcgggactgttgtgctcaagtgtcaggtgaaggatcacgaagacagtagtctgcagtggtctaacccagcccaacaaaccctgtacttcggggagaaaagggcgttgagggataatagaatccagctagtgacttcaacccctcacgagctgtccatctcgatcagcaatgtggcactcgccgacgagggcgagtatacgtgtagcattttcaccatgcctgtgagaacggccaaaagtctggtcacggttctcggaatccctcagaagccgattatcactggatacaagagttcgttacgagagaaggacaccgccacccttaactgtcaatcctctgggagcaagccagcagcgcggctgacttggcgtaaaggggatcaggagctccatggtgaaccaaccagaattcaggaagaccctaacggtaagaccttcaccgtctccagcagcgtcactttccaggtgacacgggaggacgacggagctagcatcgtttgctccgttaatcatgaatccctgaagggtgccgaccgcagcactagtcagcggattgaggtgctgtatactcctaccgctatgatacgacccgatccaccccacccgagagagggccaaaaactgttactgcactgcgaagggagagggaacccggtacctcaacagtacctttgggagaaggagggctccgtgccacctctgaagatgactcaggaatccgcgctcatattcccattcctgaataagtcggatagcggaacttatggttgtacagctacaagtaacatggggagctataaagcttactacacattaaacgtgaacgaccctagccctgtaccatccagctccagtacctatcacgccattatcggaggcatcgtcgccttcatcgtgtttctgctgctgatcatgctgatttttctgggccattacctaattcgccacaaaggaacatatttaacacatgaggccaaaggttctgacgatgcacctgatgccgatactgcaattatcaatgcagaaggcggccagtccgggggcgacgataaaaaagagtatttcatttag

SEQ ID NO: 24896 - DNA, 705 bp, Artificial Sequence
  Description of Artificial Sequence: Synthetic coding sequence
atgggagcccctgccgccagcctgctactcctccttctcttgtttgcatgctgttgggcccccggcggcgccaaccttagccaggatgacagtcagccttggacctctgacgagacagtcgtggcgggaggcaccgtagtattaaagtgccaggtgaaggatcacgaggattcctccctgcaatggtccaatccagcccagcagactttgtatttcggggaaaaaagagcactgcgagacaatcgcattcagttagtgacatcaacacctcacgagctctccatatccatttcgaacgtagcactggccgatgaaggcgagtacacctgctctatcttcacaatgccagttcggactgcaaagagcctggtgactgtgcttggcatcccccaaaaacctattataaccggatataaatccagtctgcgtgagaaggacaccgccacgctaaactgtcagtctagtggctcaaaaccagccgcccgactgacttggcgcaaaggtgatcaggaactccatggtgagcccacacgaattcaagaggaccccaatgataccccaacagccatgatcagacctgaccctcctcatccccgggaaggacagaaattactgctgcattgtgagggtaggggcaacccagtgcctcagcagtatctgtgggagaaggaggggagtgtgcctcctctcaagatgacccagtag

SEQ ID NO: 24897 - DNA, 2130 bp, Artificial Sequence
  Description of Artificial Sequence: Synthetic coding sequence
atgccttcagctactagccacagcggctcggggagcaaatcctccggacccccgcctcctagcgggtcttcaggtagcgaggccgcagccggggccggtgctgcagccccagcctcacagcatccggcaacgggtacgggagctgtccaaacagaggccatgaaacaaatactgggcgtgattgacaagaaactccgaaatttggagaaaaaaaaaggtaagcttgatgattaccaggaaagaatgaacaaaggtgagaggctaaaccaggaccagcttgacgcagtgtcgaaatatcaggaagttactaataatcttgagttcgcgaaggaattgcagcggagctttatggccctatctcaggacattcagaaaaccattaagaaaaccgctcgtagggaacagctgatgagggaggaggccgaacagaaacggctgaaaactgtgctggaattgcagtatgtcctggacaaattgggcgatgatgaggttcgaactgatctcaagcaggggcttaatggcgttcccatactgtcagaggaagagctctccctgctggacgaattttacaaactcgttgaccccgaaagggacatgtccctcagactgaacgagcagtatgaacacgcctctattcatttgtgggatttacttgaaggaaaagagaagcctgtttgtgggacaacctacaaggttctgaaggaaatcgtggagagggtcttccagagcaattattttgactcaacccacaatcaccaaaacggcttgtgcgaagaggaagaagcagcaagtgctccagccgtagaggatcaagtgcctgaagccgaaccagagcccgcagaagaatatacggaacaaagcgaggtggaaagcaccgaatacgtcaatcgacaatttatggccgaaacccaatttacaagcggagaaaaagaacaggtagatgaatggaccgttgaaacagtggaggtcgtgaactctctccaacagcaaccccaagccgcttctccaagtgtacccgaaccccattctctgacacctgtggcacaggccgaccctctggtgcggaggcagcgtgtgcaggatctcatggcccaaatgcaaggcccttataatttcatccaggatagtatgctcgattttgagaaccagaccttagatcccgcgatagtttccgcgcagcccatgaatcctacccaaaatatggatatgccccagttagtttgcccccctgtgcactccgaaagcaggttggctcaacccaaccaagttcccgtccagcccgaggccacccaggttcctctggtgtcgtccacttctgaaggctacacagccagccaacctttatatcagccgagccatgcaaccgaacagcgcccacagaaggaaccaattgaccagattcaggctaccattagtcttaataccgaccaaaccacagccagcagcagtctgcctgccgcctctcagccccaggtgtttcaggcaggtacctccaagcctctgcattcctctggaattaatgtcaatgcagcacctttccagtcaatgcagactgtgttcaatatgaatgctccggtcccaccagtgaacgagccagaaaccctgaagcagcaaaatcagtaccaggcctcatacaaccagtcattttcctcccagccccaccaggtggaacaaacggagttgcaacaagaacagctgcaaaccgtggtaggaacttaccacggttcccctgaccagtcccaccaggtcacaggtaaccaccaacagccaccgcagcaaaataccggcttcccaaggagtaatcagccttattacaatagcagaggtgtgagtagaggcggctcacggggagccagaggtttgatgaacggttaccgtggtcccgccaatggctttaggggcggttacgacgggtacaggcccagcttcagtaacactcctaactctggatatacacagtcccagttctccgctccaagggactacagcggctatcaacgggacggctaccagcagaactttaaaaggggttccggacagtccgggcctaggggagcccctcgaggaagagggggccctcctagaccgaatagaggcatgccacagatgaatacccaacaggtgaactag

SEQ ID NO: 24898 - DNA, 2130 bp, Artificial Sequence
  Description of Artificial Sequence: Synthetic coding sequence
atgccctcggcaaccagccatagcggctcaggaagtaagagttccggtcccccacctccctccggctctagtggttcagaggcagctgccggcgctggagcagcggcgccagcctctcaacatcccgccacaggaaccggcgctgttcagactgaggcgatgaaacagattctgggtgtgattgacaaaaaattgcgaaacctcgagaaaaaaaaaggaaagctggacgattatcaggagagaatgaataagggggagcggctaaatcaggaccagctggacgccgtgagtaagtaccaagaagtcactaataacttggagttcgcgaaagagctgcagcgttcttttatggctctcagccaggatatccagaagaccataaagaagactgctaggagggaacagctcatgagagaggaggcagaacagaaacgtctcaagaccgtcctggagctgcagtatgtgctcgacaagctaggcgatgatgaggtgcgaacagacttgaagcaaggattaaatggcgttcctatcctgtcggaggaagagttgagcttacttgacgagttttataagcttgttgatcccgagagggatatgagccttcgcctgaatgagcaatacgaacatgcttctatccacctttgggaccttttggagggcaaagagaaaccggtgtgcggaacaacatataaggtgcttaaggagatcgttgagcgagtctttcaatcaaactattttgattcgacgcacaatcaccaaaatggcctctgcgaggaggaggaagctgcaagcgcacctgccgtggaggaccaggttcctgaggctgagccggaaccagccgaggagtacactgagcagtccgaggtcgagtcaacagagtatgtaaaccgccagtttatggcagaaacccaattcacctcaggcgaaaaggagcaggtcgacgaatggactgtggagactgtggaggtggtcaattcgctgcaacagcagccccaggcagcatccccctccgtgcctgagcctcacagtctcacgccagtcgcccaggccgatcccctggtgagacgccagagggttcaggacctgatggcccagatgcagggaccctataatttcatacaggattccatgctcgatttcgaaaatcagaccctggatcctgcaatagtttcggctcagccaatgaaccccacacagaacatggatatgccacagctggtttgccccccggtccatagcgagtctagactggcacagccaaatcaggtcccagtccagccggaggccacccaggtccctcttgtgagctccaccagcgaaggatataccgcttcgcaacccctttatcagcctagccacgctacagaacagcgacctcagaaggagcccatcgaccagattcaagccactataagcctgaataccgatcaaaccactgccagtagcagcctcccagccgcttctcagccacaggtgttccaggcagggacaagcaaaccattgcacagctctggaatcaacgtgaatgccgcaccttttcagagtatgcagaccgtcttcaacatgaacgcaccagtgccaccagtaaacgaacctgagactctgaagcagcagaaccagtaccaggcaagctataaccagtcattcagtagccagccacaccaagtggagcagactgaattgcaacaggagcagctccaaactgtggtcggaacctaccatgggtcgccagaccaaagtcaccaagttactggaaatcaccagcagccaccccaacaaaacacgggattccctcggagcaaccaaccctactacaattctcgaggcgtcagccggggggggagtagaggtgcgcgcgggctgatgaacggttatcggggcccagcgaatgggtttagaggcgggtatgatggatatcgcccctctttctcaaacaccccgaacagtgggtacacccagagtcagttctccgctccccgggactatagtggttaccagagggatggttaccagcagaattttaagcggggtagcgggcaatccgggccacgaggagctccacgcgggcggggcggcccacctcgaccaaatcggggcatgccccagatgaatacacagcaggtgaattag

SEQ ID NO: 24899 - DNA, 2085 bp, Artificial Sequence
  Description of Artificial Sequence: Synthetic coding sequence
atgccgtccgcaacatcccactcgggctctggtagtaagtcctctggcccgcctcctccaagtgggtcttctggatcagaggcggccgccggggccggcgcagctgcacctgcatcccagcacccagcaaccgggacgggcgctgtccagaccgaagcaatgaagcagatattgggcgttattgacaagaagctccgcaatcttgagaagaagaaaggcaaactggacgactaccaagagagaatgaataagggagagcggctgaatcaggatcaattggacgcagtcagtaagtatcaggaagtcaccaataatctggaatttgccaaagagttgcagcggagtttcatggcactgtcacaagatatccagaagactataaagaaaacggcccggcgtgagcaattgatgagagaggaagccgaacagaagaggctgaagacagtgctcgagctacagtacgtcctggataagttaggggacgatgaagtccggaccgatctgaagcagggactgaacggcgtgcccattttaagcgaggaggaactttcgctgctcgacgagttctacaagctcgtggaccctgagcgagatatgagtcttaggttgaatgaacaatacgaacatgcaagcatacatctgtgggatctgttagagggtaaagagaaaccagtgtgcgggactacgtataaagtgttgaaagagatcgttgagagggtgttccagagcaattatttcgattctacacacaaccatcagaacgggctttgtgaggaggaagaggctgctagtgcccccgcagtagaggaccaagtgcccgaggctgaacctgagccagcggaggagtataccgagcagtcagaggtcgagtcgacggagtacgtgaataggcaattcatggccgagacccaatttacaagtggtgaaaaagaacaggtggacgagtggaccgtggagacagtagaggtagttaattcgctgcagcagcaaccccaggcagcctccccttccgtccccgaaccccactctctgacacctgtcgcccaggcagaccctcttgttcggcgtcagcgtgtccaggacctgatggcacagatgcaggggccatacaattttattcaagactctatgctcgactttgagaatcaaactctggaccctgctatcgtgtctgcgcaaccaatgaacccaactcagaacatggacatgccccagttggtctgtcccccggtccacagcgagtctagattggcccagcccaatcaggtccctgtgcagcccgaagctactcaagtccctcttgtgtctagcacatccgaggggtacaccgcttcccaacccctctatcagccaagccatgccaccgagcaacgcccgcagaaggaacctatcgatcagatccaggcgaccatttcactaaatactgatcagacgacagcttctagtagcctgccggctgctagtcaaccccaggtgttccaggcaggcacctccaagccactgcactcaagtgggattaatgtcaacgctgcaccttttcagagcatgcagacagtgttcaacatgaacgctccggtgcctcccgtaaacgagcccgaaaccctgaaacagcagaaccagtatcaggcctcttacaaccagtctttttcatctcaacctcaccaagtggagcagactgagttacagcaggagcagctccagactgtagtagggacatatcacggtagccccgaccagagccatcaagtgaccggaaatcatcagcagcctccgcagcagaacacaggctttccaaggtcgaaccagccgtactataattccagaggcgtctcccgcggagggtctcgtggagcgcgtggcctaatgaacggttatagaggacccgcgaatggcttcaggggcggatacgacggatatcgcccttctttctcaaatactccaaatagcgggtacacacagtcacagttctctgcaccacgagactactccggatatcagagggacggatatcagcagaacttcaaaagagggagcggtcagtctgggccacgcggggccccacgggggaatatcctctggtggtag

SEQ ID NO: 24900 - DNA, 2274 bp, Artificial Sequence
  Description of Artificial Sequence: Synthetic coding sequence
atgtcggagaactcatccgacagcgacagcagctgtgggtggacggttatttctcacgaaggcagcgacatcgagatgctgaatagcgtcactccaaccgactcctgcgaacccgcacccgagtgttccagtctggaacaagaagagctgcaggctttgcaaatcgagcagggagaaagctcacagaatggcactgtgcttatggaggaaaccgcataccctgcactggaggaaacatcgtcgaccatcgaggcagaagaacaaaaaatccccgaggattcaatctatattggtacagcgtcagatgattccgacatcgtcacacttgaaccccccaagctggaagagatcggaaaccaagaagtggttatagtagaggaagctcaaagtagcgaagatttcaatatggggtcaagcagttcctcacagtacacgttctgtcaacctgagactgtgttctcaagtcagccttcggatgatgagtcctcaagtgacgaaaccagcaatcagcccagccccgcatttcggagacgacgggcccgcaagaaaacagtgtccgcgagtgaaagcgaagaccgcctggtggccgagcaggaaacggaaccctccaaggaactgtccaagaggcagttttcaagcgggctgaacaagtgcgttatcctcgctctggtgatagccatcagcatgggcttcggccatttctacggcacaattcagatacagaagagacagcagctcgttcgtaaaattcatgaagacgaactgaacgacatgaaagactacctctcgcaatgccaacaggaacaagagtcgtttatcgattataaaagtcttaaggaaaatctggctaggtgctggacgttgacggaggccgagaagatgtcattcgagacccagaaaacgaacctcgccaccgaaaatcagtatttgagagtctctcttgagaaagaggaaaaagctcttagttcactgcaggaagagctgaacaagctaagggaacagattcggattctagaagataagggaaccagcactgagctagtaaaggaaaaccagaaactaaagcaacaccttgaggaagaaaaacaaaaaaaacattcctttctgtctcaacgggagaccctcctaaccgaagccaaaatgctgaagagggagcttgagcgtgagcgactggtaacaaccgccttgagaggagaactccagcagctgtccggcagtcagctgcatggcaaaagcgatagccctaatgtctatactgagaagaaggaaatcgctatcttgcgggaaaggctgacagagctcgaaagaaagctgacattcgagcaacagagatccgacttatgggagcggctgtatgtggaagcaaaggaccagaacggtaagcagggcaccgatggcaagaaaaaaggtggccggggctcccaccgtgccaagaacaagagtaaagaaacctttctcggatccgtgaaggaaacattcgacgcgatgaaaaatagtaccaaggaattcgtgcgacatcacaaggagaagatcaaacaggcaaaagaggcagttaaagagaatctcaagaaattcagcgactccgtcaagagcactttccggcattttaaagacacgacaaagaatattttcgacgaaaaagggaataaacggtttggggccactaaggaagctgcggagaagcctagaacggtcttttccgattacctgcatcctcagtacaaagcccccacagagaaccaccacaataggggacccacgatgcagaacgatggccggaaggagaagccagtccattttaaggagttcaggaagaatacaaatagcaaaaaatgcagtcccggtcatgactgtcgcgaaaactcacatagttttcgaaaagcttgcagtggggtgttcgattgtgcccagcaggagtccatgtccctttttaatacagtggtgaatcctatccgaatggatgaatttagacaaatcattcaaagatatatgcttaaagagcttgatacattttgccactggaatgaactggatcagttcatcaataagttcttcctgaacggcgtattcatacacgatcagaaactgttcacggattttgtaaacgacgtcaaggattacctcagaaacatgaaggaatacgaggttgacaacgacggcgtctttgagaaattagacgagtacatctatcggcacttcttcgggcatacattcagtccaccgtatggacctcggtcagtgtacatcaagccctgccattatagcagcttatag

SEQ ID NO: 24901 - DNA, 1275 bp, Artificial Sequence
  Description of Artificial Sequence: Synthetic coding sequence
atgtctgagaatagctccgatagcgattctagctgcggttggaccgtcatatctcacgagggttcagacatcgagatgttaaactccgtgacacctaccgacagctgtgaaccggcccccgagtgttccagtctggaacaggaggagctgcaagcactgcagatcgagcaaggagaaagtagtcagaacgggactgttctgatggaggaaactgcatatcctgctcttgaggaaaccagctccacgattgaagccgaagagcagaagatccctgaggatagtatttacatcggcacagcttcagatgacagcgacatcgtaacacttgagccccccaaactcgaggagattggcaaccaggaggtcgtgatcgtagaggaagcccagtctagcgaggacttcaatatgggcagctcttcctcttcccagtatactttctgtcagccggagaccgttttctcatcacagccttccgacgatgaaagttcctcagatgagaccagtaaccagccgagccccgccttccgccggcgaagggctcggaagaagaccgtgagtgcttctgagagcgaggatcggctggtagcagaacaggagactgaaccaagcaaagagctttccaagcggcaattttcttctggcttaaacaagtgtgtgattctagccctcgtgatcgccatctccatgggatttggacatttttacgggaccatccagattcaaaagcggcagcagcttgttcgcaaaattcacgaggacgaacttaacgacatgaaggattacctgtctcagtgccagcaagaacaggagagtttcattgactacaagagcttaaaggagaatttggcaagatgttggaccttgacagaggcagagaaaatgtccttcgaaacgcagaagaccaacctcgcaacggaaaatcagtatcttcgcaaactgtttacagactttgtcaacgatgttaaagactacttgcggaatatgaaagagtatgaagtggacaatgatggggtctttgaaaaattggacgagtatatataccgccactttttcggccacacatttagccccccctatggcccctcacggccagacaagaagcaacgaatggtcaacattgaaaactcccgacacaggaaacaagagcagaagcacctgcagcctcagccgtacaagcgggaaggaaagtggcacaagtacggtcggacaaacggcagacagatggctaaccttgagatagaacttggtcagcttcccttcgacccccagtattag

SEQ ID NO: 24902 - DNA, 2424 bp, Artificial Sequence
  Description of Artificial Sequence: Synthetic coding sequence
atgtccgagaacagttcagattcggacagcagctgcggctggacggtgattagccatgaaggtagcgatatagaaatgttaaactccgtgacaccaacagattcatgtgagcctgcgccagaatgctccagcctggagcaggaagagctgcaggcattgcagattgagcagggtgagtcatctcaaaatggcaccgtccttatggaagaaactgcctatcctgctctcgaggaaacatcctcaactattgaggcagaagagcagaaaattcccgaagattctatatacattggcaccgcctcggatgacagtgacatcgtgaccctcgaacctcccaaactggaggaaatcggcaaccaagaggttgtcatcgtggaggaggcacaatcatctgaagacttcaacatgggctcctcctccagcagccagtataccttctgtcagccagagacagtgttttctagccaacctagtgacgacgagtcctccagcgacgaaacttcaaatcagccatcccccgcatttcgtagacgccgggctcgcaagaagaccgtgtccgcttcggagtccgaggacaggctcgttgctgagcaagaaaccgagccctcaaaagaactttccaagaggcaattttctagtggtctcaataaatgtgtgattctagctctggtcatagctatcagtatgggtttcgggcatttttatgggactatccagatacaaaagcggcagcagctggtacgcaagatccacgaggacgagctgaatgacatgaaggactacctttcgcagtgtcagcaggagcaggagtcttttatagactacaagagcctgaaggagaacttggcgaggtgttggactctgaccgaagctgaaaagatgtcctttgagactcagaaaacaaacttagctacggaaaaccagtatctgagggtgagcttggaaaaggaggaaaaagccctgtccagcctgcaagaggaactcaacaaactgcgggagcagattaggattctggaggacaaaggcacgagtactgaactcgtgaaggagaaccagaaactcaaacaacaccttgaggaggagaagcagaaaaaacactcttttctgtcgcagcgcgaaaccctgctgaccgaagccaagatgctaaaaagggaattggaacgcgaacgcctcgttaccaccgctcttaggggtgagctgcagcaactctctggtagtcaactgcacggaaagtccgattccccgaatgtttataccgaaaagaaagaaatcgcaattctgagggaacgacttacagaactcgagcgtaaacttacattcgagcagcagagatccgatctatgggagaggttatacgtcgaggccaaagaccagaatggtaaacagggaaccgatggcaagaagaagggaggccgtggctcccacagagccaaaaacaagagcaaggagaccttcttgggatcagtgaaagagactttcgacgccatgaagaatagtaccaaggaatttgtcagacaccacaaggagaagatcaagcaagctaaggaagccgtgaaggagaacctgaaaaagtttagcgactcggtcaagtcaaccttcaggcacttcaaggataccaccaaaaatatcttcgatgagaaagggaacaagcgcttcggcgctacgaaggaggccgccgagaaaccacgcactgtgtttagtgattacctgcacccccagtataaagcacctaccgaaaaccatcataataggggacccaccatgcagaatgacggtaggaaagaaaaaccagttcatttcaaagagtttcgcaagaacactaattccaaaaaatgttctcctggtcatgattgtcgcgaaaactcacatagtttcaggaaagcgtgttccggcgtcttcgactgcgcccagcaggagtctatgtctctgttcaatacagttgtgaacccaatccggatggacgagttccgccagataatacaacgttacatgctgaaagaactggacactttctgccattggaatgaactggaccagtttattaacaagttttttttaaacggcgtcttcatccatgatcagaagctgtttacagactttgtaaatgatgtcaaggactatctgcgtaacatgaaggagtacgaggtggataacgacggcgtgtttgaaaagttagacgagtatatctacaggcatttttttggacacacttttagtccaccgtacgggccctcacgacctgacaaaaaacaaaggatggtgaacatagagaatagcaggcatcggaaacaagagcagaagcatctccaaccgcagccctataaacgggagggcaaatggcacaagtacggccggaccaacggacgccaaatggctaacctggaaattgagctgggacagctgccattcgatcctcagtattag

SEQ ID NO: 24903 - DNA, 717 bp, Artificial Sequence
  Description of Artificial Sequence: Synthetic coding sequence
atggagtatgcgatgaaaagtctatcgcttttgtatcccaagtccctatcccgacatgtctccgtgagaaccagcgtagtgactcagcagctgcttagcgagccttcacctaaggcaccaagggcgcgcccctgtcgagtgtcaaccgccgacagatcggtaagaaaggggatcatggcgtattcgcttgaagatctcctgctcaaggtccgagacaccctgatgttggctgacaagccgtttttcttagtgttagaggaggatggcaccaccgttgagaccgaagagtatttccaggccctcgcaggcgataccgtgttcatggtgctgcaaaaagggcagaagtggcagcctcccagcgagcagggcactcgtcaccctctgtccttaagtcataagccagccaaaaagatcgacgtcgcacgtgtcacctttgacctatataagctaaacccccaggactttatcggctgcctcaacgttaaggcaaccttttatgatacctactccctgagttacgatctgcattgctgtggtgctaagagaattatgaaggaagcgttccgctgggctttgttctcaatgcaagctaccggccacgtgcttctgggtacatcttgctaccttcaacaactgctcgacgccaccgaggaaggccagccgcccaaggggaaagcaagctctttgataccaacatgtttaaagatcctgcagtag

SEQ ID NO: 24904 - DNA, 402 bp, Artificial Sequence
  Description of Artificial Sequence: Synthetic coding sequence
atggaatacgcaatgaaaagtctgtctttactctaccccaaaagcctgagtcggcacgtcagtgttcggacctccgtagtgacccagcaactgctatccgagccatccccaaaagcccccagggccagaccctgccgagtcagcactgccgacaggtctgttaggaaaggcatcatggcctatagcctggaggacttattgctgaagggctccttccccctcggtccattgcaacatgcagggcaccgtccaagaacagcgtggcacctactcctgcctgctgccgcccctcgctgttacggtggaagagccgctccccaagggcagggcttaatcccgtatcccgacctgagcgaagataccgctgtcaaagcacaggtcttgggatcgtttccccagtag

SEQ ID NO: 24905 - DNA, 495 bp, Artificial Sequence
  Description of Artificial Sequence: Synthetic coding sequence
atgctcgcagacaagcctttcttccttgtccttgaggaggatgggactactgtagagaccgaagaatactttcaagctttggcgggcgacaccgtcttcatggtgcttcagaaagggcagaagtggcagcccccctccgagcaaggcacgcgacaccccttgtcactcagccacaaacccgcaaagaagatagacgtcgcacgagtgacttttgatctgtacaagctgaatccacaagacttcatcggatgcctaaatgtgaaagctaccttctacgatacttactcattgtcctacgacttacactgctgcggcgccaagcgaatcatgaaggaggcgtttaggtgggcactcttcagcatgcaggcaactggtcatgtgctcttgggcaccagctgctacttacagcagttgctggatgcaaccgaagaaggacagcctcccaaaggaaaggcgagttctctgatccctacatgcctgaagatcttacagtag

SEQ ID NO: 24906 - DNA, 495 bp, Artificial Sequence
  Description of Artificial Sequence: Synthetic coding sequence
atgcttgccgacaagcccttctttttagtgcttgaggaagatgggacaacagtggagaccgaagaatacttccaggcattagctggcgatacagtgttcatggtgctgcagaaaggccagaaatggcagcctccctctgagcagggcactaggcacccattaagcctcagccataagcccgcaaagaagatcgatgtggcgcgggtgacgttcgacctgtataagcttaacccacaggacttcattgggtgtctaaatgtaaaggctaccttttatgacacttattccttgtcctacgacctgcattgttgcggggcaaaacgtatcatgaaagaggcctttcgctgggccctattcagcatgcaagccactggacatgtcctcctgggaacttcatgttacctgcagcagcttctggacgccacagaggaaggccagcctccaaaagggaaggcttcatcattgattcctacctgcctgaaaattcttcaatag

SEQ ID NO: 24907 - DNA, 747 bp, Artificial Sequence
  Description of Artificial Sequence: Synthetic coding sequence
atggagtacgctatgaagtctctttccttactctatccaaagtccctctctcgtcacgtatccgtgcggacctcggtggtaacccagcagctgttgagcgaacctagccctaaggctccacgcgcccggccatgccgcgttagcacagcagaccggtcagtgagaaagggaatcatggcctacagcctagaggacctcttgctcaaaactaggaatcccgaagcccggagtcaggaagtaagagatacattgatgctggcagacaagcctttctttttggttctcgaagaagacggaaccacagttgaaacagaggaatattttcaggccctagctggggacactgtgtttatggtgttgcagaaaggacaaaagtggcagcccccaagtgagcaaggtacccgacaccctctctccctatctcataagcctgcaaagaagatagacgtggccagagttacttttgatttgtacaaattgaacccgcaggacttcattggatgtcttaatgtaaaggccactttctacgacacctattctctgagctacgacctccactgttgcggggcgaagcggatcatgaaggaagccttcaggtgggctctattctccatgcaagccaccggccatgttttgcttggaaccagctgctatctccagcagctactcgacgccactgaggaaggacaaccgcccaaggggaaggcttcatcactgattccaacttgtctgaaaatactccagtag

SEQ ID NO: 24908 - DNA, 987 bp, Artificial Sequence
  Description of Artificial Sequence: Synthetic coding sequence
atggcaaactcagccagcccagagcagaatcagaaccactgctcggccattaacaactcgatcccgttaatgcagggcaacctgccaaccttaaccctgtcgggcaagatacgagttactgtcacctttttcttattcctcttgtcagccacatttaacgcctcattcctcctaaaactgcagaagtggacccagaaaaaagagaagggcaagaagctatctcggatgaaactcttacttaagcatctcacactggctaatttactggaaacactcatcgttatgcccctggatggaatgtggaacatcacagtgcagtggtatgctggggaactcttgtgcaaggtgttgtcttatctgaagctgttctccatgtatgccccagcgttcatgatggtggtcatctcattggataggagtctggcgattacgcggcctcttgctctgaaatctaacagcaaagtcggtcaatccatggtcgggctcgcgtggatcctcagctcagtgttcgccgggccccagctttacatttttcgcatgattcaccttgccgactccagtgggcagacgaaagtgttttcccaatgtgttacacactgctcatttagtcaatggtggcatcaggccttttacaatttttttacattcagctgcctttttatcatccccctgttcattatgctgatctgcaacgccaagattatatttactctaaccagggttttgcaccaagatccacatgagctgcagctgaatcaatcaaagaacaacattccacgggccagactcaagaccttgaagatgaccgtggccttcgcaacttctttcactgtctgctggacaccgtactatgttttgggtatttggtattggtttgaccctgagatgctcaatagactgtctgatccagtaaaccatttcttcttcctcttcgcctttcttaacccatgttttgaccctctcatctatggctattttagcctttag

SEQ ID NO: 24909 - DNA, 504 bp, Artificial Sequence
  Description of Artificial Sequence: Synthetic coding sequence
atgagtctggcgctccgttcggaactggtggtagataaaactaagagaaagaaaagacgggaactgtcagaggagcagaagcaggagataaaagatgctttcgagcttttcgacaccgataaagatgaagcaatcgattaccacgaactcaaggtcgccatgcgagctttgggctttgatgttaaaaaggctgatgtcctaaagatactgaaggattatgatcgcgaagccaccggaaagatcacattcgaagacttcaatgaggtagtgaccgactggatcctagaacgcgatccacacgaggagatcctgaaagctttcaagctgttcgatgatgacgactctggcaagatctctctgcgaaacttgcgacgggtagcacgagaactgggcgagaatatgtctgatgaagagctgcgggccatgatcgaggagttcgataaagacggtgatggcgaaatcaatcaggaggagtttatcgccattatgaccggggacatttag

SEQ ID NO: 24910 - DNA, 789 bp, Artificial Sequence
  Description of Artificial Sequence: Synthetic coding sequence
atggcagtgacagcccaggcagctaggcggaaagaaagagtgctgtgcctgttcgatgttgatggtactttgactccagcacgtcagaagatcgatccagaggtggccgcatttctgcagaaattgagatcacgggttcagatcggagttgtgggcgggtctgactactgtaagattgccgaacagctgggggatggggacgaggtgatagagaaatttgactacgtcttcgccgagaatgggactgttcagtataagcatgggcgcctgctcagcaagcaaaccatccagaatcacctgggagaagaacttctccaagatctcattaacttttgcttatcctacatggctttgctgagattgccaaaaaaacgtggcacctttattgagtttcgcaatgggatgcttaatatatcacctatcgggagatcttgtacactggaagaacggatagagttctcggaacttgacaaaaaggagaaaattagagaaaagttcgtggaagcccttaagaccgagttcgccgggaaagggctcaggtttagcaggggaggtatgatctcgtttgacgtgttccctgaaggatgggacaaacgctattgcctagactcccttgatcaggactcattcgacacaatacacttttttggcaatgaaacatctccaggcgggaacgactttgaaatctttgcagaccctagaaccgttggccacagcgtcgttagtccccaggacaccgtgcagaggtgtagggagatctttttccctgaaaccgctcacgaagcatag

SEQ ID NO: 24911 - DNA, 1020 bp, Artificial Sequence
  Description of Artificial Sequence: Synthetic coding sequence
atgttttctgaggtgctgcatgggctgattggacgcacccagcggtcagccggcgtggatcagaatcacccacgggcagttttagtgccaagctctctccgcatcgggatcattcctgccggcagtacagattgtgtctgctactcaacagtgggaacctcagatgccgagaccagcgctctccatatagtggtgggagacagcctagcaatggacgtgtcgtccgtgcaccataactcaaccctgctgcgttattcagtctccctgctgggatatggcttttatggcgacattatcaaggacagcgaaaagaagcggtggctaggcctagcacgctacgatttcagcgggctgaaaacctttctttcgcaccactgttatgaaggaacagtatcattccttccagcccagcacaccgttgggagcccccgtgaccgcaagccatgccgtgccggatgcttcgtttgtcgccagagtaagcaacagttagaggaggagcagaaaaaagctctgtacggcttggaggccgccgaggacgtagaggagtggcaagtcgtttgtgggaaatttctcgccattaatgccactaatatgtcttgcgcctgtcgcaggtcaccccgcgggctgtcccctgctgcccatctaggggatggctccagtgatcttattctcatcagaaaatgctcccgctttaacttcttaagatttctgatcaggcatacgaaccagcaagatcagttcgatttcactttcgtggaagtgtacagggtgaagaagtttcagttcacgagcaaacacatggaagatgaggattccgacctgaaagagggtggaaagaagagattcgggcatatctgttctagtcaccccagttgctgctgtacagtctccaatagtagttggaattgcgacggcgaggtgctacacagtcccgccatagaagtgagagtccactgccagcttgtgcggttgtttgctagaggcatagaggagaaccccaagccagactctcacagttag

SEQ ID NO: 24912 - DNA, 1053 bp, Artificial Sequence
  Description of Artificial Sequence: Synthetic coding sequence
atggccgccgcgggtcctgctgcaggtccaacaggcccggagccaatgccatcctacgcccaacttgtgcagagaggctggggttcagcactggccgccgcaaggggctgcaccgactgcgggtgggggctagctcgcaggggactcgctgaacacgcccacctagctccaccagaattacttctcctggctctgggggccctgggctggaccgccttaaggtccgcggccaccgcacggttatttcgccctctcgccaagcgctgttgccttcagcctagagatgcggccaagatgcccgagtcagcttggaagtttctgttttatctcggatcttggtcttatagtgcatacctgttgtttggtacagactatccgttcttccatgaccccccaagcgtgttttatgactggacccctgggatggccgtcccaagagatattgcagccgcttacctgcttcagggcagcttctacggccattctatctatgctactctgtatatggacacctggcgcaaggactccgtggtcatgctgctgcatcacgtggtgaccctcattttaattgtgagctcatatgccttccgctatcacaacgtgggcattctagtgctgttcctgcatgacatcagcgacgtgcagctcgaattcaccaagctgaacatatactttaaatcacggggagggagttaccatcggctgcatgccctggctgccgaccttggctgcctgtcctttggttttagctggttctggtttaggctgtactggttcccccttaaagtgttgtatgccacaagccactgtagcttgaggacagtgcccgacataccattctacttcttttttaatgcactgctgctcttgctgaccctcatgaacttgtactggtttctatacattgttgccttcgccgcgaaagtcctcacaggccaagtgcatgagttaaaggatctaagggagtacgacaccgctgaggctcaaagtctcaagccatccaaggctgagaaacccctaagaaatggtctggtgaaagacaaaaggttctag

SEQ ID NO: 24913 - DNA, 1014 bp, Artificial Sequence
  Description of Artificial Sequence: Synthetic coding sequence
atggccgcggcgggacccgccgcaggccccacaggacccgagcccatgccctcctatgcccaattggtacagcgtgggtggggatcagcattggctgccgctagagggtgcaccgactgtggctggggtctggcccggcggggactcgccgagcatgcgcatcttgcacctccagagcttttactgctcgcgctgggggctcttggctggactgctctcaggtccgctgccaccgcacgtctgttcaggcccctcgctaaacgctgttgtctccagccccgggatgccgctaagatgcctgaaagcgcctggaaattcctcttttatttgggatcctggtcttactcagcatacttgctttttgggacagactaccctttctttcacgatccgcctagcgttttttacgactggactcctgggatggctgttcccagagacatagccgccgcatatctcttgcagggatctttctacggtcactcgatttacgccactttatacatggacacctggcgaaaggacagtgtcgtgatgctgttgcaccacgttgtaacacttattcttatagtgtcctcctacgcatttcgttatcacaacgtcgggatcctggtgctgttcctgcacgacattagtgacgtgcaactcgagttcactaagcttaatatctattttaaaagcagaggcggatcctaccacaggttgcatgctctcgcggccgatctgggatgtctgagcttcgggttcagttggttctggttccgactttattggttccccctgaaggtcctatatgccacctcacattgcagtctgcgcactgtgcccgatattcccttttacttctttttcaacgccctgttattgctcctgacgttgatgaatctgtactggtttctgtacatcgtggcattcgcagccaaggtccttaccggtcaggtgcacgagctgaaagatctgcgagaatatgataccgccgaggcacagagtttaaagccatctaaagccgaatag

SEQ ID NO: 24914 - DNA, 720 bp, Artificial Sequence
  Description of Artificial Sequence: Synthetic coding sequence
atgccggaatcagcctggaagtttctgttctatttgggctcctggtcttacagtgcttacttactgttcggcacagattatccgttttttcacgaccccccatctgttttctacgactggacaccgggaatggctgtgcccagagacattgccgccgcctacctcttacaagggagcttctatggccacagcatatacgcaactctgtatatggatacatggagaaaagacagtgtggtgatgttactgcatcacgtggtgactctgattttgatcgtgtctagctatgcttttcgataccataatgtcggtatcctggttctatttctgcacgacattagtgacgtccaactagagtttacgaaactaaacatctacttcaaatccagggggggaagttaccaccgcctgcatgccctggcggccgacctcggttgcttgtcatttggattctcctggttctggttccggctatactggttccccctgaaggtcttatacgctacctcccattgctctctgaggaccgtgcctgacatccccttttacttcttctttaatgccctcctcctgttattaacactgatgaacttgtactggtttctgtacatcgtggcctttgccgccaaagtacttacaggccaggtgcatgaattgaaagacctgagagagtacgataccgccgaagcgcagtctctgaaaccttctaaggcggagtag

SEQ ID NO: 24915 - DNA, 1143 bp, Artificial Sequence
  Description of Artificial Sequence: Synthetic coding sequence
atgctccaaacattgtatgactacttttggtgggagcgcttatggctgccagtgaacctcacgtgggcagacctcgaggaccgggacggcagggtttatgccaaggcttcagacctgtacattacacttcctttggccctcttgttcctgattgtacgctacttctttgaactgtacgtggcgacgccactagcagccctcctcaacatcaaggagaagacaaggctgagggccccccctaacgcaacactggagcatttctatctgacttccggcaagcagcccaaacaggttgaggtggagctcctgagtcggcagtctggattatcagggcggcaagtggagaggtggtttcggcgacggagaaatcaggacaggccttcgctgctgaagaagttccgcgaagcctcctggagatttacattttatctgattgcattcatcgcagggatggcggttattgttgacaagccttggttttacgatatgaagaaagtttgggaaggttacccaatacagtccacaattcctagtcagtactggtactacatgatcgagctgtcattttattggtcactattgttctctattgccagcgacgtcaaacggaaggacttcaaggagcagattattcatcatgtcgctacaatcatccttattagctttagctggtttgcaaattacatccgcgctggaacgctgattatggcccttcatgacagttccgactatcttctagaatccgccaagatgttcaattacgcaggttggaagaacacctgcaacaacattttcatcgtctttgccatcgtgttcatcattacacgtctagttatacttccattttggatactgcactgcacgctcgtctatccactggaactgtaccccgcattctttggctattattttttcaatagcatgatgggcgtcctccaactcctccatattttctgggcctatttgattttgcgcatggcccacaagtttattacaggcaagctggtggaggacgagcggtcagaccgggaagaaaccgagtcctccgagggtgaggaagccgctgccggcggcggggcaaagagtcgtccgttggcaaatggccaccccattctgaataacaatcaccggaaaaatgattag

SEQ ID NO: 24916 - DNA, 693 bp, Artificial Sequence
  Description of Artificial Sequence: Synthetic coding sequence
atggcggtgattgtcgataagccatggttttacgatatgaaaaaagtctgggaagggtatccaatccaaagtactatcccttcccagtactggtattacatgatcgaactatccttctattggtctctgttgttcagtattgccagcgacgttaaacgtaaggactttaaggagcaaataatccaccacgtcgccacgataattctgatttccttctcatggtttgccaactacatcagggctgggactcttatcatggctctgcatgactccagcgattacctccttgagtctgccaagatgtttaactacgccggttggaaaaatacctgcaataacatcttcatagtgtttgctatcgtgttcatcataacccggttggtcattctgcctttctggatccttcattgcacactggtatatccacttgaattgtaccctgcattctttgggtattacttcttcaattctatgatgggagtgcttcagctccttcatatcttctgggcctatctgatattgaggatggcacataagtttatcactggcaagctggtggaggacgagagaagcgatcgtgaggagactgaaagcagtgagggcgaagaggcagccgccggaggcggcgctaaaagccggcccctcgccaatggtcatccgatcttaaataataatcatcgtaaaaatgattag

SEQ ID NO: 24917 - DNA, 750 bp, Artificial Sequence
  Description of Artificial Sequence: Synthetic coding sequence
atgcttcaaaccctttacgactacttctggtgggaaagactgtggctgcccgtgaacctgacgtgggcagatttggaggacagagacggacgcgtgtatgctaaagccagtgacctctatataaccctacccctggcactcttgtttctgattgtgcggtacttcttcgaactgtacgttgctactcctctggccgcccttctgaacatcaaagaaaaaaccaggctgagggctccgccaaacgccaccctcgaacatttttaccttacttcgggaaaacagccaaaacaggtagaagtggagttattgtctcgtcaatctggactttcgggtcgacaggtagaacgttggttcagaaggcgacgaaaccaggatcggcccagcctgctgaaaaagtttagggaggccagctggcgattcaccttctacttgattgctttcattgccggcatggcggtgattgtggacaagccttggttttacgatatgaagaaagtgtgggaggggtacccaattcagtctaccatccctagccaatattggtactatatgatcgaactgtctttctactggtctctgcttttctcaatcgcctccgatgttaagcggaaagattttaaagagcagatcattcatcatgtggcgactatcattctcatctctttctcctggtttgctaactacatcagagccggaaccttaatcatggccctgcatgatagctccgactatttactggaagttagatag

SEQ ID NO: 24918 - DNA, 975 bp, Artificial Sequence
  Description of Artificial Sequence: Synthetic coding sequence
atggtgcctcttgcattgcatttcccaggcgaagtggggttgcaggagaccgcggttaggatgctccagacactgtatgattatttctggtgggaacggctgtggttgccggtcaacctcacttgggcagatctcgaggacagagacggtcgcgtgtacgccaaggcctccgatctctacattacacttccactggcattgcttttcctgatcgtgagatacttctttgaactgtacgtcgccacaccgctcgctgctcttctgaatattaaggaaaaaacacgtttgcgggccccaccgaacgccaccctggaacatttttacctgactagtggaaagcagcctaagcaggtggaggttgagctgctgagtaggcagagcggccttagtggaaggcaagtcgagaggtggttccgccgcaggagaaatcaagatcgcccctctttgttgaaaaaattcagggaggcaagctggagattcactttctatttaattgctttcattgctgggatggccgtgatagtagacaaaccttggttttacgacatgaagaaggtctgggagggctacccaattcagtccactattccaagtcaatattggtattacatgatagaattgagcttttattggagcctcctgttctctatcgctagcgacgtcaaacggaaagactttaaagaacaaatcatccaccacgtcgccactataatactgatctctttcagctggtttgcaaactatattcgggctggaacccttattatggcccttcatgactcatctgactacctgctggaatcagcaaaaatgttcaactacgcagggtggaagaacacatgtaataacatctttatcgtctttgccattgtgttcatcatcacaaggcttgtaatattaccattctggatccttcactgcactttagtctatccactcgagttgtaccccgcttttttcgggtattatttttag

SEQ ID NO: 24919 - DNA, 1143 bp, Artificial Sequence
  Description of Artificial Sequence: Synthetic coding sequence
atgctgcagaccctgtacgactacttctggtgggaacgactgtggttgcccgtgaacctcacttgggctgatttagaagatagagacgggcgggtgtacgctaaggcctccgacctttatatcacattgcctcttgccctcctgtttttgattgtgagatattttttcgagctgtatgtggctacaccactcgcagccctgttaaatatcaaagagaaaaccaggctgcgcgctcctcccaacgctaccttggagcatttttatttgacatccggcaagcaacccaaacaggtggaggtggaactgctgtcacggcagtcgggtctatccggacgacaagttgagcgctggttccggaggcgaaggaatcaggacaggccatcattgctaaaaaagttcagagaggcatcatggcggttcaccttctacttgatcgcttttatcgctgggatggcggtcatcgtggataaaccgtggttttacgacatgaaaaaggtttgggagggatatcctatccagtccaccatacccagccagtattggtattacatgattgaactgtcattttactggtccctgttgttctctattgctagcgatgttaaacggaaggattttaaagagcaaatcatacaccatgtggctacaataatcttgattagcttctcttggtttgcaaactatatccgcgcaggtaccctcattatggctttacatgattcttctgactacctcctagagtcagccaagatgtttaattacgctggctggaaaaacacatgcaataatatatttatcgtctttgccatcgtattcatcattactcgccttgtcattctgcccttctggattctgcattgcacactggtgtaccctctggagctatacccagcctttttcggttattatttttttaacagtatgatgggtgtgctgcaactccttcatattttttgggcctacctcatcctgcggatggcgcacaaatttatcactggcaagctcgtggaggatgagcggagcgacagagaggagacagaatcctcagaaggcgaagaggccgcggcaggcgggggtgccaagagcaggcccctcgcaaacggacatccaatcctgaacaacaaccatcgcaaaaatgactag

SEQ ID NO: 24920 - DNA, 579 bp, Artificial Sequence
  Description of Artificial Sequence: Synthetic coding sequence
atgcttcagactctatacgactatttttggtgggagaggctctggttgcccgtcaacctcacctgggccgatctggaggacagagatggtcgcgtatacgcaaaagcctctgatctgtatatcacactccccctggccctgctgtttctaatcgttcgttacttctttgagctctacgtggcaactccactcgctgccctgctcaatataaaagaaaaaacacggcttcgggctcctcctaatgcgacgctcgagcacttttatcttaccagcggcaagcagcccaaacaggtggaagtcgaactgctatcaaggcaatctggactgtccggtagacaggttgagcggtggttcagacgtaggcgaaatcaggatcgaccttccctcctaaagaaatttagggaggcctcctggaggttcactttttacctgattgcatttatcgccggcatggccgtaatcgtcgataagccttggttctacgacatgaaaaaggtgtgggagggctacccaatccaatccacaattccttcacagtactggtactatatgatcgagctgagcttctactggtcctag

SEQ ID NO: 24921 - DNA, 390 bp, Artificial Sequence
  Description of Artificial Sequence: Synthetic coding sequence
atgctccagaccctctatgactacttctggtgggagaggctttggctgcccgtgaacctcacatgggcagacttggaggacagggacggacgagtctacgccaaggcatctgatctttacatcacactccccttggcactgctgtttctcattgtgcggtattttttcgaattgtatgtcgcgaccccccttgctgcactccttaatattaaggagaagactcgtcttagggcaccgcctaatgccactctcgagcatttttatctcacatccggcaaacagccaaagcaggtggaagtggagctgctgagccgacagtccggtttatctggccgccaagtcgagcgatggttcaggcggcgaaggaatcaagaccggcccagcctttag

SEQ ID NO: 24922 - DNA, 672 bp, Artificial Sequence
  Description of Artificial Sequence: Synthetic coding sequence
atgctgcagaccctctatgactatttctggtgggagcggctgtggttgcctgtcaaccttacatgggccgacctcgaggacagagacggtagggtctatgccaaagcttccgatctgtatatcacactgccgctcgctcttctgttcctcatagtcagatatttcttcgagctgtacgtagctactccactggccgctctgctcaacataaaggaaaagactaggctgcgggctccccctaacgccaccctggaacatttctacctgactagcgggaagcagccaaaacaggttgaggtggagctgctgagtcggcagagcgggctgagtgggcgccaggttgagaggtggttccgccggagaaggaatcaggaccgcccgtcactcttgaagaagttcagggaggcttcttggaggtttacattttacttgatcgccttcatcgcagggatggcggtcattgtggacaagccctggttttacgacatgaagaaggtttgggaagggtatcccattcagtcaacgatcccatctcagtactggtactatatgatcgagctgtctttttactggtcactgctttttagcatcgcgagtgatgtcaaaaggaaggatttcaaggagcagattattcaccacgtcgccaccatcatcctgattagcttctcctag

SEQ ID NO: 24923 - DNA, 1152 bp, Artificial Sequence
  Description of Artificial Sequence: Synthetic coding sequence
atgttctggacctttaaggaatggttctggctggagagattttggctgcccccaaccattaaatggtccgatctggaagaccatgacggcctggtcttcgtgaaaccatcccacctgtacgtgaccatcccttatgcttttcttctgctgatcattcggagggtgttcgagaaatttgtcgcaagcccattggctaaatcatttgggattaaggaaacagtgcgcaaggtaacccctaataccgttttggagaattttttcaagcacagcacgcgccagcccttacaaacagacatatacggcctcgcaaagaaatgcaatctgactgagcgccaagtggaacgttggtttcgcagccgccgaaaccaagaaaggccatccagactaaagaaattccaggaggcttgttggcgatttgctttctatttgatgataaccgtggccgggattgccttcctgtacgataagccatggctttatgatctctgggaggtttggaacggctatccgaaacagccgctcctaccatctcagtattggtactatatactcgagatgtccttttattggagtcttctcttcaggctcggcttcgacgtcaaacgcaaggatttcttagcgcacattatccaccacttggccgctataagcctcatgtcttttagctggtgtgcgaactatatacggtccggaacattggtgatgatagtgcacgatgtcgcagacatttggctggagtctgctaagatgttcagctacgcagggtggacacagacctgtaataccttattcttcatcttctcgactatcttttttattagtcgactgattgtcttcccgttctggattctttactgcactctcattttgccaatgtatcacctggagccgttctttagctacatctttctgaatctgcagttgatgatcctccaggtgctacacctgtactggggctactatatcttgaaaatgctgaataggtgcatttttatgaagagcattcaagacgtgcgcagtgacgatgaggactatgaagaggaagaagaagaggaggaagaagaggccacgaagggcaaggagatggattgtcttaaaaatggcctgcgcgcggagaggcacctgatcccaaatggccagcacggacattag

SEQ ID NO: 24924 - DNA, 1152 bp, Artificial Sequence
  Description of Artificial Sequence: Synthetic coding sequence
atgttctggacatttaaggagtggttctggctggaacgcttctggttgcccccaacaattaagtggtcagacctggaagatcacgatggtttggtgtttgtcaagcccagccacctctacgtaacaattccctacgcctttcttcttctgatcattcggagagtgtttgagaaatttgtggcttcaccactcgccaaatccttcggcatcaaagagaccgttagaaaggttacccctaatactgtactggaaaatttctttaaacacagtaccaggcagcccctgcaaaccgacatatatggtctggcaaaaaagtgcaatctgaccgaacggcaggtggaaagatggttccgctcccgtaggaatcaggagaggccttcccgtttgaaaaaattccaggaagcatgctggcgctttgctttctatctgatgatcacggtagctggaatcgcatttctatacgacaagccctggttgtatgatctctgggaggtatggaacggatatcccaagcaaccccttctgccgtcacagtattggtattatatcctggagatgagcttctactggagcttgcttttcaggctcggcttcgatgtgaagcggaaagactttctggcacacattatacatcacctggctgctatctcgctgatgtctttctcatggtgcgctaactatattagatcagggacacttgtgatgatagtccacgatgtggccgacatatggctcgaaagcgccaagatgttttcttacgcaggctggacccagacctgcaacacactgttttttattttttcaactatcttcttcatttccaggctcatcgttttccccttttggattctgtattgcactctgattctgccgatgtatcacctggagccattcttttcctacattttcctgaatttgcagttaatgatactgcaggtgctccacctgtactgggggtactatatcctcaagatgttgaacagatgcatcttcatgaaaagcatccaagacgtgcgttccgatgacgaagactatgaagaggaggaggaggaggaggaggaggaggcgacgaagggtaaggaaatggactgcctgaaaaacggactgcgggcagagagacaccttattcccaatggtcagcacggccattag

SEQ ID NO: 24925 - DNA, 1152 bp, Artificial Sequence
  Description of Artificial Sequence: Synthetic coding sequence
atgttctggacttttaaagagtggttctggctggaaagattctggctcccgcccaccattaaatggtcggatctagaagatcacgatggcctagtgttcgtaaaaccgagccatctgtacgtgaccatcccttacgctttcttgctgctgattatcaggagagtgttcgagaagtttgtggcaagccctctggctaaatcatttggcataaaggaaacagtgaggaaggtgacgccaaatacagtgttggaaaacttcttcaagcacagcacccggcaacctctgcagactgacatctacggattggctaaaaagtgcaacttaaccgaacggcaggtagaacggtggtttcggagcagaaggaatcaagagcggcctagcaggttaaagaagtttcaagaggcctgctggcgcttcgcattctatcttatgatcacagtggcagggatcgccttcctgtacgataaaccatggttgtacgatctgtgggaggtctggaatggatacccaaagcaacctctcctgccctcccagtactggtattatattctcgaaatgagcttctactggtccctcctgttcagactgggattcgatgttaagcggaaggattttctcgcccacatcattcatcatctggccgccatctctttgatgagcttctcttggtgtgccaactatattaggagtggcacactggtgatgatcgtccatgatgtggcagatatctggttggagtcagctaagatgttttcatacgccggttggacccaaacgtgtaacaccctctttttcatcttcagcactatcttcttcattagtcgcctgattgtgtttcccttttggatcctctattgcacactgattttacctatgtatcatttggagcctttcttttcatatatctttctgaacctgcagctgatgatcctccaggtcctgcacctctactgggggtattacattctgaaaatgcttaatagatgtattttcatgaagagtatccaggatgtgaggagcgatgacgaggattacgaggaagaggaggaagaagaagaagaagaggctaccaaggggaaagagatggactgtctaaaaaatggcctgagggctgaacgccatctgattcctaacgggcagcacggacactag

SEQ ID NO: 24926 - DNA, 468 bp, Artificial Sequence
  Description of Artificial Sequence: Synthetic coding sequence
atgttctggacctttaaggaatggttctggctggagcgcttttggctaccacccaccattaagtggtccgatcttgaagaccatgatgggctcgtattcgttaagccatcacacttgtatgttacaatcccctatgccttcctgctgctcataattcgacgggtgttcgagaagtttgttgcatcccccttggcaaagagctttggcataaaagagactgtgagaaaggtcacgccgaacactgtccttgagaacttcttcaagcactcaacccgtcagcccctccaaactgacatatacgggctggctaaaaaatgcaatctgactgagaggcaggtggaacggtggttccgatcgagacgtaaccaggagcggcctagccgtttaaaaaagtttcaggaagcctgctggcggttcgctttttacttgatgattaccgtggccggaatagcctttttatacgactag

SEQ ID NO: 24927 - DNA, 48 bp, Artificial Sequence
  Description of Artificial Sequence: Synthetic coding sequence
atgttttggaccttcaaggaatggttctggctggaacgattttggtag

SEQ ID NO: 24928 - DNA, 174 bp, Artificial Sequence
  Description of Artificial Sequence: Synthetic coding sequence
atgttctggaccttcaaggagtggttttggttggaacgcttctggttgcctccaaccatcaagtggtccgacctggaggaccatgatggactggtattcgtcaagccctcccatctttacgtgaccatcccctatgcattcctccttctaatcattagacgggtgtttgagtag

SEQ ID NO: 24929 - DNA, 1185 bp, Artificial Sequence
  Description of Artificial Sequence: Synthetic coding sequence
atgctgagcagcttcaacgagtggttttggcaggacagattttggttgccacccaatgtgacatggactgaactcgaagacagggacggtagggtctatccacacccccaggatctcctcgccgctctgccgttggctctggtgctgttggcgatgcgactcgcctttgagagattcatagggctgcccttatcacggtggctgggcgtcagggatcagactcgcagacaggtgaagcccaatgccacactggagaaacatttcctcaccgagggacatagacccaaggaacctcagctgagtctcttggccgcccagtgcgggttgacactgcaacagacccagcggtggttccggaggcgcaggaaccaggatcgcccccagttgacgaaaaagttttgtgaagccagttggaggttcctgttttacctttcttcttttgtaggaggcttgtctgtgctgtaccacgagtcgtggttgtgggcgccggtcatgtgctgggatcgatacccaaatcagaccctgaagccttctctgtactggtggtatctgctggaactcgggttttacctcagtctgctgatacggctgccgtttgatgtgaaacggaaggactttaaggagcaggtcattcatcattttgttgccgttatactgatgaccttttcctattctgctaatcttctgaggatcggctctttggtgctgcttcttcatgattcgtcagactaccttctggaggcctgtaaaatggtcaattatatgcagtaccagcaagtgtgtgacgctctgttcttaatcttctcatttgtgtttttttatacccgcctggtactgttccccactcagatactgtatactacttattacgagtccataagcaacagaggaccgttcttcggctactatttctttaatggactcctcatgctgttgcagctcctgcacgtgttttggtcttgcttgatcctgagaatgctgtactcgttcatgaagaaaggacagatggagaaggatattcgctccgacgtggaggagtccgacagtagtgaggaggctgccgcagcacaagagcctctccagctgaaaaatggcgccgctggtggtcctagacctgccccaacagatggcccaagatctagagtcgctgggagattgacaaatcggcatacaaccgccacatag

SEQ ID NO: 24930 - DNA, 342 bp, Artificial Sequence
  Description of Artificial Sequence: Synthetic coding sequence
atgctgtctagtttcaacgaatggttttggcaagacaggttctggctaccccccaacgtaacatggaccgagttagaagaccgcgatggacgcgtttatccacacccacaggatctgttagcggccctcccgctggcacttgtgctgctggcaatgcgactggcatttgaacgctttatcggcctccctctgtccagatggcttggggtcagagatcagacccgccgccaggtaaaacctaacgcgacattggagaagcacttcctgacagaaggccataggccgaaagaaccccagcttagcctgctagccgcccaatgtggcctgacactgcaacagtag

SEQ ID NO: 24931 - DNA, 579 bp, Artificial Sequence
  Description of Artificial Sequence: Synthetic coding sequence
atgctgtcgagttttaacgagtggttttggcaggatagattttggctgccgcccaacgtgacatggaccgagctggaggatcgagacggcagagtgtatccccaccctcaggatcttctcgccgcccttcctttagcgctggtgctcctggccatgcgcctcgccttcgaaaggttcatcggtctccctcttagtcgatggttaggcgtgcgggaccaaactcgaaggcaagtgaagcccaatgctaccttagagaagcattttttgacggagggacaccggcccaaagagccacaacttagcctgttggcagcacaatgcgggctcacccttcagcagacacagcggtggttcagacggcggcggaaccaggatcgccctcaactaactaaaaaattttgtgaggcaagctggcggttcctcttttatctctcctcatttgtgggtggactgagcgtgctctaccacgagagctggctgtgggcacctgtgatgtgttgggatagatacccaaaccagactctaaaaccctctttgtattggtggtatcttctggaactcggtttctatctatcttag

SEQ ID NO: 24932 - DNA, 1185 bp, Artificial Sequence
  Description of Artificial Sequence: Synthetic coding sequence
atgctctcatcatttaatgaatggttttggcaggatagattttggcttcctccgaatgtgacctggacagaattggaggatcgcgatgggagagtatatcctcacccacaagacctgctagccgcactgcctctggccctcgtcctcctggccatgagactcgcgtttgagcgattcatcggacttccactgtcaaggtggctgggcgtccgcgaccaaactcgcaggcaggtgaaacctaacgctacgcttgaaaagcatttcctgaccgagggccatcgcccgaaggaacctcagctgtctcttttagcagctcagtgcgggctgacactccagcaaacgcagcgctggtttagaaggcggagaaaccaggaccgtccccagttgaccaaaaagttttgtgaggcgagttggagatttctattctacctctcttcatttgtaggtggcctttccgtactctaccatgaatcatggctctgggccccagtcatgtgctgggataggtatcccaaccagactctgaaaccctcattatattggtggtacctgctcgagcttggattctacttgtcattgctaatacgtctgccttttgatgtcaaacgcaaggatttcaaggagcaggtgattcaccactttgtcgccgttatcctgatgacattcagctacagcgctaatctgttgcgtattgggtcactcgtgctgctgctgcatgacagttccgactatctactggaggcctgcaagatggtgaactacatgcagtatcaacaggtgtgcgacgccttgtttttaattttttcatttgtgttcttttatacgcgcctggtcttatttccaacccagatcctgtatacgacgtattatgagtctatatccaatagagggccgttcttcggctactatttttttaacgggctgttaatgctgctgcagttactgcatgtcttttggtcctgcctaatcctgaggatgctgtacagttttatgaaaaagggtcaaatggaaaaggacatccgctccgatgtggaggagtcagacagttccgaggaggccgcagccgctcaagagccattacagctgaagaatggggctgctgggggtcccaggcctgcccccactgatggaccaaggtctcgcgtggcaggaaggctgaccaacagacatacaaccgccacatag

SEQ ID NO: 24933 - DNA, 99 bp, Artificial Sequence
  Description of Artificial Sequence: Synthetic coding sequence
atgctcagtagcttcaacgaatggttctggcaggaccggttctggctgccccccaacgtgacatggaccgagctcgaagatcgggatggcagggtctag

SEQ ID NO: 24934 - DNA, 279 bp, Artificial Sequence
  Description of Artificial Sequence: Synthetic coding sequence
atgctctcatcctttaacgagtggttttggcaggatagattttggcttccccctaacgttacgtggaccgagctggaagatagagatggacgagtatatcctcatccccaggacctgctggccgctctgccactagcgctagttctcctggcaatgcgcctcgcctttgaacgcttcatcgggctccccctgagtaggtggctcggagtgcgtgaccagactcgacgccaagtcaagccaaacgctacgctggaaaaacacttcttgaccgagggttag

SEQ ID NO: 24935 - DNA, 1179 bp, Artificial Sequence
  Description of Artificial Sequence: Synthetic coding sequence
atggcgaccgcggcccagggccccctgagtctgctgtggggttggttgtggtctgagaggttctggctgccagaaaatgtgagctgggctgatctggagggtcctgctgacgggtacgggtatcccagaggcaggcacatcctctccgtttttccactggcggcgggcatctttttcgtccgactgctgttcgagaggtttattgctaaaccctgcgccctgtgcattggaatcgaagacagcggcccttaccaagcacagccaaatgcaatccttgaaaaggtatttattagtatcaccaaatatcccgacaagaaacggctcgagggcctaagcaagcagttagattggaacgtccgtaagattcagtgttggttccgccacagaagaaaccaggacaaaccaccgacccttacaaagttttgcgagtcgatgtggcggttcactttctacctctgcattttttgttatgggattaggttcttatggtcttccccctggttctgggatatcaggcagtgctggcacaattatccttttcagccgctgagctcaggcctctaccactattatatcatggagttggctttctattggtcgttgatgttctcacaattcaccgacataaagaggaaggacttcttgattatgttcgtgcaccatttggtcactatcggcctcatctccttctcttacataaataacatggtgcgggtcgggacgctgatcatgtgcctacatgatgtgtctgattttctgcttgaagccgcgaaattggctaattatgctaagtaccagcgcctgtgcgacacactgtttgtgattttttctgcggtgtttatggttacccggttgggtatttaccctttttggattctcaacactaccttgttcgagtcgtgggagatcataggcccttacgccagttggtggctcctgaatgggctgctgcttaccctgcagctccttcatgtcatatggtcctacctgatcgctagaatcgccctcaaggcattgattagaggcaaagtatctaaagatgacagatccgatgttgagagcagttcagaagaggaagacgtgacgacttgtacaaagagcccttgcgacagctctagcagcaacggagctaatcgcgttaatggccacatggggggctcttattgggccgaggagtag

SEQ ID NO: 24936 - DNA, 588 bp, Artificial Sequence
  Description of Artificial Sequence: Synthetic coding sequence
atggccacagccgctcaggggccgttgtcactcctctgggggtggttgtggagcgagcggttttggttgcctgaaaacgtgtcctgggccgacctcgaggggcccgcagatggctatggatacccaagaggaagacacattctctcagtgtttcccctcgctgccggaattttttttgtgcgtcttctcttcgaacgcttcatcgcgaaaccatgcgccctgtgcatcggaattgaagattcaggcccctaccaggcccagcccaatgccattttggagaaagtgtttatttcgattaccaagtatcccgacaaaaaacgtctggagggcctgagtaagcagctggactggaatgttcgtaagattcaatgttggtttagacataggaggaaccaagataaaccaccgaccctgaccaaattctgtgagtccatccacttgggaagcggcacttcagattctgcaggaattaccattcacttttcattattccaagtcgggttcattaccatcattagctggaactggcccagcatcgggcccctgtgcttcctgtccctacagacactgaaagaacgcacttcctag

SEQ ID NO: 24937 - DNA, 1005 bp, Artificial Sequence
  Description of Artificial Sequence: Synthetic coding sequence
atgatgaaacctagaccgaaacgctttattgccaaaccctgtgctttatgtatcggcattgaagattccggcccataccaggcacagccaaacgctattctggagaaagtgttcatctcaatcaccaaatacccggacaagaaaaggctagaagggctttccaaacaactcgattggaacgtcagaaaaatccaatgctggtttcgacaccgccgcaaccaggacaagcctccaacactgaccaaattctgcgagtccatgtggagattcaccttctatttatgtatcttttgctatggcatccgattcctgtggtcttccccctggttttgggacattcgccagtgctggcacaactacccattccagcctctgagtagcggactttaccactactacattatggagctcgccttttactggtccttaatgttttcacagttcaccgatataaagagaaaagatttcctgattatgtttgtgcatcatctagtgactataggtttgatttctttttcctacattaataacatggtgagagtgggtacccttattatgtgtctccatgacgtatccgacttcctcctggaagcggcaaagcttgcaaattatgccaagtaccaacgcctgtgtgacaccttgttcgtcatatttagtgcagtgttcatggttactcgtctagggatctatcccttctggattctgaacacaactcttttcgagagttgggaaatcattgggccatatgccagttggtggctgctgaatgggctgctgttgacgctgcagctgctgcacgttatatggtcgtacttaatagctcgaattgccctgaaggctctgatacgtggtaaagtgtcaaaggacgacagatcagacgtggagtcttccagcgaggaagaagatgtgactacttgtacaaagagcccctgtgatagcagttcgagcaatggcgctaatagggtgaacggacacatgggggggagctattgggcagaagaatag

SEQ ID NO: 24938 - DNA, 588 bp, Artificial Sequence
  Description of Artificial Sequence: Synthetic coding sequence
atggccactgccgctcaaggcccactctctttgctctgggggtggctctggagcgaacggttttggctccccgaaaacgtgagttgggcagatctggagggtccagcggatgggtatggctacccaagagggaggcacatcctgagcgtttttcccctggccgccgggattttttttgttagactgctgtttgaaagatttatcgccaagccctgcgcactgtgcattgggattgaggattctggcccataccaggcgcaacctaatgctattttggaaaaggttttcatatcaatcaccaaataccccgacaagaaaaggctggagggactgtcaaagcagttggactggaatgtccggaaaatccagtgttggtttcggcacaggcgaaaccaggacaagccaccgactctcacgaagttctgtgagagcattcacctcggtagtgggactagcgattcagctggtataacaatccacttctctttgttccaagttggcttcatcactataatttcatggaactggccgtctatcggacctttatgtttcctctcactgcaaactctgaaggagaggaccagttag

SEQ ID NO: 24939 - DNA, 1155 bp, Artificial Sequence
  Description of Artificial Sequence: Synthetic coding sequence
atggcggggatcctggcttggttctggaatgagcggttttggcttccacataacgtgacctgggctgatctcaagaatacggaggaggcgacttttcctcaagccgaggacctgtacctggcctttccgctggcattttgtatctttatggtcagactgatctttgaaagatttgtagccaaaccgtgcgctattgcgctgaatatccaggccaacggtccccaaatcgcgccgccgaatgcaatactcgagaaggtgttcacagcaatcactaagcacccagacgagaaaagactagaaggcctttcgaagcagttagattgggatgttagatcgattcaaaggtggtttcgccagcggagaaaccaggagaaaccatctaccctaacacgcttctgtgagtccatgtggcgcttctcattttacttgtacgtttttacctatggagtccgatttttgaagaagaccccttggttatggaacaccaggcattgctggtacaactatccttaccaacctctaacaaccgacctgcattattactacatcctggagctctcgttctattggtctctgatgttttcacagttcactgacattaaacgcaaagacttcggtatcatgttccttcaccacctcgtaagcattttcctgattaccttcagttatgtgaacaacatggctagagttgggacgttagtgctgtgcctgcacgacagcgctgatgccttacttgaagccgccaagatggcgaactatgctaaattccagaagatgtgtgacctgctgttcgtgatgtttgccgtggtattcatcacaacacgcctgggcattttccccctgtgggtcttaaatacaaccctgtttgaatcttgggaaatcgtgggcccctatccatcatggtgggtgtttaatctcttacttcttctggtgcagggtttaaactgtttctggagttatctgattgtgaagatcgcctgtaaagcagtcagtagagggaaagtaagtaaggatgatcgttctgacatcgaatcctcctccgatgaggaggactctgagcctccagggaaaaatccacacacagccacaacaacaaatgggacaagcggcaccaacggttaccttctgaccgggagttgtagcatggatgattag

SEQ ID NO: 24940 - DNA, 1179 bp, Artificial Sequence
  Description of Artificial Sequence: Synthetic coding sequence
atggctgggatcctcgcatggttctggaacgagaggttctggctaccacataatgttacctgggcagacctgaagaacacagaagaggccacattcccccaggctgaagacctgtacctcgcatttccattagctttctgcatatttatggtacggctgattttcgagcggttcgtggcaaaaccttgcgccattgccttgaatatccaggctaacggaccgcagattgctccacccaatgcgatcctagagaaagtatttaccgcaatcactaaacatcctgacgagaagcggttagaagggctgtctaaacagcttgattgggatgtgaggagcatccaaaggtggtttaggcagcgcagaaatcaagaaaagccaagcaccctgaccaggttctgcgagtccatgtggcggttcagcttctatttatacgtttttacctatggcgtgcgcttcctgaagaagactccctggctctggaataccagacattgctggtacaactatccataccagccgctgacaaccgatctacactattattacattctggaactctcgttctattggagcttgatgttctctcagttcaccgacataaagcgcaaagatttcggaattatgttccttcatcatttagtcagcatcttcttaatcactttctcatatgtgaataatatggcccgtgtgggcacgctggttctttgtctacacgactccgctgacgccctgctggaagctgctaaaatggcaaattacgcaaaatttcagaaaatgtgtgatctgttgtttgtgatgttcgcagtggtgttcataaccacccggctaggcatttttcctctctgggtgttaaacacaaccttgtttgagagctgggaaatcgtaggcccatacccctcttggtgggtgtttaaccttcttctcttgttagtgcagggcctgaactgcttctggtcttatctgattgtgaaaatcgcctgcaaagcagtaagcagagggaaagctgggaaatggaatcctctacatgtctctaaggatgataggtcagacatcgagtcaagctctgatgaggaggattccgagccacccggaaaaaacccccacaccgccactactaccaatgggacttccgggaccaatggctatctccttacggggtcatgctctatggacgactag

SEQ ID NO: 24941 - DNA, 675 bp, Artificial Sequence
  Description of Artificial Sequence: Synthetic coding sequence
atgcaagcaccgggcaggggtccactggggctgcggcttatgatgcctgggaggcgaggagcactgagagagcctggcggctgtgggtcatgtctcggtgtggccctggcgctcctgctcctcctgctgcccgcttgttgtcccgtccgcgcccagaatgacaccgagccgatcgtgcttgagggaaagtgtcttgttgtgtgcgattctagccctagcgcagacggagcagtgacctcctctctggggatcagcgtgcggtccggcagtgctaaggtggcattttctgccaccaggtccactaatcacgagccttcagagatgtccaataggactatgacaatctattttgaccaggtcctcgtgaacattggcaaccacttcgatctggcatcctctatattcgtcgctccaagaaaaggtatctattccttcagcttccacgtcgtgaaagtgtacaaccgccagacgatccaagtcagcctgatgcagaacggctaccccgtgatcagcgccttcgcgggggaccaagatgttacccgggaggcagcctccaatggcgtccttttactaatggagcgagaggacaaagtgcatctgaagctggagagagggaatcttatggggggctggaaatactcaacattcagcgggttcctggtatttccactttag

SEQ ID NO: 24942 - DNA, 1788 bp, Artificial Sequence
  Description of Artificial Sequence: Synthetic coding sequence
atgagggccgcaagggcagcaccgctgttgcaattgttgctgctgctaggaccatggctggaggcggcaggcgttgccgagtcgcccttacccgcagtagtcttagctatcctggctaggaatgccgagcactcactgcctcactacctgggtgccctcgaaagactggattatcccagagctcgaatggccttatggtgcgcaaccgaccacaatgtagacaatactaccgagatgctccaggaatggctcgccgccgtaggagacgattacgctgcggtcgtgtggcgacccgagggtgagccccggttctatcccgacgaggaagggccaaagcattggacaaaagaacggcaccagttcctgatggagctcaaacaggaggcactgactttcgctaggaattggggcgccgattacattctgtttgccgacactgataacatcctgacgaacaaccaaacgctacgtctcctgatggggcagggacttcctgttgtggctcccatgctcgactcccagacatactactccaacttttggtgcggaataacaccacagggctattatagaaggaccgctgagtacttccccacaaaaaatagacagagacgtggctgcttcagagtgcccatggtgcactcaacttttttggcctccctgagggccgagggcgccgatcagctcgccttttatcctccccaccctaactatacatggccattcgacgatattatcgtattcgcttacgcctgtcaagctgctggtgtctccgttcacgtgtgcaatgagcaccgctatggctacatgaatgtccctgtgaaaagccaccagggactggaagatgaacgggtgaactttatacatttgattctcgaagccctcgtggatggtcctagaatgcaggcttctgctcacgtgactaggccatccaagcggccttcaaaaataggcttcgatgaagtcttcgtcatttccctggcccgccggccagatcggagggagagaatgcttgcgtcgctgtgggagatggagattagcggtcgggtggtggatgcagtggatggatggatgctgaactcctccgccatccggaatctcggagttgatctcctgccaggctaccaggacccctactcaggacgcaccctcacaaagggcgaggtcggctgttttttatcacactattcgatatgggaagaggtggtggcccgcggcctggccagggtcctggtatttgaggatgatgttcgatttgaaagcaactttcggggccggctcgaacggcttatggaggacgttgaagccgaaaaactctcttgggacctcatttacttggggcgcaaacaggtcaatccagaaaaggagactgcagtcgagggcctgcccgggctcgttgtggccggatactcctactggaccctggcctacgcattgaggctcgccggagcgcgtaagttactggccagccagcccctccggcgtatgttgcccgtcgatgagttcctgccaatcatgtttgatcaacatcccaatgagcagtataaggcccatttttggccccgggatcttgtcgccttcagcgcacagcccttacttgcagccccaacccattatgctggggatgcggaatggctcagcgacaccgagacgtcttccccctgggatgacgacagcgggcggctgatctcttggtctggttctcagaagacactgagaagtcctcgattggacctgactggctcctctggccactccctacagcctcagccgagagatgagctgtag

SEQ ID NO: 24943 - DNA, 1554 bp, Artificial Sequence
  Description of Artificial Sequence: Synthetic coding sequence
atgctgcaagaatggttagcagccgtcggcgacgactatgccgctgtggtttggcgtccagaaggcgagcctagattttatcctgatgaggagggtcccaaacattggaccaaagaaagacaccagtttttgatggagctcaagcaggaagcattgaccttcgcccgaaactggggcgccgattacatcctgtttgctgataccgacaatatcttgaccaacaaccagactctcaggttactgatgggccaagggttaccagtagtagctcccatgctagatagccagacatactactcgaacttctggtgtggtatcacaccacaggggtactacagacgcaccgccgagtacttccctaccaaaaaccgccagcggagggggtgctttagggtgccaatggttcactcaaccttcctggccagtttaagggcagaaggtgccgatcagctagccttctacccaccacaccccaactacacgtggcccttcgatgatatcatcgtgtttgcctatgcctgtcaagctgctggcgtatcagttcacgtgtgcaatgagcacagatatggatatatgaatgtgcccgtcaagagccatcagggcttggaagatgagcgcgtcaatttcatccacttaatacttgaagcacttgtggatggcccccgaatgcaggctagcgcgcacgtgacccgcccgtccaagcgtccaagcaagatcgggttcgatgaagtgttcgtgatttcacttgcccgacggcctgacaggcgcgaaaggatgttagccagtctgtgggagatggaaatcagcggacgtgttgtcgacgcagtcgacggatggatgctgaacagttccgccatcaggaatctaggggtggatttactccccggataccaagatccctatagcggacggacgctgaccaagggagaagttggatgttttctgtctcattactcaatttgggaagaagttgtcgcccgaggacttgctcgcgtgctcgtgtttgaagacgacgtgcgatttgagtccaattttcgagggcgactggaaaggcttatggaggacgtagaagccgagaaactttcctgggatctgatttatttggggcgtaagcaggtcaacccagagaaagaaactgccgtggaggggctgcctggactcgtggtggccggctacagttattggactctggcgtatgcactgcggctggcaggagcgcgcaaactcctcgccagccaaccacttcgaaggatgctgcctgtcgatgagtttctgcccatcatgtttgatcagcatcccaacgaacaatataaggcccacttctggcctagggatctcgttgccttctcagctcaacctctactggctgccccaacgcattatgccggcgatgccgagtggctttcagacacggaaaccagctcaccctgggatgacgattccggcaggctaataagttggagcggcagtcaaaagaccttaagaagcccacgcttagatctgactggatcttcgggccatagcctgcagccccagcctagagacgaactgtag

SEQ ID NO: 24944 - DNA, 240 bp, Artificial Sequence
  Description of Artificial Sequence: Synthetic coding sequence
atgctccaggaatggctcgcggcagtgggcgatgactatgcagctgtagtctggcgcccggaaggagaacctaggttctatcctgatgaggaggggccaaaacactggacgaaagagagacatcagttcctgatggagcttaagcaggaagctctgactttcgctagaaattggggagccgattatattttgtttgcagacactgacaacattctgacgaataaccagaccctgcggtag

SEQ ID NO: 24945 - DNA, 1647 bp, Artificial Sequence
  Description of Artificial Sequence: Synthetic coding sequence
atgcgcgcggcacgggcggctccactactgcagctgctgctgctactaggaccctggctcgaagctgcaggagtggctgagtctccattacccgccgtcgtgttagccatactcgcccggaacgccgaacactccctgccgcactatttaggcgcactcgagcgactggattacccacacgaggagggacctaaacactggacaaaagaacgccaccagtttctcatggagcttaaacaggaggctttgacttttgccagaaattggggcgcggactacatcttgttcgctgataccgacaacatcttaacaaacaaccagacactgagactgttaatggggcaaggtctgccagtggttgcgcccatgctcgatagccagacttactacagcaacttctggtgtggaattacacctcaggggtactataggcgcaccgcagagtatttcccaactaagaataggcagcgcagagggtgcttccgcgtgcctatggtgcatagcacattcctcgcatcgctgcgggctgaaggagctgaccagctggcattctatcctcctcaccccaactacacgtggccattcgatgacatcattgtatttgcttatgcctgtcaggcagccggcgtctcggttcatgtttgtaatgaacacaggtatggttatatgaacgtaccagtgaagagccatcaggggctggaagacgaacgggtgaacttcatccatctgatcttagaggccctggttgacgggccacgcatgcaggcaagcgctcatgttacgcggccctccaagcgcccttcaaaaattgggttcgacgaagtattcgtcatctccctcgctagacggcctgacaggcgggagcggatgctggcctcactgtgggagatggagatcagcggtcgtgtggtggatgcagttgacgggtggatgctgaatagctcagctataaggaacctgggtgtggacctgttgcccggctaccaggacccatacagtggtaggaccctgacaaagggcgaagtggggtgtttccttagtcactacagcatttgggaagaggtcgtggctcgcggactggccagggttctggtttttgaagatgacgtgaggtttgagagcaactttaggggccggctggaacgcctcatggaggacgtcgaagcagagaagctctcgtgggatctgatatacctcgggcggaaacaggttaatccagaaaaggagaccgctgtggaaggattacccgggctggtcgtcgctgggtattcctattggaccctggcctacgcactcagactggccggcgccaggaaactcctggcctcacaacccctgcggcgaatgctgcctgttgatgagttcctgccaatcatgttcgatcaacacccaaatgagcagtacaaagcccatttctggccacgagacctggtcgccttttcagcacagccgttgctggccgcccctacacattacgctggcgatgctgagtggctaagcgacaccgagacttcatcaccatgggacgacgatagcgggcgccttattagctggagcggatcacagaagactctgaggtcgcctagactcgatttgacgggctcaagcgggcattctttgcagccacaaccacgcgacgagctctag

SEQ ID NO: 24946 - DNA, 195 bp, Artificial Sequence
  Description of Artificial Sequence: Synthetic coding sequence
atgcttcaggaatggctcgcggcagtgggggatgactacgctgctgtggtttggcgcccagaaggggaacccaggttttacccggatgaagagggtcccaagcactggacgaaggagcgacaccaatttctgatggaactcaagcaggaggctttaactttcgcccgcaattggggcgcagattacattctgtag

SEQ ID NO: 24947 - DNA, 657 bp, Artificial Sequence
  Description of Artificial Sequence: Synthetic coding sequence
atgctgcaggagtggttagccgccgtgggagacgactatgccgcggtggtatggagacctgagggggaaccccgcttctatcccgacgaggagggtcccaagcattggacgaaagagcggcaccagttcctgatggagctgaagcaagaggcccttacttttgccagaaattggggcgccgactatattttgttcgctgacaccgacaacatcctcaccaacaatcaaacactgcgcctcctgatgggccaggggttgccagtagtggcaccaatgttagattctcagacttactactccaacttctggtgtggtattaccccacagggctattacaggcgaacagccgaatactttcctacaaagaacaggcagcgaaggggttgcttcagagtccctatggtccattctaccttcttggcctccctcagggcggaaggagcagatcagctggctttctatccaccccatcccaactacacctggccttttgatgatatcatcgtgttcgcatacgcctgccaagctgccggggtcagtgtgcacgtgtgtaatgagcatcgctatggatacatgaacgtacccgtgaagtcccatcagggcctcgaggacgagcgcgtgaactttattcaccttatactcgaggcactgggctag

SEQ ID NO: 24948 - DNA, 330 bp, Artificial Sequence
  Description of Artificial Sequence: Synthetic coding sequence
atgcttcaggaatggctggccgctgtgggggacgattacgcggctgtggtgtggagacccgagggggagcctcgattctaccccgacgaggaagggcccaagcactggacaaaagagcggcatcagtttttgatggagctgaaacaagaggcactgacgtttgcccgaaactggggagcagactacatactgtttgctgacacagacaatatactcacaaataaccagacactgcggctgctaatgggccaggggcttccagtggtggctcccatgctggactcacagacatattattccaacttttggtgcggaatcacaccacaatag

SEQ ID NO: 24949 - DNA, 348 bp, Artificial Sequence
  Description of Artificial Sequence: Synthetic coding sequence
atggaggttaaagatgcaaatagcgcattgctgagtaactacgaaacattaaaatacattagcaagaccccctgtcggcatcaaagtccagagattgtccgtgagtttctcacagccctcaaaagtcataagttgaccaaggccgagaagctgcaactcttgaaccatcggccagtcactgcagttgagatacagttgatggtggaggaatctgaagaacggctcacagaggagcaaatcgaggctctactacacactgtgacctctattctgcccgcggaacctgaggctgaacagaagaagaatactaattctaatgtggccatggacgaggaggaccctgcttag

SEQ ID NO: 24950 - DNA, 447 bp, Artificial Sequence
  Description of Artificial Sequence: Synthetic coding sequence
atggaggtcaaggatgccaatagcgccctcctgagcaattacgaagtattccagctgcttactgacttgaaggagcagcgaaaggagtccggcaagaataaacattcctccggccagcagaatctcaacaccataacctacgaaacactcaaatatatcagcaaaaccccctgtaggcaccagagtcctgagatcgttagggagtttttaacagccttgaagagccacaagcttacgaaggccgagaagctccagctgctaaaccatcgtcccgttactgccgtggaaatccaactcatggttgaggaatccgaggaacgactgacggaggagcagatcgaagcattgcttcacacagtgaccagcattctcccagctgagccagaagccgaacagaaaaaaaacactaacagtaatgttgcgatggatgaggaagaccctgcttag

SEQ ID NO: 24951 - DNA, 216 bp, Artificial Sequence
  Description of Artificial Sequence: Synthetic coding sequence
atggaggtggcagagaagttgcagctcctgaaccatagacccgtgactgccgtggaaattcagctgatggtcgaagagtctgaagaacgcctgacagaggagcagatcgaagctctgctgcacactgtcacttccatcttgccagccgagccagaggctgagcagaaaaagaacaccaacagtaacgtagccatggatgaggaggaccctgcttag

SEQ ID NO: 24952 - DNA, 348 bp, Artificial Sequence
  Description of Artificial Sequence: Synthetic coding sequence
atggaaatgaaggatgcaaactccgccctcctctctaactatgaaaccctgaagtacatctctaaaacaccatgccgccaccagagcccagagattgtgcgggagtttctgaccgcgctgaagagccataagctgactaaggccgaaaagctgcagctcctgaatcacaggccagtcacggccgtggagattcagctgatggtggaggagagcgaggagcgactcacagaggaacagattgaggccctccttcatactgtcacgagcattttaccagccgagcccgaagcagaacagaagaagaacaccaattctaacgttgccatggacgaggaggacccggcctag

SEQ ID NO: 24953 - DNA, 426 bp, Artificial Sequence
  Description of Artificial Sequence: Synthetic coding sequence
atgcaaaggggcgacccaggtgaacacctcggggccagaagctggcacttaggagcggttggaggcggtggtgatagctgcgaggttaaagacgctaatagcgcactcctgtcaaactacgaaacactgaaatatattagcaaaactccatgtcgccaccagtcgcccgaaattgtccgggaatttctgacggctctgaaatcccacaagctcacaaaggcagagaagctgcagctccttaatcaccgtcccgtgaccgctgtcgaaatacagctgatggtcgaagaaagcgaagagcgactgacagaagaacagatcgaagccctgctccacacagtaaccagtatcctgccagccgagcccgaggcagagcagaaaaaaaacactaacagtaatgttgctatggacgaggaggacccagcctag

SEQ ID NO: 24954 - DNA, 702 bp, Artificial Sequence
  Description of Artificial Sequence: Synthetic coding sequence
atgtccaagttggggaaatttttcaaaggcggtggctcgtccaaaagcagagcagccccatccccccaagaggccctcgtgcgtctcagagagacagaggagatgctcggaaaaaagcaggaatatttagaaaaccgcatccagcgcgaaattgccttggccaagaaacacggaactcagaacaagcgcgccgccctccaggccctgaaacgcaagaaaagattcgagaagcagctgactcaaattgatggcacgctgagcaccatcgagtttcaacgtgaagctctggaaaattcacacacaaatacagaagtgctcaggaacatggggtttgctgccaaagcaatgaagtcggtgcacgaaaatatggacctaaataaaattgatgatctgatgcaagagatcacggaacagcaagacatagctcaggagatctctgaggctttttctcaacgcgtgggctttggagacgattttgacgaagatgagctaatggccgaattggaggaactggagcaagaggagctcaacaaaaagatgactaatattcggttacccaacgtcccctcatcaagcctgcccgcacagcccaaccgtaagcctggaatgtcctccaccgcccggagaagtagggcagcttcaagtcaaagggccgaagaagaagacgatgacataaagcagctggcagcctgggctacctag

SEQ ID NO: 24955 - DNA, 1293 bp, Artificial Sequence
  Description of Artificial Sequence: Synthetic coding sequence
atgctatgcagcctgctgttatgtgagtgccttcttctcgttgccggttacgctcacgacgatgactggattgatccaactgatatgttgaattatgacgccgcatctggtactatgcgcaagagccaggccaaatacgggatctctggggagaaggatgtgtcccctgatttgagctgcgctgatgaaatcagcgagtgctatcataaactcgatagcctgacctataagatcgatgaatgtgaaaagaaaaagagagaggattatgagtcgcagtctaatccagtgttcagacgctacctgaacaagatcctcattgaggccggaaagcttggactcctcgccttcgcacagcaccaagctgaagttgctaaaatggaaccgctgaataatgtctgtgctaaaaaaatggattggaccggtagcatttgggaatggttccggagttcatggacatacaaagacgatccctgtcagaagtattatgagcttctgctggtcaaccccatatggctggtgcccccaaccaaagctctggcagttacctttactacctttgttactgagccacttaaacacataggaaaggggacaggagagttcatcaaagccctgatgaaggaaatccccgctttgctgcatctgcccgtcctcattattatggccctagccattctctccttctgttacggtgccgggaagagcgtccacgtgttaaggcacatcggcggcccagagtcagagccccctcaggctctgcggcctagagatcgcaggaggcaggaagaaattgactataggcccgacgggggagctggcgacgccgacttccactataggggacagatgggtcctacggagcaggggccttacgcaaagacctatgaaggtcgccgggagatattgagagagagagatgtagacttgcgctttcagactgggaacaagagtcccgaggtactccgggcctttgatgtgccggatgccgaggcccgggaacacccaaccgtggtcccttcgcacaaatcccctgtgttggacaccaagcccaaggagactggcggcatcctgggcgaaggcactccaaaggagtcctctacagagtctagccagagtgcaaaacctgtgagtggacaggacacaagcggcaacaccgagggatctccagccgccgaaaaggcccagctgaaatccgaggctgcaggctctccagaccaggggagcacatacagtcccgctcggggagtagccggtcctcgcgggcaggatccggtgtcctccccatgcggttag

SEQ ID NO: 24956 - DNA, 1101 bp, Artificial Sequence
  Description of Artificial Sequence: Synthetic coding sequence
atgttatgcagcctcctgttgtgtgagtgcttgctcctcgtggctgggtacgcgcacgatgacgactggatcgaccccactgatatgctgaactacgatgcagcatctgggacgatgcgtaaatcacaggctaagtacggcatatccggggagaaagacgtgagccccgacttgtcttgcgcggatgagattagtgagtgctatcacaagctggactctctgacatataaaatcgacgagtgcgaaaagaaaaaacgcgaggactatgaatcccaatccaacccagtgtttaggcggtatttaaataagattctcatagaggccggaaaactcggtttagcgctcgctgtcacattcacgactttcgtgacagagccacttaaacacatcggaaagggcaccggcgaatttatcaaagcactcatgaaagagatccctgccctcctgcacctgcccgtgctgattatcatggcactagccattctgagcttttgctacggtgccgggaagagtgtgcacgttctgcggcatataggagggccagaatccgaaccgccacaggctctgaggccgagagaccgtcggagacaggaggaaattgactaccggccagatggaggcgcaggagatgccgactttcactacaggggccagatgggtccaactgagcaaggcccctacgccaagacatatgagggtcgccgagaaattctacgggagcgcgatgttgacctgcgctttcagacagggaacaaatcccctgaggtgctccgggcgttcgacgtgcccgacgcagaagctagagagcatcccacggtggtaccatcccataagtcgcctgtcctggacaccaagcccaaggagactgggggcattcttggggagggaacaccaaaggagagttccaccgagtcgtcgcagtccgcaaagcccgtgtccggccaggacacttctggcaacacagagggaagtcccgctgcagagaaagcccaactgaagagtgaggccgcaggctcaccggaccagggcagtacatatagtccagcgcgcggagtggccgggccccgtggccaggatccggtttccagcccctgtggctag

SEQ ID NO: 24957 - DNA, 1656 bp, Artificial Sequence
  Description of Artificial Sequence: Synthetic coding sequence
atgttgtgctccttgctcctatgtgaatgtctcctgcttgtggccggctacgcacatgacgatgactggatcgaccctaccgacatgctgaattatgacgctgctagcggcacaatgcgaaaatctcaggcgaagtacggtatcagcggagagaaagacgtcagccctgacttaagctgcgccgacgaaatcagcgagtgctaccacaagctcgactccctcacctacaagattgacgagtgcgaaaagaaaaagcgggaggattacgaatcgcagtccaatcctgtgtttagacgctacctgaataaaatcctgatagaagcaggaaagctcggcctccctgatgagaataaaggtgatatgcactacgatgctgagataatcctgaaacgtgagaccctgctcgaaatccaaaaatttcttaatggtgaggactggaagcccggcgcactcgatgacgccctgagcgacatcctgattaatttcaaattccacgactttgaaacttggaagtggaggtttgaggattcttttggggtggatccctacaacgtgcttatggtgctcttgtgcttgttgtgtattgtagtcctggtcgcgacagaactgtggacgtatgtacggtggtatacccaactgaggcgagtgttaattatctccttcttatttagcctgggctggaattggatgtacctgtacaaactggcttttgctcaacaccaagctgaggttgctaaaatggagccactgaataatgtgtgtgctaaaaaaatggactggactgggagtatctgggagtggttcagatcctcatggacctataaagatgacccctgccagaagtattatgaactgttattagtcaacccaatctggctcgttcctccgactaaggcacttgcagtaacattcacaacattcgtcacagaacccttaaagcacataggtaagggcaccggtgagttcattaaggcccttatgaaggagatccctgccctgttacatctgcctgtgctcatcatcatggcgctcgcaatcctgagcttttgctatggagccggcaagtcagtgcatgtgctccgtcacataggtggtcctgagtcagaacccccacaagcactacggccgagggaccgccgccggcaagaggagatcgattatcggccagacggcggggccggcgacgcggattttcattatagagggcagatgggccccacggagcagggaccttatgccaaaacatacgaaggaagaagagagattctcagagaacgggatgttgatctgcggttccaaactggcaacaagagccccgaggtcttgagagcgttcgatgtgcccgacgccgaggctcgcgaacacccaaccgtggtcccatcccacaagtccccggtgctggatactaagccgaaggagaccggcggcatcttaggcgagggtactccaaaggagagctccacggagtcgtcacagtctgccaagcctgtatccggacaggacacctctggcaatactgaaggcagtcctgccgccgaaaaagctcaactgaagtccgaggccgcaggatcacctgaccaaggatccacctatagtcccgcccggggcgtcgcgggccctaggggccaggatccagtctcttctccctgcggatag

SEQ ID NO: 24958 - DNA, 1101 bp, Artificial Sequence
  Description of Artificial Sequence: Synthetic coding sequence
atgctgtgcagcttgttgctgtgcgagtgtcttctgctggtggccggctacgcacacgacgatgactggatcgacccgacagatatgctcaattacgatgccgcatccggtacgatgagaaagtcgcaggccaagtacggcatatccggggaaaaggatgtgagtcccgatttgtcttgtgctgatgagatctcagagtgctatcataagttggattcactcacatacaagatagatgaatgtgagaagaaaaagagagaagattatgagtcccaatctaaccccgtgttcaggcggtacctgaacaagatcttgattgaggccggtaaactgggactggccctcgccgtgaccttcactaccttcgtaaccgaacctctgaagcacatcggtaagggcacaggggagtttataaaggccctcatgaaagagatccccgccctgctgcatctgccagtcctgattataatggcactggccatcctgagtttttgctatggcgcaggtaaatcagttcacgtgctcaggcatataggggggccagaaagcgaaccacctcaagctctgcggccaagagaccgaagaaggcaggaggagatagattaccgtcccgacggtggagcgggagatgcagattttcactatagaggacaaatgggacccaccgaacagggcccctacgcaaaaacctacgagggccggcgtgaaatcctccgggaaagagacgttgacctgcgctttcagaccgggaataaatcgcctgaggttttgcgggccttcgacgtacccgatgccgaggctagggagcacccgactgtggtcccttcgcacaagtcccctgtgctggataccaagcccaaagaaactggggggattctcggtgaagggacgcccaaagagtcaagtaccgagagtagccagtctgccaagcccgtaagcggacaggacacaagtggcaatacagagggcagccccgccgccgagaaagcccagctcaagagtgaagccgctggcagccccgatcagggcagcacctatagtcccgctagaggcgtagcaggcccaagaggtcaagacccagtgtctagcccttgcggttag

SEQ ID NO: 24959 - DNA, 1293 bp, Artificial Sequence
  Description of Artificial Sequence: Synthetic coding sequence
atgctgtgttcacttctcctttgcgagtgcctcttactcgtcgctggatacgcccacgacgatgactggatcgaccccaccgacatgctcaattatgatgccgccagtggaactatgcggaagagtcaggcaaagtacggaatcagcggcgagaaagacgtgtccccagatctgtcttgtgccgatgaaatctctgagtgttaccataaactggactccttaacctacaagatcgacgagtgcgaaaaaaagaaaagagaggattacgagagccagagcaaccctgtttttcgaaggtacctgaacaaaattcttatcgaggcgggaaagctgggcctgttagcgtttgctcaacaccaggccgaagtcgctaagatggagccccttaataatgtgtgtgccaagaagatggactggactggtagtatttgggaatggttccgcagttcctggacctataaagacgacccttgtcagaaatattacgaactcttacttgtgaaccccatctggctcgtccctccaaccaaagccttagccgtgacgttcactaccttcgtgaccgagccactgaagcacattgggaaaggaacaggcgaattcataaaagcgttgatgaaagaaattcctgctctactgcatctcccggtgctgatcatcatggcattggctatcctctccttctgctacggcgccggcaaatcagttcatgtgcttcggcacatcgggggccccgagagtgagcctcctcaggcacttcgccctcgggatcgacggagacaggaggagattgattatagacctgacggcggcgctggggacgctgattttcactatagggggcagatgggacccacagagcagggcccatacgccaagacctacgaggggcgccgggaaattctgcgcgagagggatgtagatttgcggtttcaaaccggaaataaatcgcctgaagttctaagagccttcgacgtcccagatgccgaggcgcgcgagcaccctacagtggtgccctcgcacaagagtcccgtgctggacacaaagcccaaggagacaggagggatcttgggcgagggcacccccaaggaatctagcacggaaagttcccagtccgcaaaaccagtgtccggacaggatacgagcgggaacaccgagggcagtcctgctgcggagaaggcccagctaaaaagcgaggccgcaggatctccagatcaggggtcaacgtattctcccgcccgaggcgtggcagggccgcggggtcaagaccccgtctcatctccttgcggatag

SEQ ID NO: 24960 - DNA, 1506 bp, Artificial Sequence
  Description of Artificial Sequence: Synthetic coding sequence
atgctgtgtagtctgctactgtgtgagtgcctccttttagttgctggatatgcccatgacgacgattggatagatcctactgatatgctgaattacgatgccgcttccggtacaatgcgcaagagccaggcgaaatatgggatcagtggtgagaaggatgtgtctcccgatctatcgtgcgcggatgagatctctgagtgctaccacaagcttgactcgctcacatacaaaattgacgaatgtgagaaaaagaagcgcgaggactatgaatcgcagtcaaaccccgtgtttagacgctatctgaacaaaatattgatagaagccgggaagcttggtctgtttcacgatttcgaaacgtggaaatggagatttgaagattccttcggcgttgacccgtacaacgtgctgatggtgctgctgtgcctgctgtgtatcgtggttctcgttgccacagaactatggacatacgtccggtggtatacccagttacggagagtgctcatcattagctttctcttctccctcgggtggaattggatgtacctgtacaagctggctttcgcccagcaccaggcggaggttgcaaaaatggagccactaaacaatgtctgtgcaaagaagatggattggaccggttccatctgggaatggttccggtctagctggacctacaaggacgacccatgtcaaaagtactatgaacttctgctggtgaatccaatctggctggtccctcctacaaaagctcttgccgtgacttttactacctttgttacggaacccctgaagcatattggaaaaggaacaggagagttcattaaggccctgatgaaggagataccagctctcctgcatctccccgtcctcatcatcatggccctagcaatactgtcgttttgctacggcgccggcaagagtgtgcatgttttgcggcacatcggggggcctgaaagcgaaccccctcaggcgctgcgtcctcgggatagaaggagacaggaggagattgactacagacctgacggaggtgccggggacgctgactttcactaccggggacaaatgggtcccaccgagcagggcccctacgcaaaaacctacgaaggacggcgggagatactccgggagcgtgatgtagatctgagattccagaccggcaataagagccctgaggtcctgcgagcctttgacgtgccagacgctgaagcccgtgagcaccctactgtggtaccatcgcataagagccctgtcctggacacaaagcctaaggaaacaggtggtatcctgggagagggcacgcctaaggaatcgtcaacagaatcgagccagagcgccaaacccgtctctgggcaagatacttccgggaacaccgaagggtcaccagctgccgagaaggcacagcttaagagcgaagcagccgggtcccccgaccagggatctacatactcaccagcccggggtgtcgcaggcccccgaggacaggaccccgttagtagcccgtgtgggtag

SEQ ID NO: 24961 - DNA, 1656 bp, Artificial Sequence
  Description of Artificial Sequence: Synthetic coding sequence
atgctgtgtagcctgctgctatgtgagtgtttgctcctggtggcagggtacgcacatgatgacgattggatcgatcccaccgacatgcttaactacgatgccgcgagcgggacgatgcgaaaatcacaggctaagtatggtatttcaggcgaaaaagacgtctcccccgatctgagttgcgctgatgaaatatccgagtgctaccataagttagatagcctaacgtacaagattgacgagtgcgaaaaaaagaagagagaggattacgaatcacaatctaaccccgtatttaggcgctatctgaacaagatcctaattgaggcaggaaaattaggcctccctgacgagaacaaaggcgatatgcactatgatgcagaaatcattctcaagagagaaactctccttgagattcagaagtttctgaacggagaggactggaaacctggagctctggatgatgcactgagcgatattctgataaatttcaagttccatgattttgagacgtggaaatggcggtttgaggattcttttggagtggacccttacaacgtgttaatggtgctgctgtgtctgttgtgtatagtcgtgttggtggctactgagctatggacttacgtgcgttggtatactcagctgagaagagtgctgatcattagctttttattttccctaggctggaattggatgtacttatacaaactggccttcgcccagcaccaggcagaagtggctaagatggaaccgctgaataacgtctgcgccaagaaaatggattggacagggagcatctgggagtggttcagaagtagctggacatacaaggatgatccgtgccaaaaatactatgagctgctcctcgtgaatcctatatggctcgtgccccccactaaggccctcgccgtaactttcacgaccttcgtgacagaaccacttaaacatattggaaaggggactggcgaatttatcaaggcattaatgaaggagattcccgcactgcttcacttgcctgttttgatcataatggccttggccatactcagcttctgctatggcgccggcaagtcagtgcatgtgctgagacacattggcggacctgagtcagaaccaccccaggccctgcggcctcgagacaggcgcaggcaggaggaaatagactatagaccagatggcggcgcaggcgatgccgacttccactacaggggtcagatgggtcccacagaacagggaccatatgcaaaaacatacgaagggcgcagggaaattctgcgggaacgcgatgtcgatctgcgtttccagaccggcaacaagagtcccgaagtcctgagggctttcgatgttcccgatgctgaagctcgggagcatccaacagtcgtcccctctcacaaatctcccgtgttggatacgaaacccaaagaaaccggtgggattctgggggaagggactccaaaagagtcctccacagaaagctctcaaagcgcgaagcctgtgagcggccaggatacctccggaaacacagagggctcgccagctgcggaaaaagcccagctaaaatcagaagctgcaggctctcctgatcaggggtcaacctattcaccagcccggggggtggcaggccctcggggacaggatcccgttagcagcccatgcggatag

SEQ ID NO: 24962 - DNA, 789 bp, Artificial Sequence
  Description of Artificial Sequence: Synthetic coding sequence
atgctgtgctccctcttactgtgtgagtgtctgctgttagttgcaggctatgcgcatgacgatgattggatagatcctacggacatgctaaattacgacgctgcctccggaaccatgcgcaagtcccaggcaaagtacgggattagcggagagaaggatgtgtcacctgatctttcttgcgctgacgagatcagcgagtgctatcacaaattggacagccttacgtacaagatcgatgagtgcgaaaaaaaaaaaagagaagactatgagagtcagtctaaccccgtgtttcgtcggtatctaaacaagatcctcatcgaagctgggaagctgggactgccggacgagaacaagggcgacatgcattatgacgccgaaataatcctgaaacgagaaacgctgctcgaaatacagaagttcctgaatggcgaagactggaaaccgggcgctcttgatgacgcgctgtcagacatccttattaatttcaaatttcatgatttcgaaacatggaagtggcgcttcgaggactcttttggagtagacccttacaacgtgctgatggtgctgctgtgtcttctgtgtatcgtcgtgctggtcgctacagaactttggacttatgtccggtggtacacccagcttcgtagagtgctcataatctcttgtgctcagtccgaggcttcgcgagtgaaacaagtgggaaacttgtttcaagcatgggcatttgcagtgtgcgatcctgtgttattgcaggtcccagtgtgccccatcctcgttttttgctactcttag

SEQ ID NO: 24963 - DNA, 1506 bp, Artificial Sequence
  Description of Artificial Sequence: Synthetic coding sequence
atgctctgttctctgctgctgtgtgagtgtcttctcctggtggccggatacgctcatgacgacgattggatagacccaaccgatatgctcaactatgacgccgccagcggaactatgcggaagtcccaggctaaatacggaataagtggggagaaggacgtgtccccggatctgagctgcgccgacgagatctcagaatgttaccataagttagattcgctgacttataagatagacgagtgcgagaaaaagaaaagagaggactacgagagtcagagcaatcctgtgtttaggagatacctgaataagattctgattgaagcaggcaagctggggctcttccacgactttgagacctggaagtggaggtttgaggactcctttggggtggacccatataatgtgctcatggtgctgttgtgccttctttgcatcgttgttcttgtggccacagagctgtggacatatgtccgatggtacacacagttgagacgggtcctgatcatctcctttctgttcagcctgggttggaactggatgtacctctacaagctagctttcgcccaacaccaggcagaagtagccaaaatggagccgctgaataacgtctgcgcaaagaagatggactggacaggatcgatctgggaatggtttcggtccagctggacctataaggatgatccgtgccaaaagtactacgagctgctgttagtcaatcctatctggcttgtgcccccaacaaaagcacttgcagtcacattcaccacgttcgtgaccgagccgttaaaacatattgggaaaggaacaggtgagttcatcaaggcccttatgaaggagatccccgcgctcctacatctcccagtactgattattatggccctcgcgatcctctcattttgctatggtgctggtaagagcgttcacgtcttgagacatattggtggccccgaatcagagcctccacaggcccttcgaccccgcgacaggcgaagacaggaggagattgattacagaccggacggcggggcaggcgacgctgatttccattatcgaggacagatgggaccaaccgagcagggcccatacgcaaagacatacgagggccgacgtgaaatcctgcgcgaaagggatgtagatttgcggtttcagaccggcaacaagagcccagaggtcctgagggccttcgacgtgccggatgccgaggcacgcgagcaccccacagtcgtgccctcgcataaatcacctgttctggacaccaaaccaaaggaaactgggggaattctcggtgagggcactccaaaggagagttccacagaatctagtcagagcgccaagcccgtctctggccaggacacttccggcaacactgagggatcaccagccgccgaaaaagcacagctgaagagcgaggctgccggcagccccgatcagggctccacctactccccagccaggggagtcgccggaccccgagggcaggaccccgtgagttctccttgtggatag

SEQ ID NO: 24964 - DNA, 726 bp, Artificial Sequence
  Description of Artificial Sequence: Synthetic coding sequence
atggcagaagagcaaccacaggtggagctcttcgttaaagccgggtcagatggggccaagattggcaattgccctttttcccaacggcttttcatggtgctttggcttaagggagtgaccttcaatgtgacaactgtcgatactaaaaggcgaaccgagacagtgcagaaactatgccctgggggccagctgccttttctgttgtacggtacggaggtccatacggatactaacaagatcgaggagtttctcgaggctgtgctgtgtcccccccggtaccccaagctggcagccctgaatcccgagtccaacactgctgggcttgacattttcgcaaaattctcggcttacataaagaattcaaaccctgcccttaacgataatctggaaaagggcctgctgaaggccttgaaagtgctggacaattatcttacaagcccactgcctgaagaagtggatgaaacttccgccgaggatgagggggtttcccagaggaagttccttgacgggaacgagctgactcttgcggattgtaacctcctgccgaagctacacattgtacaagtggtctgcaagaagtatagggggtttacaattcccgaggctttcagaggagtgcatcgctatttatccaatgcatacgcgcgagaggagtttgcatcaacatgcccggatgacgaggaaatcgagctcgcatacgagcaagtagctaaggcattaaagtag

SEQ ID NO: 24965 - DNA, 726 bp, Artificial Sequence
  Description of Artificial Sequence: Synthetic coding sequence
atggcagaagagcagccgcaggtagaactgttcgtgaaggcgggctcagacggggccaaaataggtaactgtcccttttctcagcggctctttatggtcctgtggctgaaaggcgtgacattcaatgtcacaacagtggatacaaagaggaggacagagacagtccagaaactctgtcccggcggccagctgccttttctgctgtatggtaccgaggtccataccgacactaacaagattgaagagtttctagaggcagtcttgtgccctccacgctaccccaaactagccgcattgaatcccgaaagcaatacagccggcctcgatattttcgcaaagtttagcgcctacattaaaaattcaaaccccgctctaaacgataacttagagaagggcctcctcaaggccctgaaagtgcttgataactatctcacctcacctctgccggaggaggtggacgaaacatcagccgaagacgagggcgtttcacagcgcaagttcttggatggcaacgaattaaccctggctgactgtaatctcctgcccaagctacacatagtgcaggtagtatgcaagaaatatagggggtttactatacctgaggcgtttcggggcgtacacaggtatctgagcaatgcctacgctagggaggagtttgcctctacgtgccctgatgacgaggaaatagaattagcctacgagcaggttgcaaaggctctgaaatag

SEQ ID NO: 24966 - DNA, 726 bp, Artificial Sequence
  Description of Artificial Sequence: Synthetic coding sequence
atggcggaagaacagcctcaagtggagttgttcgtgaaggccgggtccgacggagctaaaatcggcaactgtccgttcagtcagagattgtttatggtcctgtggctcaagggcgtcacattcaatgtcacgacagtcgacacaaagcgccggacagaaactgtgcaaaagctttgcccaggtggtcagctgccatttcttttgtatggaaccgaggtacataccgatacaaataaaattgaagagttcctggaagctgtgctttgtcctccccggtatcctaagttagccgccctgaatcccgaaagcaacacagctggcctagacatatttgctaaattcagcgcttacataaagaactccaacccagctctgaatgataacctggaaaagggcctccttaaggcgctgaaagtcctcgacaattacctgaccagccccctccctgaggaggtggacgagacaagcgccgaggatgagggcgtttcccagagaaaatttcttgacgggaacgagctgaccctcgcggattgcaacctgctgccaaagcttcatatagtccaagtcgtctgcaaaaaatacaggggcttcacaattccggaggcatttagaggcgttcataggtatttgtccaacgcctatgctagggaggagttcgcctctacttgccccgacgatgaagaaattgaactggcttacgagcaggttgcaaaggccctgaagtag

SEQ ID NO: 24967 - DNA, 726 bp, Artificial Sequence
  Description of Artificial Sequence: Synthetic coding sequence
atggctgaggagcagccacaggtggagctatttgtgaaagctggaagtgacggtgctaagataggcaattgtcccttttctcagcgtctgttcatggtgctttggttgaagggggttaccttcaacgttaccaccgttgacacaaagcggcgcaccgaaacggtccagaagctttgccctggcggacagctcccctttctgttatacggtaccgaagtgcacactgatacaaataaaatcgaggagttcctcgaagcggtcctttgtcctcctcggtacccaaagttagctgccctgaaccctgagtccaataccgccgggctcgacatttttgccaaattcagcgcatatattaagaatagcaacccagcacttaacgacaacttggagaagggccttctgaaagccctgaaggtgttagataactacctcaccagcccactccctgaagaagtcgacgagacaagcgcggaagacgagggcgtgtcccagagaaagtttctggacggaaatgaactgacacttgctgactgtaacctcctccccaagttacatatcgttcaggtcgtgtgcaagaagtacagaggctttactattcccgaggccttccgaggagtccacagatatttgtcgaacgcctatgccagggaagagttcgcaagcacatgccctgatgatgaggaaatcgagttggcatacgagcaagtggctaaggccttgaagtag

SEQ ID NO: 24968 - DNA, 726 bp, Artificial Sequence
  Description of Artificial Sequence: Synthetic coding sequence
atggccgaagaacagcctcaggtggagttattcgttaaggccggatccgatggcgcgaagattggtaactgtcctttttcgcaacggttgttcatggtattgtggctgaaaggtgtgaccttcaacgttacaactgtggatacaaaaagacggacggagactgtgcaaaaattgtgtccggggggtcaactgccctttcttctctatggaaccgaggtgcacacggatactaacaagatagaggagttcctggaggcagtgctgtgccccccacgctaccctaaacttgctgccctgaatcccgaatccaatacagcgggtctagatattttcgccaagttctccgcctacattaaaaatagcaaccccgctctgaatgataatctcgaaaaaggcctgttgaaagctttaaaggtcctagacaactatttaacctctcccttaccagaggaggttgacgaaacctcagcagaagacgaaggtgtatcccagcgtaaatttctggatgggaatgagcttacactcgcagattgtaatcttctgcctaagctgcacattgtccaggttgtctgtaagaaatatcggggattcaccatccccgaagccttcagaggcgtgcatcgttatttatctaacgcatatgctcgcgaggagttcgcgtccacatgccctgacgatgaggagattgaactcgcatatgaacaggtggccaaggccctaaagtag

SEQ ID NO: 24969 - DNA, 726 bp, Artificial Sequence
  Description of Artificial Sequence: Synthetic coding sequence
atggccgaggagcagcctcaggttgaactgtttgtgaaggccggttccgatggggccaaaatcggcaactgtcctttcagccagcggctgtttatggtcttgtggttgaagggggtgactttcaatgttacgactgtggatacaaagcggaggactgaaaccgtccagaagctttgtcccggaggacagttaccttttttgttgtacggaacagaggtgcataccgacactaacaaaatcgaagagttcctggaagccgtcctgtgtcccccacgctatcccaaactcgctgcgctgaatccggagtccaacaccgctggcttggatatattcgccaaattctcagcctacataaagaactcaaatccagccctcaatgataacctggagaaaggactgctcaaggctttaaaggttctggacaactacctcaccagccccctgcccgaagaggtggacgaaacctcggcggaggacgagggagtgtcgcagcgtaaattcctagatgggaatgaacttactttagcggactgtaacctccttcctaagcttcacattgtacaggtggtgtgcaaaaagtacaggggctttacgatccctgaagcttttagaggcgtccaccgctacctgagtaatgcatacgcccgggaagagttcgcatcaacctgccctgacgacgaggagattgaattagcttatgagcaggtggctaaagcattgaaatag

SEQ ID NO: 24970 - DNA, 726 bp, Artificial Sequence
  Description of Artificial Sequence: Synthetic coding sequence
atggccgaggaacagccccaagtagaactgttcgtgaaagccgggtccgacggggcaaagattggcaactgcccctttagccagaggctgtttatggtgctctggctcaaaggagtcacatttaatgtcaccaccgtggataccaagagacgtaccgagactgtgcagaagttgtgtccaggcgggcagcttccattcctgctgtatggcacagaggttcatacagatacaaacaaaatagaagaatttctcgaagctgtgctatgtcctccccgctatcctaagctggctgcactgaatcctgagagtaacacagcgggcctggatatatttgccaagttttcagcctacattaagaactcgaaccctgctctcaacgacaacctggagaaagggctcctcaaagctctcaaagtgctcgataattatctcacaagtcccctcccggaggaagtcgatgagacgagcgccgaagatgaaggagtgtcccagcgcaagttcctggatggaaatgaactgacactggccgactgtaacctgctgcccaagctccacattgtccaagtcgtttgtaagaagtataggggattcactattcccgaggctttcaggggagtgcatagatatttaagcaatgcctatgcgagggaggagttcgcctcaacctgtcccgacgatgaggaaatcgagttggcctacgagcaggtcgccaaggcgctcaagtag

SEQ ID NO: 24971 - DNA, 726 bp, Artificial Sequence
  Description of Artificial Sequence: Synthetic coding sequence
atggctgaggaacagccgcaggtagagctgtttgtgaaagccggcagtgacggcgcaaagatcggcaactgtcctttttcccagcggctgttcatggtcctttggttaaagggagtgaccttcaacgttacgacagtggataccaaaaggaggacagaaaccgtgcaaaaactctgccccggcgggcagctaccattcctcttgtacggtaccgaggtacacaccgacactaataagatagaagaattcctcgaagcggtgctgtgccctccaagataccccaaattggcagctcttaaccctgagtcaaatacagctggcctagatattttcgcgaaatttagtgcttacatcaagaattctaaccctgcgctgaatgataatcttgaaaaaggcctccttaaggctctgaaggtccttgacaattatctgacttcccccctgccagaggaagtggacgagacctcagccgaagacgagggtgtgtctcagaggaaattcttggacggcaacgagctgaccctcgccgactgtaacttactgcccaagctgcatatcgtacaagttgtgtgtaaaaagtaccgtgggtttaccattcccgaggcatttagaggggtgcaccgatatctcagcaatgcatacgcaagagaagaatttgcgtcgacatgtcccgatgatgaggaaattgagctggcgtacgagcaggtcgctaaggccctgaagtag

SEQ ID NO: 24972 - DNA, 726 bp, Artificial Sequence
  Description of Artificial Sequence: Synthetic coding sequence
atggcggaagaacaacctcaagtggagctgttcgtgaaggctgggtccgacggggccaagatcggaaattgtcctttttcccagcgcttgttcatggtcctctggctgaaaggcgtgacttttaatgtgactaccgtcgacacaaaaagacgaactgagactgtacagaaactgtgcccaggcgggcagttgccttttctgttgtacggaactgaagtgcataccgataccaacaagatcgaggagttcctcgaggccgtgttatgccccccaaggtatccaaagttagccgcactcaatcccgagtctaatacagccggactggatattttcgccaagttttccgcgtacatcaagaatagcaatccagcattaaatgataatctagagaagggactcctcaaagcactcaaggtgctggataactatctgacaagcccactgcctgaggaggtggatgaaacatcagctgaggatgagggggtcagccagagaaagtttctggacggaaatgaactcacactcgcagactgcaacctgctccctaagctgcacattgtgcaggttgtctgcaaaaagtatcgtggattcaccatacctgaagcttttcgaggcgttcaccgctacctttccaacgcttatgcacgtgaagagtttgcatctacatgtccagatgacgaagagatcgagctagcatatgaacaggttgccaaagcactgaaatag

SEQ ID NO: 24973 - DNA, 726 bp, Artificial Sequence
  Description of Artificial Sequence: Synthetic coding sequence
atggctgaggaacagccccaagtggaactgttcgtgaaggccgggagtgacggagcgaagattggcaattgtcctttttctcagagactcttcatggtgctgtggctgaagggggtaacctttaacgttacgactgtcgacaccaaacgccggactgaaaccgtgcaaaaattgtgcccgggaggacagctgccctttctgctttatggaacggaagtgcatactgacactaacaaaattgaagaatttctggaggccgttctttgtcccccacgatatcccaaactggccgcactaaatcctgaaagcaatacggccggtttggacatctttgccaagttttccgcctacatcaaaaatagcaaccctgctctcaacgacaacttggaaaagggcctactcaaggcactcaaggtactggacaattatcttacaagtcccttgcccgaggaggtcgatgaaacatcagcagaagatgagggagtcagccaacgcaagtttctggatgggaacgaattgacattagccgattgcaatctgctgccgaagctccacatcgtccaagtggtgtgtaagaaataccgaggtttcactatacccgaggcctttaggggagtccaccggtacttgagcaacgcgtatgcaagggaggagtttgcctcaacttgcccagatgacgaggaaatagagctcgcatacgagcaagtagccaaagccttgaagtag

SEQ ID NO: 24974 - DNA, 726 bp, Artificial Sequence
  Description of Artificial Sequence: Synthetic coding sequence
atggccgaggagcagccgcaggttgagttatttgtgaaagccggttcagatggcgccaaaattgggaattgtccctttagtcaacggctcttcatggtcttatggttaaagggagtgactttcaatgtcacgaccgtcgacacaaaacgacgaacggagaccgtacaaaaactgtgtcccggcggtcaattgcctttcctcctctacgggactgaggtgcataccgacacaaacaaaatagaggagttcttagaggcagtactgtgtccccctcggtaccccaaactcgccgccctcaacccagaatccaacactgctggtcttgatatctttgcaaagtttagtgcctatattaagaattccaacccagcactcaatgacaacctggaaaaggggctgctcaaggccctgaaggtgctggacaattacctcaccagcccgctcccagaagaagtagatgagacatccgcggaggacgaaggagtcagccaaaggaagtttttggacggcaacgagctaacactagccgactgcaatctgttacctaagctacacatcgtgcaggtcgtgtgtaaaaagtacagagggttcaccatacccgaagccttccgcggggtacacaggtacttgagcaatgcttacgcaagagaagagtttgctagcacatgccccgacgatgaggaaattgagctcgcttacgagcaggtagccaaagccctaaagtag

SEQ ID NO: 24975 - DNA, 726 bp, Artificial Sequence
  Description of Artificial Sequence: Synthetic coding sequence
atggccgaagaacaaccccaagtcgaactgtttgttaaggctggatccgatggcgcaaagataggcaactgtccgttttctcagagactgtttatggtgttgtggctcaagggggttacattcaacgtgacaacagtggacacaaaacgcagaacagagacagtgcaaaagctgtgtccaggcggtcagctgccgtttcttttgtatggcacggaagtgcatacggataccaacaaaatcgaggagttcctggaagcagtgctctgccctcctaggtaccccaagctcgcggcacttaaccccgagtctaataccgccggcctagatatttttgctaaattcagcgcttatattaagaacagcaaccctgctcttaacgataatcttgagaaggggttgcttaaagctctgaaggtcctggacaattacttgactagcccactgccagaggaggtggacgaaacgagcgcagaagatgaaggagtgagtcaacgcaagttcttagacggcaatgaactaacattggctgactgtaatctgctccctaaactgcatattgtgcaagtggtgtgtaagaaataccgaggcttcacaattccggaggcatttcgcggggtacatcgatatctgtcgaatgcttatgcaagagaggagttcgcctccacatgccccgatgacgaggaaatcgaactcgcatatgagcaggtggcgaaagctctcaagtag

SEQ ID NO: 24976 - DNA, 726 bp, Artificial Sequence
  Description of Artificial Sequence: Synthetic coding sequence
atggccgaggagcaacctcaggtggaattgtttgtgaaggcagggtcggatggcgccaagataggcaactgcccattttcccaaagactattcatggtcctttggttgaaaggggtgactttcaacgtaaccacagtcgacaccaagcgacgtaccgagacagtgcaaaaactttgccctggagggcaattgcccttcctgctatacggcaccgaggttcatactgatacgaacaagatagaggagtttttagaggcggtgttgtgtccaccccggtaccctaagctggccgcactcaacccagagtcaaataccgccggcctggacatctttgcaaaattttccgcctacattaagaacagcaatccagccttgaatgataatctggagaaggggctgctcaaagcattaaaggtgctcgacaactatctcacctcgccacttcctgaggaagtcgacgaaacctcagccgaagatgaaggcgtttctcaaagaaaatttcttgacggaaatgaactgactctggcagattgtaacctcttgcccaaactgcacatcgtgcaggtggtatgcaagaaataccgcggatttacaatcccagaggctttccgcggagtgcacaggtatctctctaacgcttatgcgcgagaagagttcgctagcacttgtccagatgatgaggagatcgagctggcttacgagcaggttgcaaaggctctgaaatag

SEQ ID NO: 24977 - DNA, 726 bp, Artificial Sequence
  Description of Artificial Sequence: Synthetic coding sequence
atggccgaggagcagccgcaggtggagctttttgtgaaggccggcagcgacggagccaagatcgggaactgtccattctcccagagactgtttatggttttgtggctaaagggtgtgacctttaatgtcaccacggtcgataccaaaagacgaacagagacagtgcagaagctgtgccctggaggccagctccccttccttctgtacggaacggaagtccacacagatactaataagatcgaagagttcctggaggccgtgttgtgtcccccaaggtatccaaagcttgccgccctgaatcctgagagtaatactgccggcttagatatcttcgccaaattcagtgcctacataaagaattctaaccctgcacttaatgataacttggagaaggggttgttgaaagctctgaaagtgcttgataactatttaaccagtcccctcccagaggaggtcgatgaaacaagcgctgaagacgaaggtgttagccagcggaagttcctagatggcaatgaactgaccctggccgattgtaatttactgcccaaactccatattgtgcaggtggtgtgcaaaaagtaccgaggattcactatccccgaggcctttcgaggagtgcatcgatacctctctaatgcttacgcgagggaagaattcgctagcacgtgcccggacgacgaagaaatagagcttgcctatgaacaagttgcaaaagcccttaagtag

SEQ ID NO: 24978 - DNA, 726 bp, Artificial Sequence
  Description of Artificial Sequence: Synthetic coding sequence
atggctgaagagcagcctcaggtagaactgtttgtaaaagccggtagcgacggagccaaaatcggaaactgccctttttcacaacgtctgtttatggtgctctggctgaagggtgtcacctttaacgtgacgactgtggatactaaaagacggacggagaccgtgcaaaaactctgtcctggaggccaactgcccttccttctctacgggactgaggtccataccgacaccaataagatcgaggaatttctcgaggccgtgctatgcccaccaaggtaccctaaactggctgcccttaatccagagtccaacactgcaggcctggacatctttgctaaattctccgcatacattaagaactccaaccccgctctaaatgataatctcgaaaaaggtctgctgaaagcattaaaagttcttgataactatctcacctccccgctgcccgaagaagtggacgaaaccagtgctgaggatgaaggcgtgtcccagaggaaatttctcgatgggaatgaacttaccctcgccgattgcaatctccttccaaaattacatattgtacaggtcgtgtgcaaaaagtaccgtggattcacgattccagaggcgttcaggggagtccatcggtatctatcaaatgcgtacgcccgcgaagagtttgcatcaacctgtcctgatgatgaggaaatcgaattggcttatgagcaagtcgccaaagcactcaaatag

SEQ ID NO: 24979 - DNA, 726 bp, Artificial Sequence
  Description of Artificial Sequence: Synthetic coding sequence
atggcagaggagcagcctcaagttgaactatttgtgaaggcaggcagtgacggagcaaagatcggtaattgccccttctcacagcggctcttcatggtgttatggctgaagggcgtgacattcaacgtgacgacagtagatactaagcggcgcacagagacagtccagaagctgtgcccgggcggacagcttcccttcctcctctatggaacagaggtacacactgacacaaacaagattgaagagttcctggaagcagtgttgtgcccaccacggtatccaaagttggcagccctcaacccagagtcaaataccgcagggctagacatctttgccaagtttagcgcatatataaagaacagtaatcccgctctgaacgacaacctggaaaaaggcctcctgaaggccctgaaggtactcgataattacttgacatcaccccttccggaggaagtggacgaaacctcagccgaggacgagggagtaagtcagcgcaaattcctcgatggcaatgaactgactttggcggactgtaacctgctcccaaagctccacatagtgcaggtcgtatgcaaaaaataccgcgggttcacgatccccgaagcctttcgcggcgtgcatcgctatctgagcaacgcttacgctcgcgaggagtttgcgtccacttgtccagatgacgaggaaattgagctggcctacgaacaggtggccaaggcactaaaatag

SEQ ID NO: 24980 - DNA, 726 bp, Artificial Sequence
  Description of Artificial Sequence: Synthetic coding sequence
atggctgaggagcagccacaggtggaactgttcgtaaaagcgggctcggatggagcaaagatcgggaactgtcctttttctcaacgtctgtttatggtcctgtggctgaagggcgtgacctttaacgtgacaaccgtcgacactaaacgaagaaccgagacagtgcagaaactgtgtccaggcggccagcttcctttcctgctctacgggaccgaagtgcatacagatactaacaaaattgaggagtttctggaggctgtgctgtgccctcctagataccccaagttggctgccctgaacccagagtccaatacggccggactcgatatctttgccaaatttagcgcttatatcaagaactcaaaccccgctctgaatgacaacctcgaaaagggacttctaaaagcgcttaaggtgctagacaattacctcacttcccccctgccagaggaagtggatgaaaccagcgccgaagatgagggggtttctcagcgaaaattcctggacggcaacgaactgactctggccgattgcaatttgttgcctaagcttcacattgttcaggtagtctgtaaaaagtacagagggttcactattcccgaggcattcagaggtgtgcataggtatctgagcaatgcgtacgcacgggaggagttcgccagtacatgtccggacgatgaagaaatcgagctcgcctatgaacaagtagccaaggctttgaagtag

SEQ ID NO: 24981 - DNA, 726 bp, Artificial Sequence
  Description of Artificial Sequence: Synthetic coding sequence
atggctgaggaacaaccccaggtcgaacttttcgtcaaagcgggcagtgacggcgcgaaaatcggtaactgcccattcagccagagattgtttatggtcctatggcttaagggcgtaactttcaatgtaactactgtggacactaaaagacgtactgaaaccgtgcagaaactgtgtcccggcggacaactgcccttcttgctgtacggcactgaagtccacaccgacacaaataagatagaggagtttttggaagctgtgttgtgccccccacgatatccaaagctcgccgctctcaatccagaaagtaatacggcaggcctggatatattcgctaagttttcggcatatatcaagaatagtaatccagctctcaacgacaacttggagaagggcttactcaaagctctcaaggtgctggataactacctcacctcccctctgcctgaagaagtggatgaaacctccgccgaagatgagggagtcagccaacggaagttcctcgacggcaatgaactgactctcgcagactgtaacctcctgcctaagctgcacatcgtccaggtggtgtgcaagaaatacagaggtttcacgatccccgaagcctttaggggcgtacaccgctatctttcaaatgcctacgcccgggaggaatttgcaagcacgtgtcccgatgatgaggaaattgagctggcctatgagcaagttgccaaagcactcaaatag

SEQ ID NO: 24982 - DNA, 726 bp, Artificial Sequence
  Description of Artificial Sequence: Synthetic coding sequence
atggcagaggagcagccgcaggtggaactcttcgtaaaggccggctcagacggcgccaaaattggcaattgtccgttctctcaacgcctgttcatggtcctctggttaaaaggcgttaccttcaatgtaaccacagtcgacacaaaacgacggactgagacggtgcagaaactgtgccctggaggccaactcccctttcttctctacggtaccgaggtgcacacagatactaacaaaatagaagaatttcttgaagcagtactgtgtcccccacggtaccccaaattggccgctctcaatcccgaatctaacactgctggcctcgatatattcgctaaattttcggcctacatcaaaaattcaaaccccgccttaaatgacaaccttgagaagggcctgctaaaggccctgaaagtgttggacaactatctgacatccccacttccagaagaggtggacgaaacctcagcagaggatgaaggagtgtcccagcgaaagtttttagatggcaacgaacttaccctcgctgattgcaacctgctccccaaacttcacatagtgcaagttgtttgcaaaaaatatcgggggtttaccataccagaagcctttcgcggggtgcacagatatctctccaacgcctacgcccgggaggagttcgctagtacatgccctgacgatgaagagattgagttagcatacgaacaggtggccaaagccctgaagtag

SEQ ID NO: 24983 - DNA, 726 bp, Artificial Sequence
  Description of Artificial Sequence: Synthetic coding sequence
atggccgaggagcaacctcaagtcgagcttttcgtaaaggctggctcagacggagctaaaatcggtaactgccctttttcgcagaggcttttcatggtgttgtggctgaaaggcgtgacatttaatgtcaccaccgtggacaccaagcggagaacagaaaccgtgcaaaaactgtgcccaggcggccaactgcccttcctcctgtacggcacagaagtacatactgatacgaataagatcgaagagtttcttgaagcggtgctgtgtcccccccgctacccaaagttagccgccttaaacccggaatcaaatacagctggcctagatatcttcgcaaagtttagtgcttatatcaaaaattcgaatcccgccctgaacgacaacctggaaaagggattgctgaaagccctcaaagtgctggacaattatctcaccagccccctgcctgaagaagttgacgagacatccgccgaggacgaaggggtgagccagaggaagttccttgacggaaacgaattgacattggctgattgtaaccttctgcctaagttgcacattgtgcaggtggtgtgcaagaagtacagggggtttactatcccagaggcttttcggggagtgcacaggtatttatccaacgcctatgcacgtgaagaattcgcctcaacctgccccgatgacgaggagattgaactggcatatgagcaagtcgccaaagccctgaagtag

SEQ ID NO: 24984 - DNA, 726 bp, Artificial Sequence
  Description of Artificial Sequence: Synthetic coding sequence
atggccgaggaacaaccacaggttgagttgtttgtcaaagcaggaagtgatggggcgaagattggcaattgccctttctcacagcgcctattcatggtcttgtggctgaaaggggtgacatttaatgttacgactgtggatacaaaacgcagaacagagaccgtgcagaagttatgcccagggggccagttaccctttctgctgtacggtacagaggtgcacaccgatactaacaaaatcgaagaattcctggaggcggtcttgtgcccaccacgttatccaaaactggcagctttaaatccagagagtaatactgctggcctggacatattcgctaaattcagtgcctatatcaagaattccaacccagccttgaatgacaacctcgagaaaggattactcaaggctctcaaggtccttgataactatctgacatcaccgctacccgaagaagtcgacgaaacatccgccgaagatgagggcgtcagtcaacgtaaatttctggacggtaacgaactcactctggctgactgcaacctacttcctaaattacatattgtgcaggtcgtgtgcaagaagtacaggggtttcactatccccgaggctttcagaggcgttcaccggtacctgagtaacgcctatgcacgagaagaattcgcgtcaacctgcccagatgacgaggagatcgagctggcatacgagcaggtggctaaagccctgaaatag

SEQ ID NO: 24985 - DNA, 726 bp, Artificial Sequence
  Description of Artificial Sequence: Synthetic coding sequence
atggctgaggaacagccccaggtggagctttttgtcaaagcaggcagcgatggggctaagatcggcaactgccccttttctcagagactgtttatggtgctgtggctcaagggagtaacttttaacgtcacaacagtggacactaagcgccgcacagaaactgtccagaaactctgcccaggcgggcagctgccgtttctgttgtacgggaccgaagtgcatacggacacaaacaagatcgaagagtttctcgaagctgtgctgtgcccaccaaggtatcccaagctggcggctctgaacccggagtctaatactgcaggcctcgatatctttgccaagttctctgcatacattaagaattccaaccccgccctgaacgataacctcgagaaaggtctcttgaaagctttgaaggttctcgataactaccttacgagtcctctgccagaagaggtggatgagacttctgcagaagatgagggtgtctcccaaaggaaattcctagatggtaatgaactcacgctggccgattgtaatctgcttcccaaattgcatatcgtgcaagttgtgtgtaaaaagtaccggggctttacaatacccgaggcctttaggggagtgcatcggtatctcagtaatgcatatgcccgagaagagtttgccagcacttgtccagatgacgaggagatcgagctcgcatacgaacaagtagccaaagcactcaagtag

SEQ ID NO: 24986 - DNA, 726 bp, Artificial Sequence
  Description of Artificial Sequence: Synthetic coding sequence
atggccgaggaacagcctcaggtcgagctgtttgtgaaagctggctcggatggcgccaagattggcaattgccctttttcacaacgcctatttatggttctgtggttgaagggagtaacctttaatgtaacaactgtggataccaagagacggaccgaaacggtacaaaagttgtgcccgggaggccagctccctttcttactgtacgggacggaagttcatactgacaccaataagatcgaagaattccttgaggcagttttgtgccctcctcgatatcctaaattggcggccttgaatccagagtcaaataccgctgggctggatatcttcgccaagtttagtgcatacattaagaacagtaatcccgccctaaatgataaccttgagaaagggcttctgaaggcgctaaaggtcctggacaattatctaacatcaccgctcccggaagaggtggatgagacatccgcagaggacgagggagtgtcacagaggaaattcctggacgggaatgaacttacattagctgattgtaacttgctccccaagttgcacatcgttcaggtcgtgtgtaaaaaatatcggggatttaccatccctgaggcctttcggggggtgcaccgctaccttagcaatgcctatgcgagagaagagttcgcctctacttgccctgacgatgaggaaatcgaactggcctatgaacaggtcgcaaaggcattaaagtag

SEQ ID NO: 24987 - DNA, 726 bp, Artificial Sequence
  Description of Artificial Sequence: Synthetic coding sequence
atggctgaggaacaaccccaggtcgaactctttgtgaaagcaggaagcgacggcgctaagatcggaaactgtccatttagtcagcgtctctttatggtgctttggctcaagggcgtgactttcaatgtgaccaccgtcgacactaaacgaaggacggagacagtgcagaagctgtgtcccggcggccaactgcccttcctcttgtacggtactgaagtgcacaccgataccaataagatagaagagtttctcgaagctgtgctgtgccctccgaggtatcctaagctagctgctcttaaccccgagtctaacacagctggtcttgacatcttcgccaagttctcggcatatatcaagaatagcaatccagccctgaacgataacttggaaaaaggtctcctgaaggcactgaaggtacttgacaactacctgacttcccccttgccggaggaagtggacgagacttctgcagaagacgaaggtgtgtcacagcgaaaatttttggacggaaacgaacttaccttggcggactgtaatcttctgccaaagttgcacattgttcaagtagtgtgcaagaagtatcgcggctttaccatacctgaagccttccgcggggtgcatcgctaccttagtaatgcctacgcccgggaagaattcgcgtcaacgtgtcccgacgatgaggagatcgagcttgcttatgaacaggtcgcgaaagcgttaaagtag

SEQ ID NO: 24988 - DNA, 726 bp, Artificial Sequence
  Description of Artificial Sequence: Synthetic coding sequence
atggcggaggagcagccacaagtcgaactgttcgtgaaagcgggctctgacggcgccaaaattggcaactgtccgttctcacagaggctgtttatggtgttatggcttaagggtgttacattcaatgtgactacagtcgataccaagagacgaactgagacagtacaaaagttgtgccctggtggccagcttcctttcctgttatacggtaccgaagtgcacaccgacacgaacaagattgaggagtttctagaagcggtgctttgcccgcctcgttaccctaaactggctgcattgaaccccgaaagcaatacagccggcctggatatttttgccaaattctcagcctacattaaaaacagcaatcctgcactcaacgacaatcttgagaaaggtcttttgaaggccctgaaggtcctagataattacctcacctcccctctccccgaggaagttgacgagacatcagccgaagatgagggtgtgagccaacgaaaatttctagacggcaatgaactgactctggccgactgtaatctcttgcctaaactacacattgtgcaagttgtttgcaaaaagtatcggggattcaccatccctgaggccttccggggggtccacagatacctgtccaatgcttacgctagagaggaattcgcttctacatgcccagacgatgaggaaattgaattagcttacgagcaggtggcaaaagccctcaaatag

SEQ ID NO: 24989 - DNA, 726 bp, Artificial Sequence
  Description of Artificial Sequence: Synthetic coding sequence
atggcagaggaacagccgcaggtggagttatttgtaaaggctggttcagatggtgcaaagatcgggaattgtcccttttcacagaggctttttatggtgctctggctgaagggcgtcacgttcaatgtcactacagttgatactaagcgacgcacagagactgtgcagaagctctgcccaggaggacagctgccttttctgctgtatgggacagaggtgcacactgatacaaacaaaattgaggaattcctggaagccgtgttgtgcccacccaggtatcccaagctcgccgcccttaaccccgagtccaataccgctggcctggacatctttgctaagttcagtgcgtatatcaaaaactccaaccccgctctaaacgataatctggagaaaggtcttttaaaggcactgaaagtgcttgataactatcttacctctcccctacctgaagaggtggacgaaacttcagctgaggatgaaggggtgtcccagcgcaaattcctggacggtaacgagttaactcttgcagattgtaacctcctcccaaaactccacatagtccaggtggtctgtaagaagtacaggggcttcacaatccccgaagccttccgaggcgttcacaggtatctgagcaatgcgtacgcccgtgaggagtttgccagcacatgtccggatgacgaggagatagagctggcttacgaacaggtggctaaggcactgaagtag

SEQ ID NO: 24990 - DNA, 726 bp, Artificial Sequence
  Description of Artificial Sequence: Synthetic coding sequence
atggctgaagagcagccccaggtcgagctgtttgttaaggccggctcagacggagcaaaaattggcaattgtccgttcagtcagcgactgttcatggtgctatggttaaaaggggtcacattcaatgtgacaactgtggacaccaaaaggcgtacagagaccgtccagaaactgtgccccggtggccagctccccttcctgctgtacggcactgaagtccatactgatacaaataagattgaggagtttctggaagccgtgttgtgcccacctcgatatcctaaattagccgcccttaaccccgagagtaacaccgccggattagacatttttgccaaattctctgcctatatcaagaattctaatcccgctctgaacgacaatctagagaaggggctccttaaagctctgaaggtgctcgacaattacctgacttcacccttgcccgaggaagtggacgagactagtgcggaggacgaaggagtgagccaaagaaagtttttggatggcaatgagctgacccttgcggattgcaatctgcttcccaagttacatattgtgcaggtggtttgtaaaaaataccggggctttaccattcctgaagcctttagaggagtgcacaggtacctgagtaacgcttacgctcgagaggaatttgcttccacatgccctgatgatgaggagatcgagctggcctacgagcaggtggccaaagcactgaaatag

SEQ ID NO: 24991 - DNA, 744 bp, Artificial Sequence
  Description of Artificial Sequence: Synthetic coding sequence
atgtctgggctgagacccgggactcaagtcgatcccgagatagaactgttcgttaaagccgggagcgacggcgagagtattgggaactgtcccttttgtcagaggctgttcatgatcctttggctcaaaggagtcaagtttaacgttaccacggtcgatatgactaggaagccagaggagctcaaagatttggcaccggggaccaacccgccttttttggtctataacaaggaattaaaaaccgacttcatcaagatcgaggagttcctggaacaaacgctggccccacccaggtacccccaccttagtcccaagtacaaagagagcttcgacgtggggtgcaatctcttcgcgaagtttagcgcctacattaagaatacacagaaagaggccaacaaaaattttgagaagtccctcctcaaagaatttaagcgcctcgacgattacttgaatacgcccctactcgatgaaatcgatccggactccgccgaagagcctcccgtgtctcgtcgacttttcctggacggggatcagctgacactcgcagattgtagtctcctgccgaaacttaatattatcaaagtagccgcaaaaaaatatagagattttgacataccagccgagttctctggagtgtggcggtacctgcacaacgcatatgctcgcgaagagtttactcacacttgccctgaagacaaggagatcgagaacacatatgcgaatgtggcgaaacagaaaagttag

SEQ ID NO: 24992 - DNA, 762 bp, Artificial Sequence
  Description of Artificial Sequence: Synthetic coding sequence
atggccttgagcatgcccctcaacggcctgaaagaggaagataaggagcctctaatcgagttgttcgttaaagctggttcagatggtgagtcaatcggcaattgtcctttctcccaacgcctcttcatgatactgtggctgaagggcgttgtattcagtgtgactaccgtggatttaaaacgcaaacctgcagacttacagaacttagctcccgggacccatccaccatttatcactttcaactcagaggtgaagacagatgtgaataaaatcgaggaattcttagaagaggtgctctgccctccaaagtacctgaaactttcccccaaacaccccgagtcgaatactgctggaatggacatttttgctaaatttagcgcctacatcaagaacagccgccctgaagcgaacgaagctctggaacgtggcttgcttaagacactgcagaagttggacgagtatctgaactctccactgcccgatgagatcgacgagaattccatggaggatataaaatttagtactagaaagtttcttgacggaaatgagatgaccctcgccgattgtaatctgcttccaaaactacatattgttaaagttgtcgcaaagaagtacaggaatttcgatatccccaaggaaatgactgggatctggcgatatctgaccaacgcttactctagagacgaatttactaacacctgcccttcagataaagaagttgagatcgcctactcagacgtcgctaagagactgacaaagtag

SEQ ID NO: 24993 - DNA, 624 bp, Artificial Sequence
  Description of Artificial Sequence: Synthetic coding sequence
atggctctctccatgccgcttaatgggctgaaggaggaggacaaggagccacttattgagctcttcgttaaagcaggaagtgacggcgagtcaatcggcaactgtccatttagtcagcgtttgttcatgattctttggcttaaaggagtggtcttttcggtcacgactgtggatctcaagcggaaacccgcggatctgcagaacctcgctcctggaacccatcccccgtttatcaccttcaattctgaagtaaagactgatgtcaataaaatagaggagtttctagaagaagtgctgtgccccccaaagtatttgaaactgtctcctaagcaccccgaatcaaatacagctggcatggacatattcgcgaaattttcggcctatatcaagaattcccggcccgaggccaatgaggcattagaaaggggactgctcaaaaccctgcagaaactggacgaatacctaaacagtccactgcccgatgaaattgacgaaaactccatggaggatatcaagttttccacccggaagttcctggatggtaacgagatgacgcttgcagactgcaacttattgcccaaactccatatagtgaaagtcgtagccaagatcagtcagttatag

SEQ ID NO: 24994 - DNA, 762 bp, Artificial Sequence
  Description of Artificial Sequence: Synthetic coding sequence
atggcactatccatgcccctgaacggtctcaaagaagaggataaggagccattgatcgagttatttgtaaaagcagggtccgacggtgaaagcattggaaactgcccgttcagccagagactcttcatgatcttatggctgaaaggcgtggtcttttcggtcacgacagttgatttgaagcggaagccagctgatctgcagaacctggctccaggaacccatccacccttcattacattcaactcggaagtgaagaccgatgtgaacaaaattgaggaattccttgaggaggtcctatgcccgcccaagtacctgaagctttcaccaaaacacccagagagcaatactgcaggaatggatatcttcgcaaagttctccgcatatatcaaaaatagccgtcccgaggccaacgaggcccttgagcggggccttctcaaaacgctgcagaagctggacgagtatctcaacagccccctgccagacgagattgatgagaattccatggaggacatcaagttttccacgcgtaagttcctggatgggaatgaaatgacccttgcggactgcaatttgctgccaaagcttcatatcgtcaaggtcgtggccaaaaagtatcgaaacttcgacattcctaaggagatgaccggcatttggaggtacctgaccaatgcctacagtcgcgatgagttcactaatacctgtcctagcgacaaggaagtcgagatcgcttacagcgatgtcgccaaaagacttacaaagtag

SEQ ID NO: 24995 - DNA, 2061 bp, Artificial Sequence
  Description of Artificial Sequence: Synthetic coding sequence
atggccgaggctgccgagcccgaaggggtcgcaccaggcccgcagggaccccctgaggtgcctgctcccttagccgagaggcctggggagcctggggccgcaggcggcgaagctgaaggccccgaaggcagcgaaggagctgaagaggctccacggggtgcagcagccgtgaaagaagctggtggcggaggacctgatcgtggtcccgaagccgaagcaaggggtacacgaggggcccacggtgagacagaagcggaggagggagcccccgagggagccgaagtcccacaggggggcgaggagacatccggagcccagcaggtggaaggagcaagtccgggtagaggggcacagggtgagccccgtggggaggcccagagagagcctgaggacagtgccgctcccgagcgccaagaagaagctgagcagaggccagaagttccagagggaagtgcatccggcgaggcgggggactctgtcgacgctgagggtcctttgggggataatatcgaagcagagggccccgcaggtgattccgtggaagccgagggaagggtaggagattcagtggatgccgaaggaccagccggcgattccgtggatgccgaggggcctttgggagacaatatacaggccgaaggtccagcaggcgattctgtggacgcagaggggcgcgtgggtgatagcgtcgatgccgagggacctgccggagactctgttgacgccgaaggacgggtaggtgacagcgttgaagccggcgatccagctggggacggcgtggaagctggcgttcctgccggtgacagcgttgaggctgaaggcccagccggcgactccatggacgccgagggaccagctgggcgggcacggcgtgtgtccggagagccccaacaatctggagacggctcattgtcacctcaagcagaagccattgaagtcgccgcaggcgagagcgccgggcgtagtccaggagagctggcttgggacgcagccgaggaggctgaggtgcccggcgttaaagggagtgaagaagcggcacccggcgacgcacgtgccgacgctggtgaggaccgcgtgggggacggaccgcagcaagagccaggggaggacgaagagcgccgagagagaagccctgaaggccctagagaggaagaggcagccggaggagaagaagagtccccggatagttccccccacggagaagctagtcggggtgccgccgagcctgaagcccaactttcgaatcatctagcggaggagggccctgctgagggctccggagaggctgctcgcgttaacgggagaagagaggacggggaagccagcgaacctcgggctctcggacaggagcatgacatcactctattcgttaaggctggctacgatggagagtccattggaaattgccctttttcgcagaggctgtttatgattctgtggctcaagggtgtcatttttaacgtgacaactgttgacttaaaacggaagccggcagacctacagaatcttgcccctggcacgaatccaccctttatgacctttgatggggaagtgaagacggatgtcaacaagatagaagaatttctcgaggaaaaattggccccgccgagatatcctaaactcggaacacagcacccggaatccaattccgctgggaatgatgtatttgctaaattcagcgccttcatcaaaaacacaaaaaaggatgccaacgaaattcatgaaaaaaacttactgaaggccctgcggaaattagacaactatctcaactccccattaccagatgaaattgacgcctactccacagaagatgtcacggtatctggtaggaagttccttgacggcgatgaactaaccctcgctgactgtaacctgctgccaaaattacacatcatcaagatagtggccaagaaatacagagactttgagtttccaagcgaaatgaccggcatttggcggtatttgaacaatgcgtatgctcgggatgagttcacgaatacgtgccctgctgatcaagagatcgagcatgcttactccgatgtggccaagcggatgaaatag

SEQ ID NO: 24996 - DNA, 2115 bp, Artificial Sequence
  Description of Artificial Sequence: Synthetic coding sequence
atggcagaagcagccgaaccagagggcgtagcccccgggcctcagggacctcctgaagtccccgccccccttgccgagaggccaggagagcctggtgcagcaggcggagaagcagagggtcccgagggtagtgagggtgctgaagaggcaccccgcggggctgcggccgttaaggaggcaggcggcggagggccagaccgtggccccgaggctgaggctcgaggcacacgcggcgcacacggcgagactgaagctgaagagggagcacctgagggcgcagaggtaccccaggggggagaagagactagcggagcccagcaagttgaaggtgccagcccaggacgtggggcacagggggagccaaggggggaagcgcagcgcgagcccgaagattcagccgcacctgaacggcaggaagaggctgagcagcggcccgaagtacctgaaggctcagcttccggcgaggcaggcgatagcgtggacgcagagggaccgctgggagataatattgaggctgagggtccagccggtgattccgttgaggctgagggaagggtgggggactcggtcgatgctgaggggccagccggcgattccgtggatgctgagggcccgctgggcgataacatccaagccgaagggcctgcgggcgacagtgtcgacgccgagggccgggtaggcgacagcgtcgacgcagaaggcccagctggcgacagtgtggacgctgaagggagggtgggggactcagttgaggccggagatcccgccggcgacggagtggaagcaggagttcctgcaggtgactccgtggaagccgaggggccagccggtgactctatggacgctgagggacctgctggacgggctcggagggtatccggcgagccacagcagtcaggggatggcagcctctccccgcaggcggaggcgatcgaagtcgcagctggcgagtccgccgggcgcagcccaggcgagctggcttgggacgcggctgaagaggctgaagtcccaggcgtgaaaggaagtgaagaagcagccccaggggatgcccgggccgacgctggcgaggacagagtgggcgacggtcctcaacaagaacctggggaggacgaagagcgcagggagagatcacccgaaggaccacgagaagaggaagctgcaggtggggaggaggagagcccagacagctccccccacggagaggcgagtcgcggggctgccgaaccggaagcccagctgtccaatcatctggccgaggaggggcctgccgagggatccggcgaagcggcacgggtgaatggaagaagggaggatggggaggcaagtgaaccgcgcgcccttggacaggaacacgacatcacattgtttgtcaaagtgaagttgaccgcgttggggtgtagccggattgctatcaagaaatatctgcgggccggttatgatggagaaagcatcggaaattgtccgttcagtcagaggttgttcatgattctctggctgaaaggcgtgatttttaatgtcacaactgtggacctgaaacggaagcccgcagacctgcagaatctggcccccggaaccaaccctcctttcatgactttcgacggtgaggtaaaaacggacgtgaataagatcgaggagttcctcgaggaaaaattagcacctccgagatacccaaaactgggcacacaacaccctgaaagcaacagtgccgggaacgatgtgttcgctaagttctccgcatttatcaaaaatacaaagaaggacgccaatgagatccacgagaagaacctattaaaagctctgcgtaagctggacaattacttgaacagtcccctgcctgatgaaatagatgcctactccaccgaagacgtcacggtgtctgggcgcaaattcctggatggagacgagctgaccctagccgactgtaatctgctccccaagcttcatatcataaagattgtagctaagaaataccgagactttgaattcccctcagagatgactggcatctggaggtatttgaacaacgcctatgctagggacgagtttacaaatacctgcccagcggaccaggagatcgaacacgcgtactccgatgtggccaagagaatgaagtag

SEQ ID NO: 24997 - DNA, 1785 bp, Artificial Sequence
  Description of Artificial Sequence: Synthetic coding sequence
atgtggtgccttttacggggactcggtagaccgggggcacttgccaggggggccctgggccagcagcagtctctcggagcacgtgcactggcgtctgctggatccgaatcgcgcgatgagtacagctatgttgttgtgggggctggctctgccggctgcgtacttgccggcagattgacagaagatccagccgagagagttttgttgctggaggccggaccaaaagatgtccttgcagggagtaagagactcagttggaaaatccacatgccagccgccctggtcgctaacctgtgcgacgacaggtataattggtgctaccacacagaggttcagcgagggctagatggtcgcgtgctgtactggccccgtggacgcgtgtggggcggtagcagtagcctgaatgccatggtgtatgtgaggggccacgccgaggactatgagcgctggcagaggcagggtgcgagagggtgggattacgcacattgccttccatattttcgcaaggcccagggacacgagctcggcgcctcgcgttacagaggagccgacgggcccctacgcgtgtcgcgaggcaagaccaaccaccccctccattgcgcttttctggaggcaacccagcaggcagggtatcccctgactgaagacatgaatggcttccaacaggagggcttcggatggatggatatgactattcatgagggcaaaagatggtcagccgcctgcgcctacctgcatcccgctctaagcaggaccaacttaaaggctgaggccgaaaccttggtgagccgggtcctgttcgaggggacaagagctgtgggcgttgaatatgttaagaacgggcagtcccatagagcctacgcctctaaagaagtgatactgtccggaggagcaataaattcccctcagctgcttatgctttccggtatcggcaacgccgatgatttgaaaaaactcggaatccctgtggtgtgtcacctgcccggcgtcggtcaaaaccttcaagatcacctggaaatatatattcagcaggcctgcacgcgacccattacgctacatagtgcacagaagccactgcgtaaggtgtgcatcgggcttgaatggctctggaagtttacaggagagggagccactgcacatctggagactggcggctttattcgcagccagcctggggtcccacaccctgatatccaatttcattttctgccaagtcaagtgatcgaccacgggcgggttcccacgcaacaggaagcataccaagtgcatgtgggaccaatgcgcggtaccagcgtcggttggctcaagctgcgatctgccaatcctcaggatcaccccgttatccagcccaattacctgtccacagagacggatattgaggatttcagactctgcgttaagctgactagggagatcttcgcacaggaggctctggcgccatttcggggcaaggagcttcagcctggctcacacatacagtctgataaggaaatcgatgcattcgttagggctaaagctgattctgcataccatcccagttgtacctgcaagatgggacagcctagtgatcccacagctgtcgtcgatccacagactcgggtgctgggtgtggaaaacctgcgagttgtagatgcatccatcatgccgagcatggtgtctggcaacttgaacgcccctactatcatgatcgcagagaaggccgccgatattatcaaaggacaaccggccctctgggataaagacgttccagtttacaagccgaggacccttgcgacgcagcgttag

SEQ ID NO: 24998 - DNA, 381 bp, Artificial Sequence
  Description of Artificial Sequence: Synthetic coding sequence
atgtggtgtttactccgtggtctgggccgaccaggggcattagcacgcggggcacttggacagcaacagtctctcggagcacgagcactggcttctgcagggagtgagtctagggatgaatactcttatgtggtggtcggcgccggctctgctgggtgcgtactagcaggccggttgacagaagacccagccgagcgcgttctgttgctggaagccggccctaaggatgtactcgcgggctcaaaaaggcttagctggaagatccatatgccggcggcccttgtggctaatctgtgcgatgaccgctacaactggtgctaccatactgaggttcagagaggattagacggacgggttctttattggcctcggggaagatag

SEQ ID NO: 24999 - DNA, 468 bp, Artificial Sequence
  Description of Artificial Sequence: Synthetic coding sequence
atgtggtgcctgctgcgcggcctgggccgcccaggtgccctggcccggggagccctgggccagcagcagtcacttggtgctcgtgcgctcgccagcgctggcagtgaaagtcgagatgagtatagctacgtggtggtcggcgctgggagcgctggatgcgtcctggccggtagactcactgaggatcctgctgagagagtgctgcttcttgaagcaggtcccaaagatgttttggcggggtctaaacgcttgtcctggaagatacatatgcccgctgccctggtagcaaatctgtgtgacgaccggtataactggtgttaccacacggaagtgcagaggggacttgacgggcgggtcctgtactggcctagaggaagagtgtggggagggtccagcagcctcaatgccatggtttatgttcggggccacgccgaagattacgaacggtggcagagacagggagcttag

SEQ ID NO: 25000 - DNA, 1023 bp, Artificial Sequence
  Description of Artificial Sequence: Synthetic coding sequence
atgggagaaatggaacagctgcgccaggaggccgagcagcttaaaaaacagattgccgacgccaggaaagcttgcgctgacgtgactcttgctgaacttgtgtccggactggaagtcgtgggcagagtccagatgaggaccaggaggaccctgcgcgggcatctggcaaaaatttatgcgatgcactgggccaccgatagcaagctgttggtgagtgccagccaagatggaaagttgatagtatgggactcctacacgaccaacaaagtgcatgccatacctctaaggagctcctgggtgatgacatgtgcctacgcaccaagtgggaactttgtggcatgcggggggctcgataacatgtgctccatctacaacttaaaatcgagggagggtaatgttaaggtaagtagagaactttctgcgcacacaggctacctgagttgttgccgtttccttgatgacaataatattgtaacttcttctggcgacacaacctgcgccctgtgggatatcgagacaggccagcagaagacagtgttcgtcgggcatacaggggactgtatgtcactggctgtttcacccgactttaacctattcatcagcggggcatgtgatgccagtgctaagctgtgggatgtgcgtgaaggaacttgccgacagacattcactggtcatgagtcggacatcaatgccatctgtttttttcctaacggcgaggctatatgcaccggttccgacgatgcatcttgccggcttttcgacctcagggccgaccaggaacttatatgtttctcacacgaatcgatcatctgcggcatcacgagcgtggctttctctctgtccgggcgtcttttgtttgctggctatgacgacttcaactgcaacgtgtgggatagcatgaagtcggaacgggtgggcattttgtcgggccacgacaatagggtgtcctgcctcggggtcacggctgacggcatggccgtggcaaccggctcctgggactccttccttaagatctggaactag

SEQ ID NO: 25001 - DNA, 696 bp, Artificial Sequence
  Description of Artificial Sequence: Synthetic coding sequence
atgttcgtgttctactgtgcccattggcagacttacgtaagtggcatgctgagattcggcaaagtggacgtcactgaaattcagattgccctggttatagtctttgtgttgtccgccttcggcggggccaccatgtgggactatacaattccaatcctagaaattaagctgaagatcctgcctgtcctgggcttccttggaggagttatatttagctgctctaattactttcacgtcattttgcacggaggcgtgggaaagaatggatccaccatcgccggcactagtgttttgtcccccggactgcacatcggtttaattattatcctagctatcatgatctataagaagtctgcgacagacgtgtttgagaagcacccttgtctctacatcctgatgttcggatgtgtttttgctaaggtttctcagaagctggtcgtcgctcacatgaccaaatcagagttgtacctgcaggacactgtatttctggggcccggcttgctgttcctggatcagtactttaacaatttcatagatgagtatgtggtgctttggatggcgatggttattagctcttttgatatggtaatatacttttcggcattatgcctacagattagcaggcacctgcacctgaacatcttcaagactgcgtgtcaccaggcccccgagcaggttcacaaacatatcgactag

SEQ ID NO: 25002 - DNA, 1251 bp, Artificial Sequence
  Description of Artificial Sequence: Synthetic coding sequence
atgtccggacataggagtacaagaaagaggtgtggagattctcatcctgaaagtcctgttggcttcgggcacatgtctacgaccggctgtgttctgaacaaactgtttcagctgcctaccccccccctctcccgccaccaactcaagagactggaggagcatcgatatcagtccgcaggacgaagcttgcttgagccattgatgcagggctactgggaatggctagtgaggagggttccatcctggatcgctccaaacctgatcacgattattgggttaagcatcaatatctgtacgactatcctgctagtgttctactgcccaactgctactgagcaggctccgctctgggcctatatagcatgtgcttgtggcctatttatatatcagtctctagatgcgatcgatggtaaacaggcccgacggaccaactccagttcaccgctcggagagctatttgaccacggctgcgattcgctgtccactgtgttcgtcgtgttaggcacttgcattgccgttcagctcggaaccaaccccgactggatgtttttctgctgtttcgctggtactttcatgttctactgtgcacactggcagacatacgtaagtggaaccctccggtttggtattattgatgtcacggaggttcagatttttatcattataatgcacttgctcgcagtgattggtggtcctcctttttggcagtccatgattcctgtgctcaatattcagatgaaaatcttccccgcactgtgtacagtggctggtactatcttcagttgcactaattacttcagagtgatcttcaccggtggagtaggcaagaatgggagcactattgctggcaccagcgtccttagcccttttctccatataggcagcgtgatcacattagccgcaatgatctacaaaaagagcgccgtgcaactcttcgagaagcacccatgtttatacatcctgacatttgggtttgttagcgcaaagatcacaaataagctagtggtggcccatatgacaaagagtgaaatgcacctccatgataccgctttcatcggaccggctctcttgttcttggaccagtactttaattcattcatcgatgagtacatcgttctgtggattgctctcgtgtttagtttctttgatctgattcgttactgtgtgtccgtttgtaaccagattgcctctcaccttcacatacacgtgttccgcattaaggtatccaccgcacactctaaccaccactag

SEQ ID NO: 25003 - DNA, 1251 bp, Artificial Sequence
  Description of Artificial Sequence: Synthetic coding sequence
atgagcggccatagatccaccaggaagcggtgcggtgactcacacccagaaagccctgtgggatttggccatatgtctactaccggctgtgtgctgaacaagctcttccaattacctacaccacccctatctaggcaccagctgaaacggctcgaagagcacagataccagtcggctggccgatcactgcttgagccgctcatgcagggctattgggaatggctcgtccggagggtcccgagttggatcgcacctaatcttatcaccatcatcggactctcgatcaacatctgtaccactatcctccttgttttctactgcccaaccgctactgagcaggctcccctgtgggcatacattgcttgtgcctgtgggttatttatataccaaagcctggacgccattgacgggaagcaggctaggaggactaactcatcaagccccctaggagagctgtttgatcacgggtgtgactccctttcaaccgtgttcgtcgtgctggggacttgcatagcagtgcagctaggaacaaaccccgattggatgttcttttgttgtttcgccgggactttcatgttctactgcgcacactggcagacctacgtgtcaggaaccctgaggttcgggattatcgacgtaacggaagtccagatctttatcatcatcatgcacctgctagcagtgataggtggcccccctttttggcaatctatgatccctgttttaaatattcagatgaagatcttccccgcactgtgcacagtggctggcactattttctcttgcaccaattattttagggtcatttttactggtggggtcggcaagaatggctccacgattgctgggaccagcgttctgagcccctttctacacataggaagcgtgataaccctcgcggccatgatctacaaaaagagtgctgtacagctgtttgagaagcacccttgcctttacatcctgaccttcggcttcgtctcagcaaagattacaaataaactggttgtggcccatatgaccaaaagcgagatgcatctccacgacactgcatttataggacccgcactcctctttctagatcaatattttaacagctttatcgacgagtatatagtcttgtggattgcacttgtgttttcattcttcgacctaattcgatactgcgtctctgtttgcaaccagattgcaagccacctgcacattcatgtatttcgcatcaaggtgtccaccgcccactctaaccatcactag

SEQ ID NO: 25004 - DNA, 1599 bp, Artificial Sequence
  Description of Artificial Sequence: Synthetic coding sequence
atgatgatggtgagacgcggacttctggcatggataagccgggtggtcgtcttattagttctgttgtgttgtgccattagcgtgctttatatgctcgcgtgcacgcccaagggtgacgaggagcagctggccctcccccgtgctaatagtcccaccggaaaagagggttatcaagcagtgttacaagagtgggaggaacagcacagaaactacgtgtcctccctgaaaagacagattgctcaactgaaggaggaactgcaggagcgctctgagcaacttcggaatggccaataccaggctagcgatgcagcgggcctcggactggaccggagcccacccgagaaaacccaggcggatctgctcgccttcttgcattcccaggtggataaggctgaagtcaatgcgggtgtgaaactagccacggagtatgctgctgtgcctttcgactcattcactctccagaaggtgtatcagctggagactgggcttacaagacatcctgaggagaagcccgttcggaaagacaagcgagacgagctggtcgaggcaattgagagcgcactggagactttaaacagtccggccgagaattctccaaatcacaggccatacacagcttcggatttcattgagggcatctaccggactgagcgtgataagggtacactgtatgagctaactttcaagggtgaccacaagcacgagttcaaaaggcttattttgttcaggcccttcgggcccatcatgaaagtgaaaaacgagaagctaaacatggcaaacactctgatcaacgttatcgtgccccttgcaaagagggtcgacaagttccggcagtttatgcagaattttcgggaaatgtgtatcgaacaggacggacgtgtccatctgacagtggtctactttggcaaggaagagattaatgaagttaaggggattcttgagaatacctctaaggccgcaaatttccgtaactttacatttatccagctgaacggggaattttctcgtgggaaaggtctcgacgtgggagctcgcttttggaaaggctcaaatgttctgttgttcttttgtgacgtcgatatatattttacaagcgaattcctgaacacatgccgcctaaatactcagcccggcaagaaggtgttctatccggttttgttttcccagtataatcctggcataatttacggacaccacgacgctgtacctcctctggaacagcagctggttatcaagaaggagactgggttttggcgagactttgggtttggaatgacatgtcaataccgcagcgactttatcaatattggcggattcgatcttgacattaaaggctggggcggagaagacgtgcacctgtaccgtaaatacttgcattccaatttgattgtagtgcgaactccggtccgaggcctgttccacctgtggcacgagaaaaggtgtatggatgaattaaccccagaacagtacaaaatgtgtatgcaatctaaagcaatgaatgaagccagccacggacagcttgggatgctggtattcaggcacgagatagaggcccacttgcgaaagcaaaagcagaaaactagctccaaaaaaacatag

SEQ ID NO: 25005 - DNA, 1599 bp, Artificial Sequence
  Description of Artificial Sequence: Synthetic coding sequence
atgatgatggtgcggaggggcctcttggcttggatttcccgagtggttgttctgcttgtactgttatgctgcgctatctctgtcctgtatatgctggcctgcacccctaagggtgatgaagagcagctggccctgcctcgggctaacagccccaccggaaaggagggatatcaggccgtgctgcaggagtgggaggagcagcataggaactacgtgtcctcactcaaacggcagatcgcgcaattaaaagaagaactgcaggaaagatccgaacaactcagaaatggacagtatcaggcatcagacgctgctggactgggattagaccggtctcctccagaaaaaacacaggcagatttactggcttttctgcacagtcaagtggataaggccgaagttaacgcaggagtgaaattggctactgagtacgcagcggtgcccttcgactccttcacccttcagaaggtctaccaactagaaacgggcctgacccgacatcccgaagaaaagcccgtgcgaaaggacaaaagggacgaactggttgaggctattgaatctgcgcttgagacacttaacagtccggccgagaattcgcctaatcataggccatacaccgcttcagattttattgagggaatctacaggaccgaacgagacaaggggactctgtatgagctaacttttaagggagatcacaaacacgagttcaagagattgattttgttccggccattcggcccaatcatgaaggttaagaatgagaagcttaatatggccaataccctgattaatgttatcgtgcccctggccaaaagggtggataaatttagacagtttatgcagaatttccgggaaatgtgcatagagcaggatggcagggtgcaccttacagttgtgtatttcggcaaggaagagatcaacgaagtgaagggcattcttgagaatacgagtaaggctgctaattttagaaattttacattcatccagctgaatggggagttcagcagaggaaaggggttggacgtgggcgcaaggttctggaaaggctccaatgtcctgctctttttctgcgacgtggacatatactttacttccgagttcctaaacacttgcaggctcaatacccagcctggaaagaaggtgttttatcccgtgctcttctcgcagtacaatcctgggataatttacggtcatcatgacgccgtgcccccactcgagcaacagctggtcattaaaaaggaaaccggtttctggcgggatttcggtttcggcatgacgtgtcagtaccgtagcgactttatcaatatcggcggcttcgatctagacataaagggttggggaggggaggacgtccacctgtatcggaagtacctacactccaatttgatcgtggtgcggacacctgtacgaggactctttcacctctggcacgagaagagatgtatggatgaactgactccagagcagtataagatgtgcatgcagagcaaagctatgaatgaggcttctcacggacagctgggaatgctggtgttcaggcatgagattgaagcgcacctgaggaaacagaaacagaaaacatcttcaaaaaagacatag

SEQ ID NO: 25006 - DNA, 1599 bp, Artificial Sequence
  Description of Artificial Sequence: Synthetic coding sequence
atgatgatggtgaggagagggctattggcatggatttctagggtagtggtcctccttgtgcttctgtgctgcgccatttccgtgctgtacatgctggcttgcaccccgaaaggtgacgaggaacagctggctctacccagggcaaacagcccaacggggaaggaggggtaccaggcagtcttgcaggaatgggaagagcagcacagaaattatgtgtcatctctgaagcggcagattgctcaactcaaggaggagctccaagaacgatccgagcagctgaggaacgggcagtaccaggcaagtgacgccgctgggctgggtttggacagaagcccacctgagaagacccaagccgacttgctggcctttctccattcgcaagttgacaaggccgaggtaaatgcaggcgtcaaacttgcgaccgagtacgcagccgtgccatttgatagtttcacactgcaaaaggtgtaccagctcgagacgggcctaacccgccaccccgaggagaagcccgtgcggaaggataaaagagatgaactggtggaggccatcgagagcgccctggaaaccctgaacagtcctgccgagaactcacccaaccatcgcccctatactgccagtgacttcatagagggcatctatcgtacagagcgggataaaggaacactgtacgagttgacctttaaaggggaccataagcatgaattcaagagactgatcttgttccggccctttgggcccataatgaaagttaagaatgagaagctgaatatggctaacaccctgataaacgtaattgtacccttggccaagcgggtggacaagttcagacaattcatgcagaacttccgggagatgtgcatagagcaagacggtcgagttcatttgacggtggtgtacttcggaaaagaggagattaacgaagtgaaagggatcctggaaaatacttcaaaagctgctaacttccgaaattttactttcatccagctgaacggcgagttcagccggggaaagggactcgacgtgggggctcgtttctggaaaggctcaaatgtgctcctatttttttgcgacgtagacatatatttcacatccgaatttttaaatacctgcaggctcaacacacagccaggtaaaaaagttttttatcctgtgctgttctcacaatataaccctgggattatttatggtcaccacgatgctgtgccaccgctggaacagcagctcgtaatcaaaaaggaaaccggtttctggagagacttcggattcggaatgacgtgccagtatagaagcgacttcattaatatcggtgggttcgatttggacatcaaaggctggggcggagaggacgtgcacctatatcgcaagtacctgcactcgaacctgattgtggtgaggactccggtgcgcggtctcttccacctgtggcacgagaaacgctgtatggatgagctgacccccgaacaatacaaaatgtgtatgcagtcaaaggcgatgaacgaggcttctcatggacagctggggatgttggtgtttcgccacgagatcgaagctcacttgcggaaacagaaacagaagaccagcagtaagaagacatag

SEQ ID NO: 25007 - DNA, 291 bp, Artificial Sequence
  Description of Artificial Sequence: Synthetic coding sequence
atgatgatggttcgtcgcgggctgctggcatggatctctcgagtggtggtcctgctcgtcttgttgtgctgcgcgatctcggtgctgtacatgctggcatgcacccccaaaggtgacgaggaacagctggctctgccccgggctaatagccctacagggaaggaaggataccaagccgttctccaggagtgggaggaacaacacagaaattacgtaagctcccttaaacggcaaattgcccagctgaaagaggaactccaagagcgtagcgagcaactccgaaacggctag

SEQ ID NO: 25008 - DNA, 162 bp, Artificial Sequence
  Description of Artificial Sequence: Synthetic coding sequence
atgatgatggtacggagagggttgctcgcatggatcagccgggttgtggtgctattggtgttgctctgttgcgccatatcagtcctgtatatgctcgcttgtacacctaagggagacgaggagcagctggctctgccccgagcaaactccccaacaggatag

SEQ ID NO: 25009 - DNA, 1599 bp, Artificial Sequence
  Description of Artificial Sequence: Synthetic coding sequence
atgatgatggtgaggcgcggtctcctggcctggatttcgagagtcgttgttcttctggtccttctgtgctgtgctatctctgttctgtatatgctagcctgcacacctaagggagatgaggagcaactggcactaccacgcgcaaactctcccaccggcaaagagggctaccaggcagtactccaagagtgggaagaacaacatcgtaattatgtgagtagtctcaagaggcagatcgcacagctgaaagaggagctgcaggagaggagtgaacaattacgaaacggacagtaccaggctagcgacgcagccggccttggcctcgatcgatcaccccctgaaaagactcaagctgacctgttagccttccttcactcacaggtcgataaggccgaagtgaacgccggtgtgaaactggctacagagtacgctgcagtgccgttcgactccttcacactgcagaaggtctaccagctcgaaaccgggctaactaggcaccctgaggaaaaacccgtcaggaaggataagcgcgacgaactcgtcgaggccatcgagtccgccctggaaacactgaactcccctgccgaaaactcacctaatcaccgtccctacaccgcgtcagatttcatagaaggaatttaccgcactgaacgagacaaggggacattgtacgagctcaccttcaaaggggaccacaagcatgaatttaagcgcttaatcctgtttcgaccgtttggcccaatcatgaaggtcaaaaatgagaagctgaatatggccaacactctcattaacgtgattgtcccactggcgaagcgtgttgacaaatttaggcagtttatgcagaatttcagagaaatgtgtattgagcaagacggtcgggtacacctgacggtggtttattttggcaaggaggaaattaatgaggtgaaagggattctcgaaaacacctccaaggccgccaacttcagaaatttcaccttcatccagcttaatggggagttcagccgtgggaagggcctggacgtcggcgccagattttggaaaggcagcaacgtgttactgttcttttgtgatgtggacatctacttcacatcagagttcctcaacacatgcaggcttaatacccagcccgggaaaaaagtgttctatccagtgctcttctctcagtacaaccctggaatcatttacggacatcatgatgctgtcccacctctggagcaacagttggtgataaaaaaggagacaggcttctggagggactttggcttcgggatgacatgtcagtaccggtccgattttataaatataggcggattcgacctggacattaagggctggggcggtgaggacgtgcacctgtatcgaaagtacctacactccaatctgattgtcgtcaggacccctgtgcgtggcctgtttcatctatggcacgagaaacggtgtatggatgaattaacgcccgagcagtataaaatgtgcatgcaatcaaaagcaatgaacgaagccagtcacggacagttgggtatgctcgtgtttcgacatgagattgaggcacacctgcggaagcagaagcagaagaccagctccaagaagacttag

SEQ ID NO: 25010 - DNA, 315 bp, Artificial Sequence
  Description of Artificial Sequence: Synthetic coding sequence
atgatgatggttagacggggactcttggcctggatttctcgcgtcgttgttctgctggttctgttgtgctgtgccatcagtgtgctgtacatgctcgcgtgtacaccaaagggggacgaggagcaattagctctcccccgcgcaaactccccaaccggaaaagaaggctaccaagcagtccttcaggaatgggaagagcagcaccgaaattacgttagcagtttaaagagacaaatcgcacaactcaaggaagagctccaggaacgctcggaacaattgcgcaacggtcagtaccaggctagcgatgcggcctag

SEQ ID NO: 25011 - DNA, 45 bp, Artificial Sequence
  Description of Artificial Sequence: Synthetic coding sequence
atgatgatggtccggagaggactcctcgcctggataagtagatag

SEQ ID NO: 25012 - DNA, 1599 bp, Artificial Sequence
  Description of Artificial Sequence: Synthetic coding sequence
atgatgatggtccggagaggcctgttggcctggatatcccgtgtggttgtgctgctggtactgctgtgctgtgctatctctgtactctacatgcttgcttgcacccccaagggggatgaagaacaacttgcccttccaagagccaattcacctacgggaaaggaagggtaccaggcagtactgcaagagtgggaagagcagcaccgcaattacgtatcttccttgaagagacaaattgctcaactaaaggaagaactacaggaaaggagtgaacagctgcggaacggccagtatcaagccagcgatgcagccgggttaggacttgaccgctcaccacccgaaaaaacccaggccgatctactggcttttctccactcacaggttgacaaggctgaggtgaatgccggagtgaagttagcaacggagtacgccgcagttccctttgatagcttcaccctgcagaaagtgtaccaactggagaccggcctcacacgccatccagaagagaagcctgtgcggaaggacaaaagggacgagctagttgaggcaatcgagtccgccctggagacactgaacagtccagctgaaaattctcccaaccacaggccatatactgcgagtgactttattgaagggatctaccggacagagagagacaaggggacactgtacgaattgaccttcaagggtgaccacaagcatgagtttaaacggctcatcctgtttcgtcccttcggcccaattatgaaggtgaaaaacgagaaactgaatatggcaaatacacttattaacgtaatagtgccgttggccaagcgggtggacaaatttcggcagtttatgcaaaatttccgtgagatgtgtatcgagcaggacggtcgggtgcatctgaccgttgtgtacttcggcaaggaggagattaatgaggtgaaagggatcctagagaacacatcaaaagcggccaattttagaaattttacattcatacagttgaacggcgaattttctaggggtaagggcttggatgtgggagcgcggttctggaagggcagcaatgtcttgttgtttttctgtgacgttgatatttactttacatccgaattcctcaatacatgccgactgaacactcagccgggaaaaaaggtcttttatcccgtgctgttcagtcagtacaatccaggaattatatatggtcatcacgacgcagtaccgcctctggagcagcagttagtgataaagaaagaaacgggcttttggcgtgatttcgggttcggcatgacctgtcaatacagatccgattttattaatatcggtggctttgatcttgatattaaagggtggggaggggaggacgtccacctctatcgaaagtatctgcattccaacttaatcgtggtcagaactcctgtgagaggtctcttccacctatggcacgaaaagagatgcatggacgagcttacccccgagcaatacaaaatgtgcatgcagagtaaggcgatgaacgaagccagccatgggcagctggggatgctggtcttccggcatgaaattgaagctcacctacgcaaacaaaagcagaagacatccagcaaaaaaacatag

SEQ ID NO: 25013 - DNA, 1002 bp, Artificial Sequence
  Description of Artificial Sequence: Synthetic coding sequence
atgccccgtcgcgggttaatcctccacactcgcacccattggctgctactcggccttgcccttctatgttccctcgttctttttatgtatctgctcgaatgtgcaccacagactgacgggaatgcaagtctgcccggggttgttggcgaaaattatgggaaagagtattaccaagcactgctgcaggaacaggaggagcattaccagacacgcgcaacgtcactgaagcgccagattgcccaactcaaacaggaactgcaggaaatgtcggagaaaatgcgttcacttcaggagaggagaaacgtgggtgctaatggcatcgggtaccagagtaacaaggaacaggccccgagcgaccttctggagtttctccacagtcaaatagacaaggctgaggttagtattggggcaaaattaccatcagagtacggtgtgattcctttcgaaagcttcacactgatgaaggtgtttcaacttgagatgggtttgacccgacatcccgaagaaaagccagtgcggaaagataagcgcgacgaattagttgaggttattgaggctggtcttgaggtaataaacaaccctgatgaggatgatgaacaggaagacgaagagggtccactcggcgaaaaacttatattcaatgagaacgacttcgtggagggttactaccggaccgagagggataaaggcacgcagtatgaactgttttttaagaaggctgatctgaccgagtacaggcacgtgactttgttccggccttttgggcccttgatgaaggtcaaatctgagatgatcgatatcacccggagtatcattaatatcattgtgcccttggcagagcgcaccgaagcctttgtgcagttcatgcaaaactttcgagacgtgtgcatccaccaagacaaaaaaatccatcttacagtggtatattttggaaaagaaggtctcagtaaggtgaaaagcattcttgagagcgtgacacgtctcgcttcatctacttggtag

SEQ ID NO: 25014 - DNA, 1629 bp, Artificial Sequence
  Description of Artificial Sequence: Synthetic coding sequence
atgccccgacgcggactgatacttcatactcggacccattggttattactcgggctggccctcctgtgtagcctggtgttgttcatgtacttactcgaatgcgccccgcagaccgatgggaacgcatcgttgccgggagtggtgggagagaactacggtaaggaatattatcaggccctcctgcaggaacaggaggaacactaccagacgagagcaaccagtctgaaacgccaaattgcacagctgaaacaggagctgcaggagatgtcagagaaaatgagatcattgcaggaaaggcggaacgtcggggctaatggcattggctatcagtctaataaagaacaagcgccctccgacctgctcgagttcttacattcccaaatcgacaaggctgaggtgtctattggtgccaaactgcctagcgaatatggggtgattccttttgaatcatttactctcatgaaggtgtttcagttagaaatgggactgacacggcatcccgaggaaaaacccgtgagaaaggataaaagggacgagctcgtggaagtgattgaggcgggtctagaggtcatcaacaaccccgatgaggatgatgagcaagaggatgaggaggggccacttggcgaaaagctgattttcaatgagaacgattttgtggagggctattacaggaccgagcgagacaaaggaacccagtatgaattgttcttcaagaaggccgacttgactgagtatcgccacgtaacacttttcagacccttcgggcccctgatgaaagtcaaatcagagatgatagacatcacccggagtattataaacataattgtcccacttgctgagcggacagaagcattcgttcagtttatgcagaacttcagagatgtgtgtatccatcaggacaagaagatccacctgactgtcgtgtactttggaaaagaaggcctcagtaaagttaaatctatattagaatctgttacctcagagtccaacttccacaactataccctggtctctctcaacgaggaattcaatcgcggacgtgggctgaatgtgggggccagagcatgggacaaaggcgaagtcctaatgtttttttgtgacgtggacatctacttttctgccgagttcctaaactcctgcaggctgaacgccgagcccggtaaaaaggtcttctacccggtggtgttttccctttataaccctgctatcgtatatgccaaccaggaggttccccctccggtagaacagcaacttgtgcataagaaggactctggattctggagggatttcgggttcggcatgacatgtcagtaccgctcagacttcctcaccattggcgggtttgatatggaggtcaaaggatggggaggagaggatgtgcatctttaccggaaatacttgcacggggacctcatcgtaatccgcacccccgttcctggactgttccacttatggcacgaaaagcggtgcgccgatgagctgacccccgagcagtaccgcatgtgtattcagtccaaagcgatgaatgaagctagccactcacatttaggcatgctggtattcagagaggagatcgagactcatctgcataaacaggcatacaggacaaatagcgaagccgtgggatag

SEQ ID NO: 25015 - DNA, 1620 bp, Artificial Sequence
  Description of Artificial Sequence: Synthetic coding sequence
atgggaagggcgggcggcgggggccctggaagggggccacctccacttctactgtttctgggagcagctttggtgttggcaagcggggccgttccggctagagaggctgggtctgccgtagaggccgaagagctggtgaaaggatcacctgcctgggagccaccagcaaatgatacgcgagaggaagcaggcccacccgcggccggggaggatgaagcaagttggaccgcccctggcggagaactggccggcccagaggaggtgctgcaagaaagcgctgcagtaaccggaacagcctggttggaggccgattcccccggcctgggtggcgtgaccgctgaggctggctctggggacgctcaggcccttccagcaactttacaggctcctcacgaggttttaggacaaagtataatgccgccggccatcccggaagcaaccgaggcctccggcccaccctcacccaccccaggcgacaagctctcacctgcctccgagcttccaaaagagtctcccctcgaggtgtggctgaacttaggaggtagcactccagacccccagggcccggaactgacttacccttttcagggcacgctggagcctcagccagcaagcgacataatcgacatcgactactttgagggactggacggagagggcaggggagctgacctcgggtccttccccgggtctccaggcacatccgagaatcaccctgataccgagggtgagacaccctcttggtcactgctggacctgtacgatgactttacaccattcgacgaatccgatttctacccaaccacctctttctacgatgatctggacgaggaggaagaagaggaagaagatgataaggatgcagtaggagggggggatctcgaggacgaaaacgaattgttggtgccaaccggaaaacctgggctcggtccaggaaccggccagcccacaagccgttggcacgccgtgccaccgcaacacactctgggctctgtgccaggttcctctattgcccttcgtccccgcccaggggaaccggggcgcgacttggcatcttctgaaaatggcactgaatgccgaagcggattcgttcggcacaatggatcatgcagaagcgtgtgtgatctgttcccaagctactgccacaatggcggccaatgttacctggtcgagaatatcggggcattctgcagatgcaatacacaggattacatttggcacaaaggcatgagatgtgagagcatcataactgactttcaggtaatgtgtgtggctgtggggagtgctgctttagtgttgttattgctgtttatgatgacagttttctttgcaaagaagctctacctgctgaagacagagaataccaagctgagacggacaaataagttcaggactccatctgagctgcacaatgataacttctcattaagtacaattgcggagggttcccaccccaacgatgacccttcggcaccacacaagattcaagaggttctgaagagttgcctgaaagaggaggaatcattcaacatccaaaacagcatgagtcctaagttagaggggggcaaaggcgatcaggcggacttggatgtcaattgcctccagaacaacctgacatag

SEQ ID NO: 25016 - DNA, 1701 bp, Artificial Sequence
  Description of Artificial Sequence: Synthetic coding sequence
atgggacgagctggtggtgggggacccggaagaggaccaccgcccttgctgctatttctgggggctgctttagttttagcttccggggccgtgccagcacgcgaggcaggcagcgccgtagaagccgaggaactggtgaagggctcaccagcttgggagccgccagccaatgacacgagggaagaggccggaccccctgccgccggcgaggacgaagcctcgtggacggccccgggtggagagctggccggccccgaagaggtgctgcaggaatctgccgctgtgacgggaaccgcctggctggaagctgacagccctgggctggggggtgtcaccgctgaagcgggcagcggagatgcccaagcgctcccagccaccttacaggccccgcacgaggtcctgggccaatctattatgccccccgctatcccagaagcaaccgaggcttctgggccccccagcccaacccctggagacaaattaagccccgcatcggagctgcctaaggagagtccattggaagtctggctgaacctgggaggcagcaccccagacccccaaggacctgagttgacatatccgtttcaaggcacgctggaaccgcagccggcctctgatataattgatattgattattttgaaggcctggacggggaaggccgcggcgcggacctcgggtctttccctggcagtcccgggaccagcgaaaatcatccggatactgagggtgagacacccagctggtcactccttgatctgtacgacgatttcacgccgtttgacgagtccgatttttacccaactaccagcttttatgatgacctggatgaggaagaggaagaggaggaggatgacaaggatgccgtcggcgggggcgatctggaggacgaaaatgagctgttggttcccactggcaagccaggcctcgggcctggaactggacagccgacctccagatggcacgcagtaccgccgcagcacacccttggatctgtcccaggttcgtctatcgccttgcgcccaaggcccggcgagccaggccgcgatctggcatcatccgagaatggaaccgaatgccgcagtggcttcgtgcgacacaacggctcctgtagatccgtctgtgacctgttcccatcatactgtcataatggtgggcaatgctaccttgttgaaaacataggcgctttttgtagatgcaacacccaggactacatttggcataaaggcatgcgatgcgagagcatcatcactgacttccaggtgatgtgcgtggctgtgggctctgcagctctggtcctcctcctgctgttcatgatgactgtcttctttgctaaaaagttgtatttgctgaagaccgaaaatacgaaactcaggcggactaacaagttccgcactccaagcgagctgcataatgataatttttccttgagcactatcgctgagggctcacaccccaatgtccggaaactgtgcaacactcccaggacatctagtccacacgcacgggctctggcgcactacgataatgtgatatgtcaggatgatccctcggccccccataaaattcaggaagtgctgaaaagttgtctgaaggaagaagagagttttaatattcagaactcaatgagcccaaagctggagggaggtaagggcgatcaagcagacttggacgtgaactgtctccagaacaacctgacttag

SEQ ID NO: 25017 - DNA, 1206 bp, Artificial Sequence
  Description of Artificial Sequence: Synthetic coding sequence
atgcccccagctattcccgaagcaacagaagcctctggtccacctagccccacccccggcgataagttaagccccgcctccgaactccctaaggaaagccccctggaggtgtggctgaacttgggcggaagcactccggacccccagggccccgagttaacatatccatttcagggtaccctggaaccgcagccagcttctgacatcatcgacatagattatttcgaaggtctggacggcgagggtagaggtgctgacctgggtagctttcctggctccccgggtacgagcgagaaccatcccgacaccgaaggcgagaccccgagctggagcctgctagacctatacgatgattttacccccttcgatgagtcggacttctaccccaccactagcttctatgatgatctcgacgaggaggaggaggaggaggaagatgataaggacgctgtgggaggcggagatctagaagatgagaatgagctgctcgtaccaacaggaaagcccggtctgggtccaggtactggccagcccacctcccgatggcatgcagtgcctccccaacatactctgggctccgtgcctggatcctccattgcccttcgaccccggccaggtgaacctggcagggacctcgcctccagcgaaaatgggactgagtgtaggtcaggttttgtgcggcataacggaagctgccggtccgtgtgtgatctattcccctcctattgtcacaatggcgggcagtgctatctcgtggagaatattggagctttttgccgctgcaatacccaggattacatctggcacaagggaatgcgctgcgagtctatcatcaccgacttccaagtcatgtgcgtggccgtgggttccgcagccctcgtgcttctactcctcttcatgatgacagtttttttcgccaaaaaactctacctgcttaaaactgaaaatactaagttgaggagaacaaataagtttcggactccctctgaacttcacaacgataacttctccctcagcacaatagctgaggggagccatcctaatgatgatccgagcgcgcctcacaagattcaagaggtgctcaagagctgcctcaaagaggaggaaagcttcaatattcagaatagtatgtcgccgaagctggagggaggcaagggcgatcaggccgatttggacgtgaactgtttgcagaataacttgacttag

SEQ ID NO: 25018 - DNA, 822 bp, Artificial Sequence
  Description of Artificial Sequence: Synthetic coding sequence
atgtctcgagtggtgtccctgcttttaggcgccgccctgctctgtggccacggagccttttgtcggcgggtggtttctggtcagaaagtctgcttcgcagacttcaaacacccttgctacaaaatggcatatttccatgaactgtccagtcgagtctctttccaggaggcaaggctcgcttgcgagagcgagggcggagttctgctctcactggaaaacgaggccgaacagaagctgattgagtctatgctacagaacctcactaagcctggaactggtatctccgatggcgacttctggattggactctggcggaacggcgatggccaaacaagcggagcctgtcccgacctctaccagtggtcagatggcagtaatagtcagtaccggaactggtacaccgatgagccatcctgtggcagtgagaaatgcgtggtcatgtaccaccagccaaccgccaaccccgggctgggtggaccatatctgtatcagtggaacgatgatcgctgcaatatgaagcataactatatctgcaagtacgaacctgaaatcaatcccaccgctcctgtggagaaaccttatttgacaaatcagcctggggatacccatcagaatgtagtggtgaccgaggccggcattattcccaacttaatttacgttgtgataccaaccattcctctgctgttactgatacttgtcgctttcggcacctgctgcttccaaatgctgcacaagtcaaaagggcgaacaaagaccagtccgaatcagtcaacactctggatctccaagtcgactcgcaaggaatctggcatggaggtgtag

SEQ ID NO: 25019 - DNA, 711 bp, Artificial Sequence
  Description of Artificial Sequence: Synthetic coding sequence
atggcctattttcacgagctatcaagtcgcgtatccttccaggaggctaggctggcctgtgagtcagaaggaggagtgctcctgtccctcgagaatgaggcggagcaaaaactcattgagtctatgctccagaatctgacaaagccaggcacaggcatcagcgacggggatttctggattggcctatggcgcaatggagacgggcaaacatcaggcgcatgtccggacctctaccagtggagcgacggaagcaattctcagtacagaaattggtatacagatgagccatcctgcggttctgagaaatgtgtagtgatgtaccaccagccaaccgcgaaccccggcttgggaggcccctatctctaccagtggaacgacgatcggtgtaatatgaaacacaattatatctgcaaatacgaacccgagatcaaccccacagctcccgtagaaaaaccttacctcacaaaccaaccaggcgatactcaccagaatgtcgtggtgacagaggcggttaaggaagaacaaaagctggtgcagacgagcctgcactgcggttttcagcgcgtgccagagaaaaaggtcgcgtggaaatataacaattccctgacatggttccagaacttcgtgatactggacctgtacaaagagtggcaccagaataacagccttgaatggctggaaatcactaaagacttacaggacgagctgtag

SEQ ID NO: 25020 - DNA, 699 bp, Artificial Sequence
  Description of Artificial Sequence: Synthetic coding sequence
atggcatactttcacgagctttcctcccgtgtgtcctttcaggaggcaaggctggcttgcgaaagcgaaggaggcgtcctgctgtctcttgaaaacgaggcggagcagaaactgatcgagagcatgctccaaaacttaaccaaaccaggaacgggtatttccgatggggatttttggattgggttgtggcgaaatggcgacggtcagacctcaggagcctgcccagatctgtatcagtggagtgacggatccaactcacagtaccgtaactggtatacggatgaaccttcatgcggctccgaaaagtgtgtggttatgtatcaccagcccacagccaaccccggactaggtgggccctatctgtatcagtggaacgatgatcgctgcaatatgaagcacaactacatttgcaagtacgagcccgagattaatcccaccgcgccagtggaaaagccttacctgactaatcagccaggggacactcaccagaacgtggttgtaacagaggccggcattatcccgaacctgatatacgtggtaatccctaccatcccactcctgctcctgatattagtagcctttggcacttgttgcttccaaatgttacacaagagtaaagggcggactaagacatcccctaaccagtccactttatggatcagcaagtctaccagaaaagagagcgggatggaagtgtag

SEQ ID NO: 25021 - DNA, 699 bp, Artificial Sequence
  Description of Artificial Sequence: Synthetic coding sequence
atggcctacttccatgagctctcgagtagggtctcattccaggaagctagactcgcgtgtgaatccgagggcggagtgctcctgagccttgaaaacgaggcagagcaaaaattaattgaatctatgctgcagaatctcacaaagccaggcaccgggatatcagatggggacttttggatagggctgtggcggaatggcgacgggcagacctctggagcgtgtcccgatctctaccaatggagtgatggaagcaactcacagtacaggaattggtatacggacgaacctagctgcggatcagaaaaatgcgtggtcatgtatcatcagccaactgccaaccctggactggggggtccctacctgtaccaatggaacgatgaccggtgcaatatgaaacataattacatatgcaagtacgagcccgagatcaacccaactgcacccgtggagaaaccatatcttaccaaccaacctggtgatactcatcagaacgtggtggtgaccgaggccgggattattccgaacctaatatatgttgtcatcccaaccattcctctcctgttgctcattctggtggccttcgggacatgctgttttcagatgctccacaagtcaaaaggccgcacaaagaccagcccaaaccagtccaccctgtggatatccaaatctactaggaaagaatccggcatggaggtttag

SEQ ID NO: 25022 - DNA, 711 bp, Artificial Sequence
  Description of Artificial Sequence: Synthetic coding sequence
atggcatacttccacgagctaagctcgcgtgtatcctttcaggaagctaggctcgcttgcgagtcagagggtggcgtattgctaagcctggaaaatgaggccgagcagaaactgatcgaaagcatgctccagaatctgactaaacccggaactggaattagcgatggggatttttggatcgggctttggagaaacggagatgggcaaacatccggcgcgtgccctgacctgtatcagtggagcgacggatccaactctcagtatagaaactggtatactgatgaaccctcctgtggttccgaaaagtgtgtagtgatgtaccatcaaccaaccgccaaccccggactaggaggaccttatctgtaccagtggaacgacgatagatgcaatatgaagcacaactatatatgcaagtacgagccagagatcaaccctactgcaccggtggaaaaaccgtatctgaccaatcaacctggcgacacacatcagaatgtcgtcgtcaccgaggcagtgaaggaggagcagaaattggtccagacatctctgcactgcggcttccagagggtcccagaaaaaaaggtggcatggaaatataacaacagcctaacatggttccagaatttcgtaatcttggacctctataaggaatggcatcagaataattccctggaatggctggagattacaaaagacctccaggatgaactgtag

SEQ ID NO: 25023 - DNA, 711 bp, Artificial Sequence
  Description of Artificial Sequence: Synthetic coding sequence
atggcgtacttccatgagctatcatcccgggtcagctttcaagaggcaaggctggcgtgtgagagcgaaggtggggttctgttgtctctagagaatgaggccgagcagaagcttattgagagcatgctgcaaaatttgacgaaacccggcaccggcataagcgacggcgacttctggataggtctttggcggaacggggacggccaaacatcaggagcctgccccgacttatatcagtggtctgacggttccaacagtcagtatcgcaactggtacactgatgagcccagctgtgggtctgaaaagtgcgtcgtcatgtaccaccagcccacagcaaatccaggcctgggcggaccgtacctgtatcaatggaacgacgatagatgcaatatgaagcacaattacatctgtaaatatgaaccagaaatcaatccaactgcccccgtcgaaaagccctacctgaccaatcaacccggagacacacaccagaacgtagttgtgaccgaggcggtgaaggaggaacagaaactggtccagaccagccttcattgtgggtttcagagagtacccgagaagaaggtggcctggaagtacaacaactcactcacctggtttcagaactttgtgatcctggatctgtataaggaatggcatcaaaacaactctcttgagtggctggaaattaccaaggatttgcaggacgaactctag

SEQ ID NO: 25024 - DNA, 141 bp, Artificial Sequence
  Description of Artificial Sequence: Synthetic coding sequence
atggcctacttccacgaactgtcctcacgcgtctcatttcaagaggccagactggcttgcgagtccgaaggcggtgtccttctatcactagagaatgaggccgagcaaaagttaattgaatccatgctgcaaaacctctag

SEQ ID NO: 25025 - DNA, 141 bp, Artificial Sequence
  Description of Artificial Sequence: Synthetic coding sequence
atggcttacttccacgagctgtcttcaagggtgagttttcaggaagcccgccttgcttgcgaaagtgagggaggcgttcttctttctctcgaaaatgaggctgagcagaagctcatcgagagcatgctgcagaacctgtag

SEQ ID NO: 25026 - DNA, 141 bp, Artificial Sequence
  Description of Artificial Sequence: Synthetic coding sequence
atggcttactttcatgagctgtcctcgagggtgtcctttcaggaggctcgtctcgcctgtgagtcagagggaggagtgctactttcccttgagaatgaagcggaacagaaactgatcgagtctatgctgcagaatctctag

SEQ ID NO: 25027 - DNA, 765 bp, Artificial Sequence
  Description of Artificial Sequence: Synthetic coding sequence
atgaccgccggcagtgctcacagccagaaggtctgctttgccgatttcaagcacccctgttataagatggcttacttccacgagctcagctcgcgcgtctcattccaggaagctagacttgcatgcgaaagcgaaggcggagttctcctctctctggagaacgaagctgagcagaaactcatcgaaagtatgctccagaatttgaccaagcccgggaccggcatctccgatggagacttttggattggcctgtggagaaacggggacgggcagacatctggcgcctgtcccgatctgtatcagtggagcgatggaagcaactcccaataccgcaattggtataccgatgagcctagctgcggcagcgaaaagtgcgtcgtgatgtaccatcagccaacagcgaaccccggtctgggtggaccttatctataccagtggaatgacgatagatgcaacatgaagcacaattacatctgcaagtacgagccagagatcaacccaacagcccctgttgagaaaccttacttgacaaatcagcccggcgacacccatcagaatgtggttgtgactgaagcaggcatcatcccaaaccttatttatgtcgtgataccgacgataccccttctcctgctgatactcgtggccttcggaacctgctgcttccagatgctacacaaatcaaaaggaagaaccaagacgtcccccaatcagagtacactctggatctcgaagtcgactagaaaggaaagcggaatggaggtatag

SEQ ID NO: 25028 - DNA, 1239 bp, Artificial Sequence
  Description of Artificial Sequence: Synthetic coding sequence
atgcagaagtattgcatctaccagcattttcagtttcagctccttattcagcacctctggatcgccgcaaattgtgacatcgccgatgagcgcttcgacgccactttccacaccaatgtgctggtcaacagttcgggacactgccagtatctgcctcccggaattttcaagagttcctgttacattgacgtgcgatggtttccctttgatgtacaacactgcaaactaaagttcggctcctggtcctatggtgggtggagcttggatctgcagatgcaggaggccgatataagtggttacattccaaatggagaatgggatctggtagggattccaggcaaacgctctgagcgcttctatgaatgctgcaaagaaccatatcccgacgtaacgtttaccgtgaccatgcgccgccggactctgtattatggcctcaatctcctcattccctgcgtcctgatttcagccctcgcactgttggtgttccttttgccagccgacagcggtgaaaaaatctctctgggcattacggtgctattgagcctgaccgtttttatgctcttggtggcagagatcatgcccgctacctctgattctgtgcccctgatagcacagtacttcgcgtctacaatgataatcgtggggctgtccgtcgtggtaactgtgatagtattgcagtaccaccaccacgacccagacggaggaaagatgcctaaatggacccgggtcatcctgctcaactggtgtgcttggttcttgcgtatgaagcgacccggtgaggacaaagtgagaccggcctgccagcataagcagcggagatgtagcttggcaagcgtcgagatgagcgccgtggcgccccctccggcaagcaacggtaatttgttatacatcggcttcagaggcctagatggggtccattgtgttcccacacctgattctggcgtcgtgtgcgggcggatggcttgcagtccaactcatgacgagcacctgctgcacggcggacaaccgccagagggagatccagatttagcaaagattcttgaggaagtgaggtatatcgcaaataggtttaggtgtcaagacgagagcgaggccgtttgtagtgagtggaagtttgcagcatgtgtggtcgacaggctctgcctcatggcattttctgtgtttactatcatctgcaccattggaattctgatgtccgcgccaaactttgtcgaagcagtgtcaaaggactttgcctag

SEQ ID NO: 25029 - DNA, 966 bp, Artificial Sequence
  Description of Artificial Sequence: Synthetic coding sequence
atgcaggaagcagatatcagcggttatattcctaatggcgaatgggatctcgtcggtataccaggtaaaaggtctgagcgtttttacgagtgttgtaaagagccatatccagacgttacatttacagtgaccatgaggaggcgcacgctgtactatggacttaacctgctcataccctgtgtcttgataagcgccctggccctgctggtctttcttcttcctgcagacagcggtgaaaaaatcagtctaggaattacagtgttgcttagcttaacagtctttatgctgctcgtggcggagataatgcccgccacctctgattcagtgccattaatcgcccaatactttgcgtccaccatgattattgtcggactctctgtggtggtaaccgtgattgtgctgcagtaccatcaccacgatcccgacgggggtaaaatgccaaagtggacacgggttatcctgctgaactggtgtgcttggtttctgaggatgaagcgcccaggcgaggataaggtcaggcctgcgtgccagcacaaacaaagacggtgtagcctggcgagcgttgaaatgtccgcggtggccccacccccagcctctaatggcaacttactctatatcggcttcagaggactcgacggtgtacattgcgtcccaacccccgattccggagtggtctgtgggagaatggcgtgtagcccaacccacgacgaacatcttcttcacggcggccagccaccagaaggcgacccggatctagcgaaaattctggaggaagtgcggtacatcgcaaatcgctttcgttgccaggacgagtccgaggcagtgtgttctgagtggaagtttgcagcatgcgtagtggatcgtctgtgcctgatggcattctcagtgttcacaattatctgcactattggtatactgatgagtgcacctaattttgtcgaagcggtgtctaaggatttcgcgtag

SEQ ID NO: 25030 - DNA, 966 bp, Artificial Sequence
  Description of Artificial Sequence: Synthetic coding sequence
atgcaggaagccgatatctctggttatattcctaacggtgagtgggatctggtgggtatccccggcaaaaggtcagaaagattctatgagtgctgcaaggagccatatcccgacgtgaccttcaccgttacaatgcgcaggcggaccttgtattatggactgaacctcttaattccatgcgttcttattagtgcccttgcacttttggtctttctgcttcctgcggactcaggagaaaagatcagcctcggaatcacggtgcttctcagtctcacagtgtttatgctgctggtcgcagaaatcatgccagcaacgtcagacagcgtgcccttgattgcacaatacttcgcctcaacgatgataatagtgggtttgtccgtcgtcgtcactgttatagtgctccagtatcaccaccacgatcccgacggaggtaaaatgccgaagtggacccgcgtgatcctgctaaactggtgtgcttggttcttgagaatgaagagacctggtgaggacaaagtgcgccccgcctgccaacacaaacagagacgatgttcactggcctctgtagagatgtcagccgtggcccctccccctgcttcgaacggaaacctcctgtatattggatttcgcggtcttgacggagtgcattgcgtccccactcccgacagcggggtcgtctgtggccgcatggcttgctcacctacccacgacgaacatctcctgcacgggggccagccacccgagggcgatcccgacctcgcaaagattctagaagaagttaggtatatcgccaacaggtttagatgtcaggacgagagtgaggctgtatgctccgaatggaaattcgcagcttgcgtcgtggatcgcctgtgcctgatggcatttagcgtgttcacgatcatttgcaccatcggcatcctgatgtccgctcccaattttgtggaggccgtgagcaaggacttcgcctag

SEQ ID NO: 25031 - DNA, 1626 bp, Artificial Sequence
  Description of Artificial Sequence: Synthetic coding sequence
atggcatcccaggagtttgaagtggaggccatagtggacaagaggcaggataagaatggaaatactcaatatctcgtgcggtggaagggctatgacaagcaagacgatacctgggaaccagaacagcacctgatgaactgcgagaagtgcgttcatgacttcaacaggagacagactgagaaacaaaagaaactgacctggacaacaacctctaggatctttagcaataatgccagaaggcgcaccagccggagcaccaaggctaattactccaagaactccccaaaaactccagtgacggacaagcatcaccggtcaaaaaattgcaagctgttcgctgcctcaaaaaacgttcggaggaaggccgcctccacattgtccgacaccaagaatatggagatcatcaatagcaccatcgaaaccctggccccagattcacctttcgaccacaagaaaactgttagtggttttcagaagctggagaagctggaccctattgctgctgaccaacaggataccgtcgtatttaaagtaacggaaggaaagcttctgcgcgaccccctttctcaccccggggcagaacagacagggatccagaataagacacagatgcatccactcatgtctcagatgtccggatctgtcacagcctccatggccaccggctctgctaccagaaagggcatcgttgtgttaatcgatccgctcgctgccaatggtaccactgatatgcatacctcagtaccgcgggtcaagggggggcaacgaaacatcacagacgacagccgaggccagccattcatcaagaaaatgcatttcactatacgcctgacagaaagtgctattacgtacagggacatagtagtaaagaaagaggatggctttactcaaattgtgttgagcacacgttccaccgagaagaatgctctaaatacagaggtgatcaaggaaatggtgaacgccctgaactccgccgcagctgacgatagcaaactggttctcttcagcgcggccggcagcgttttttgttgtggactcgactttgggtatttcgtgcggcatctgaggaacgatcgaaataccgcaagcctggaaatggtcgataccatcaagaacttcgtcaatactttcatccaatttaaaaagcccatcgtcgtttccgtcaatgggcccgctattggcctcggcgcttccatcctacctctgtgcgaccttgtgtgggccaatgaaaaagcgtggtttcaaaccccatataccaccttcggccaaagcccagatggctgctcgtccatcaccttcccgaagatgatgggaaaagccagtgctaatgagatgctgatcgccggacggaagttgactgcgcgagaggcgtgcgccaagggtctggtctcccaggttttcctcacaggaactttcacacaggaggtgatgatacagatcaaggagctggcctcttataatgccatcgtcctggaggaatgcaaggcactcgtcaggtgtaacatcaagctggaactggaacaagctaacgagagggagtgcgaggtgctgaggaagatatggtccagcgctcagggcattgagagtatgctgaaatacgtcgagaacaagatagacgagttctag

SEQ ID NO: 25032 - DNA, 1668 bp, Artificial Sequence
  Description of Artificial Sequence: Synthetic coding sequence
atggcgagtcaagagttcgaagtagaggcaatcgtggataaaagacaggacaagaatggaaatacccagtatttggtgcgctggaaagggtatgataagcaggatgatacttgggaacctgagcagcatttaatgaattgcgagaagtgtgtccacgatttcaatcggcgtcagacagaaaagcaaaagaaactgacttggactactacttccaggattttttccaacaacgcacgacgccgcacatcccgaagtacgaaagcaaactatagcaagaattcgcccaagactccagtaacagacaagcaccaccgcagtaaaaattgtaagctgtttgcagctagcaaaaatgtcagacgcaaggctgcatcaactctgagcgacactaaaaacatggagatcattaattctaccatcgagacactggcccccgacagtccattcgaccataagaagacggtctccggatttcaaaagctggagaagctggatccaattgcagccgaccagcaagataccgttgtgttcaaagtcactgagggcaagctgctgcgggaccctttgagccatcccggtgcagagcagacagggatccagaacaagacgcagatgcatccattgatgagccaaatgtccggctctgtgacagccagcatggccaccggttccgctacccgcaaaggcatagtggtcctgattgatcctctggccgccaacgggacaactgatatgcatacttctgttccacgcgtcaaggggggacagcgcaatatcaccgacgacagtcgcggccaacccttcatcaagaagatgcatttcaccatccgactgaccgagtccgccattacttatagggatattgtcgtgaagaaagaggacggctttacccagatagtgttatcaacccggtcaaccgaaaagaatgccctgaacactgaggttataaaggaaatggtgaatgccctaaacagcgctgcagcggatgactcaaagctcgtgctcttctctgccgcaggctcagttttctgttgcggactggacttcggatatttcgtgaggcatctgcgcaatgacaggaataccgcaagtttggaaatggtagacactatcaaaaattttgttaatacattcatccagttcaagaaacccattgtcgtctctgtcaacggaccagccattggactcggggcctccatacttccgctctgtgatctggtgtgggccaacgagaaggcctggtttcagacaccttacacaacgtttggccagtcccctgacggatgctctagcattactttccccaagatgatggggaaggcatccgcaaacgagatgctcatcgccggcaggaaacttaccgctcgcgaggcctgtgctaaggggctggtgtcacaggtgttcttaacgggtacctttactcaggaggttatgatacagattaaagagcttgccagctataacgcaatcgtactcgaggagtgtaaagccctcgtgcgctgcaacataaagttagagctggaacaggccaacgagcgcgagtgcgaagttctgcggaaaatctggtccagtgcccagggcattgaatccatgctcaaaataccactgctagggtacaaagcagccttcccgccgcgcaagacacagaatgaccagcggtggtgtccttag

SEQ ID NO: 25033 - DNA, 2403 bp, Artificial Sequence
  Description of Artificial Sequence: Synthetic coding sequence
atggctacactaggacagaaacctgtgattcacactgtgttgaaacgcaaggtgtactcctctaatgaaaaaatgcgcagggggacctggcgcatcgtcgtgcccatgacaaaggacgacgccctgaaagagataagaggtaaccaggtgacctttcaggactgctttatcgcagattttttgatcctcttgacttttcccctgttaaccataccagaaattcctggctacttgcctatttcatctccccggggaagccaactcatggcctcctgggatgcatgcgtggtggcttcagccgtactggtgaccgacatggagactttccacactactgattcattcaagagttggacccggattagggtgcccccggacatcctgtctgacgatgagcgccggtcagtagctcacgtgatcttatccagagacgggatcgtgttcctgataaatggggtgttgtatataaaaagcttcagaggcttcatccgcctcggaggaattgtcaatctgcccgacggtgggattactggcataagttctcgcaaatggtgttgggttaactatttactaaaggccaagggcaggagaagcacattcgccgtttggaccgagaacgagatctatctcggcagcattctgttgaagttcgcccggctggttacaaccacagagctcaagaatatcctatctctgtccgtcaccgcaaccctgacaattgaccgagtggagtataccggtcatcccctcgagatagccgtcttcctgaactactgtactgtgtgcaatgtgaccaaaaagatcttcttagtgatctataacgaagacacgaagcagtgggtctctcaggattttacattagacgcaccgattgattctgtgacgatgcctcatttcaccttttcggctctccccggactgctgttatggaacaaacatagcatctactattgctaccataacttcaccttcaccgggattctgcagactccggcaggacatgggaatcttagcatgctgagcaatgattctatcatccatgaggtgttcattgactactacggagatatcttagttaagatggaaaacaacgttattttctattcaaagatcaacactagagatgctgtgaagctgcacctctggacaaactataccaccagggccttcatatttctgtccacaagcggacagacttacttcctctacgccctagacgatgggaccattcaaatccaggactatccactgcatcttgaagcccagtctatcgcgtttactaccaaggacaagtgtccatacatggctttccacaacaatgtcgcccacgtcttttattttctggataaaggcgaagcactcaccgtttggactcagatcgtgtaccctgagaataccgggctgtatgtgattgtcgagagttatggcccaaagatattgcaggagagtcacgagattagctttgaggccgctttcgggtactgcacaaagacattgactttgaccttttatcagaacgtggattatgagagaatctctgattatttcgagactcaggacaagcatacaggccttgttctcgtgcagtttcgcccgtccgagtattctaaagcttgcccaatcgcccagaaggtgttccagatcgccgttgggtgcgacgataagaagtttattgcaattaagggtttcagcaagaaaggttgccaccaccacgacttttcctatgtaattgaaaagtcatacctcaggcaccaaccttccaagaatctccgagtaagatatatttggggggagtacggctgtccactaaggctggattttacggagaagttccagccagttgtccagctttttgacgataatgggtatgtgaaggacgtggaagccaatttcattgtctgggaaattcatggacgggatgactactctttcaacaacacaatggcacagtccggatgtttgcacgaagctcaaacgtggaaatccatgatagaattgaacaaacacctccccctagaagaggtgtggggccccgaaaattacaagcattgttttagctatgccattggcaagcctggagaccttaatcaaccgtacgagataattaacagcagtaatggcaaccatattttttggcctatgggtcactccggcatgtacgtgtttcgggtcaagatcctggacccgaattattccttttgcaacctgaccgctatgtttgcgattgaaaccttcggacttataccaagcccatccgtttacctggtggctagctttcttttcgtattaatgctgttgttctttacaatccttgtgttatcctattttaggtatatgaggatttaccggcggtacatctacgaacctctacacaaacctcagaggaaacggaagaaaaattag

SEQ ID NO: 25034 - DNA, 2499 bp, Artificial Sequence
  Description of Artificial Sequence: Synthetic coding sequence
atgagcgccagggaggtggcagtgctactgctctggctaagttgttacgggtccgctctttggagatattccactaatagtcctaattaccggatcttttccactcgttctaccattaaactggaatacgaggggactctttttacagagtggtctgtgccagaaacatgctttgtcctaaataaatcctctcctactaccgagctacggtgcagttctccaggagtccacgctatcaagcctattgtgactggtccagatgaggaggaacgttatttgtttgtcgaaagcagccatacttgtttcctgtggtactacagagtccgacatttttttaataactttactcaactgattaccgtctgggcctacgaccccgagtccgccgatcctgatgaacttttgggaaatgctgaagagccttccataaacagcattgtgttatcgacccagatggccacattgggtcagaaaccggtcattcacactgtcttgaaaagaaaggtttattcctccaatgagaagatgaggaggggtacatggaggatcgttgtcccgatgactaaagacgacgccctgaaagagatccgtggcaatcaggtaacttttcaggattgcttcattgcggacttcctcatattgctgacattcccattgctcacaataccagagatacctggttatctgcccatctcaagccctcggggatctcaactgatggcaagttgggacgcctgtgtcgtggccagcgctgtactggtgacagacatggaaaccttccacactactgattcttttaagtcttggactcgaattagggtgccaccggacattctgtccgacgacgaacgacgctcagtggcccacgttattctgtctcgagacggaattgtgttcctaatcaacggtgtgctgtacatcaaaagcttcaggggcttcattcggctaggcggcatcgtcaacctgccagacgggggaattaccggaataagctcccgcaagtggtgctgggtcaactacttgctgaaggcaaaggggcggcgctccaccttcgccgtttggacagagaatgagatatacctgggatcaatactcttgaaattcgccaggctagtgacaacaactgaacttaagaacatactctctttgagtgtcacagcgaccctgacaattgatagagtggagtataccggccacccccttgagatcgcagtttttcttaattattgcacagtgtgcaatgtgacaaagaaaatattcctcgtgatttataacgaagataccaagcagtgggtcagtcaagattttacgctggacgccccaatcgattcggtcactatgccccactttacgttctcagccctgccaggcttactcctttggaacaaacattctatctactactgttaccataattttacattcacagggatcctccagactcctgctgggcatggaaacctaagtatgctgtccaacgatagtataattcatgaggtttttatagactattacggagatatactggtgaagatggaaaataacgtcatattttatagcaagatcaacacaagagacgccgtaaaactgcacctgtggaccaactataccactagggcatttatcttcctgagcacctcggggcaaacttactttctgtacgccctggacgatggaacaatccagatccaggactaccctctccacctggaggcacagtctattgcattcaccacaaaggataagtgtccatacatggccttccacaacaatgttgcccacgtcttctatttcctggataaaggggaagctctaactgtgtggactcagattgtgtacccagagaacaccgggctctacgtcatcgtcgagagctacgggccaaaaatcctccaggagtcacatgaaatcagcttcgaagctgcctttggctactgcactaaaactctgaccttgacgttctatcagaatgtggactacgagcgaattagcgactactttgagacacaggataaacatacagggttggtcctcgtacagttccgacccagcgaatactcaaaggcatgtccaattgcccaaaaagtattccagattgctgtgggatgcgacgacaaaaagtttattgctatcaagggattctctaaaaaggggtgccatcatcacgatttcagttatgtcatcgaaaaatcttatctcaggcatcagccaagtaagaacttaagagtgcgctacatttggggcgaatacggctgtcccctacggctcgacttcaccgagaagtttcagcccgttgttcaactgttcgacgacaatgggtacgtgaaagacgtggaggctaatttcatcgtgtgggagatccacggaagggatgattacagcttcaacaatacaatggctcagtcaggatgtttacatgaggcccagacatggaaatcaatgatcgagctgaataagcacctaccactggaggaggtgtggggtcccgagttcctatag

SEQ ID NO: 25035 - DNA, 2856 bp, Artificial Sequence
  Description of Artificial Sequence: Synthetic coding sequence
atgagcgcccgcgaagttgccgtactattactgtggttgtcatgttacggctccgctttatggcgctactctactaactcccccaactataggatattcagcacacggtctactataaagctggaatatgaaggaacattattcaccgagtggagcgtccctgaaacttgcttcgtgttaaataagtcgagccccactacggagctgagatgctcctcacctggagttcacgcaataaaaccgattgtgacgggccctgacgaggaggaaagatacttattcgtggaatccagccatacgtgctttctgtggtactatagagtccggcacttcttcaataatttcacacaactcataaccgtatgggcatatgaccccgagtcggcggatccggatgaactcctgggaaatgccgaggagcctagcattaactcaatagtcttatccacgcagatggcaaccttggggcagaagcccgttatccataccgtgcttaagcgaaaggtgtacagttcaaacgagaaaatgaggcgcgggacatggcggatcgttgtgcccatgaccaaggatgatgcgctcaaagagatcagaggtaaccaagttacctttcaggactgtttcatcgcagacttcttgatactgctcaccttcccactgttgaccatacccgaaatccccggctatttacccatctctagccccagaggcagccagctgatggccagctgggatgcatgtgtcgttgcttctgccgtcctggtaacagatatggagaccttccacaccaccgatagcttcaagagctggacaagaataagggtcccacctgacattcttagtgatgatgagaggcggagtgtcgcccatgtgatcctctccagggatggcatcgtgtttctgattaatggcgtgctgtacatcaagtccttccgcggcttcattaggctcgggggcatagtgaacctccccgacggtggaatcacaggcatatcctcccggaagtggtgctgggtcaattatctgctcaaggctaaggggcgccgcagcacttttgccgtttggaccgagaatgagatctatctgggctccattctactgaagttcgctcgactcgtgacaaccactgagctgaagaacatattgtcactgagcgtaactgctaccctaaccattgatagggtggagtatactggccaccccctggaaatcgctgtgttcctgaactactgtactgtgtgtaacgtaaccaaaaaaatcttcctggtgatatacaacgaggacactaaacagtgggtgtcccaggattttacattggacgcaccaattgattccgtgacaatgccccatttcactttctcagctctccccggcctgcttctctggaataagcactccatctattattgttaccacaatttcacttttactggcatcctgcagacacccgccggccatggtaatctgagcatgttgtctaatgactcaattatacatgaggtgtttattgactattatggggacatcctggtaaagatggaaaataatgtgatcttctatagcaagattaacaccagagatgctgtgaaactgcacttgtggaccaactacacaacccgggctttcatcttccttagcacttctggacagacttactttctgtacgctctggacgacggaacaatccagattcaagattatccccttcacctggaggctcaaagcatcgctttcactaccaaggacaagtgcccgtacatggcatttcataacaatgttgcacacgtgttttatttcctggataaaggcgaagctcttactgtttggacgcagatcgtttacccagagaatacaggcctgtatgtgatagtagagtcctatggccccaaaatacttcaggaatctcacgagatcagttttgaagctgcctttgggtattgcactaaaacattgacactcacattttaccagaacgtagactacgaacggatctcggattattttgagacccaggacaaacacactgggctagtattggtccagttccggccgtcagagtactcaaaggcttgcccaattgcccagaaggtatttcagatcgcagtgggatgtgatgacaagaagttcatcgcgattaaagggttttctaaaaagggctgtcatcaccacgatttttcctacgtgatcgagaagtcatatcttaggcaccaaccctccaagaaccttagggtcagatacatctggggagaatacgggtgccctctgagattggactttaccgaaaagtttcagccagttgtccaattgtttgacgataacggctatgtgaaagatgtagaagccaattttatcgtgtgggaaatccatggccgagacgactacagtttcaataacacaatggctcaatcgggatgcttacatgaagcacagacatggaagagtatgatcgagttgaacaagcacctccctctcgaagaggtctggggacctgaaaactacaagcattgttttagttatgctatcggcaagcccggagatcttaaccagccatatgaaataataaactcctcaaatggcaaccacatcttctggcctatgggtcatagtggaatgtatgtgttccgcgtgaaaatcttggacccaaactactccttttgcaacttgactgcaatgtttgcaatagaaacctttggactaatcccaagtcctagcgtgtatctcgtagcctcttttctgttcgtactcatgctcctgtttttcactatactggttctgagctatttcagatatatgaggatctacagacgatatatttacgaacccttacataaacctcagcgcaagaggaaaaagaactag

SEQ ID NO: 25036 - DNA, 2499 bp, Artificial Sequence
  Description of Artificial Sequence: Synthetic coding sequence
atgtcagccagagaggtagctgtacttttactgtggctgtcctgctacgggtctgcattgtggagatattccaccaactcgcccaactatcgcattttctccacccgttcaactataaaactggaatacgaaggaacactctttacagagtggtccgtgcccgagacctgcttcgtgctgaataaatcctctccaacaactgagttgcggtgcagttctcctggagtccacgctatcaaaccaatagtaaccgggcctgatgaagaggaaagatacctgtttgttgagtcctcgcacacgtgcttcctgtggtactaccgggtgaggcacttttttaataattttacccagctcattaccgtgtgggcgtacgaccctgagtcagctgaccctgatgagctgctgggaaatgccgaggagcccagcatcaactcaatcgtcctatccactcagatggccaccctgggacaaaaacccgtaattcatactgttctgaaacgtaaagtatactcatccaacgaaaagatgcgacgggggacttggcggatcgtggttccaatgacaaaggatgatgctctgaaggagatacggggtaaccaggttacatttcaagactgttttattgctgatttcttaatcctgctcaccttcccgctgctaaccattccggagatacccggctatctccccattagcagtcctcggggctcacagctcatggccagctgggacgcatgcgtcgtggctagcgccgtattggtaaccgatatggaaacattccacactacagactcttttaagagctggacaaggatccgagttccaccagacatcctgtctgacgatgagaggaggtcagtcgcccatgttatccttagccgcgatggcatcgtatttctcataaacggtgtcctgtacatcaaaagcttccgcgggtttatccgcctgggaggaatcgtgaatcttcctgatggcggcataacaggcatttcttcccgcaagtggtgttgggttaactatctcctgaaagccaaagggcggagaagcacatttgcggtgtggaccgagaatgagatttacctgggctctatcttgctcaagttcgcgcgccttgtgacaaccactgaattaaagaacatcttgagcctctcagtgaccgccacgctgactattgatagggtcgagtacacaggccatccgcttgagattgccgtgttccttaactattgcaccgtgtgcaacgttacaaaaaaaatttttcttgttatctacaacgaggacacaaagcaatgggtgagccaggattttaccctcgatgcacccatcgatagcgtgacgatgccacattttacattcagcgctcttcccggactcctactgtggaacaaacattctatctattattgctaccataacttcacttttaccgggatcctccagactccagcaggccacgggaacctgtcaatgctctcgaacgactccatcattcacgaagtttttatcgactattatggagatattttagttaaaatggagaataacgttatattctattctaagatcaacaccagagacgccgtcaaactacatttatggaccaattacacaactagggcttttatctttctgtcgacttctggccagacatacttcctttacgctctagacgatggaacaatccagatccaagattaccctctgcatctcgaggcacagtcgatcgcatttactactaaagacaagtgcccttacatggccttccataacaacgttgctcatgtgttttactttctggataagggagaagcgctgaccgtttggacgcagatcgtgtatcctgaaaacactggcctctacgtgatcgtggagtcctatgggcccaagatcctccaagagagccacgagataagttttgaagcagcgttcggctactgtacgaagactctaactttaactttctaccagaacgtggattatgagaggatttccgattatttcgaaacccaggataaacacaccggtttggtactggtgcagtttcgaccaagcgaatatagcaaagcctgtccaatcgcacagaaagtttttcagatcgcagtcggttgcgacgataagaaattcattgccatcaaggggtttagtaagaagggttgccaccaccatgacttttcctatgttatcgagaagtcctacctgaggcaccagcctagtaaaaacctccgggtgagatacatttggggcgaatatggatgccccctaagactcgacttcactgaaaagtttcagccggtcgtgcagctttttgatgacaacggctacgttaaggacgtggaagcaaacttcattgtttgggagatccacgggcgcgatgattacagcttcaacaacacaatggctcagagtggctgcctgcatgaagcccagacttggaaatctatgatcgaattgaacaagcacttacctctggaggaggtctggggccctgaatttctatag

SEQ ID NO: 25037 - DNA, 2616 bp, Artificial Sequence
  Description of Artificial Sequence: Synthetic coding sequence
cggcggcggtcacgccggcatgtatctcccgggtctgggcgcgctgctgcggtcgccgaactgctttggttaagacccctggaaatcaaactcgaatatgaaggaactctgttcaccgagtggtccgttcctgaaacctgtttcgtactgaacaaatcctccccgacaacagaacttaggtgttcaagtccgggcgtgcatgccatcaaaccgatcgtgactggaccggacgaggaagaaagatacctgtttgtcgaatcaagtcacacatgcttcttatggtactatcgcgtaagaacctggcgtattgtggtccccatgacaaaggacgatgcccttaaagaaatcaggggcaatcaggtgacatttcaggattgcttcatagcggattttttgatcctactgaccttccccctgctcacgatacccgaaatccctggctatctcccaatcagcagccctcggggttcccagcttatggccagttgggacgcttgcgtggtggcaagcgcggttctggtgacagatatggaaaccttccacaccacggacagctttaaatcctggacacgtattcgtgtgcctcctgacatactgtctgacgatgagcgtagaagcgtagctcacgtgatccttagcagagatggaattgtgtttcttatcaatggcgtgctgtacatcaagagtttccgcggattcattcggttgggcggcattgtgaacttacctgatgggggcattacagggatcagtagcagaaagtggtgttgggtaaactacctgctgaaagccaaaggaaggcgaagtacatttgccgtgtggactgagaacgagatttatttaggaagtatcctgctgaaatttgcaaggttggtgaccacaactgagctgaaaaatatcctgtctttgagtgtgaccgccaccctgacaattgatcgcgtggagtataccgggcaccccctagagatagcagtctttttaaactactgcactgtatgcaacgtgactaaaaagattttcttagtgatttacaacgaggacacaaagcagtgggtttctcaggacttcaccctagacgcccccattgatagcgtgactatgccacactttaccttttcagccctcccagggctgctgctttggaataaacatagcatctattattgttatcacaattttacgtttactggaatcctccagacacctgccggtcacgggaatctgagtatgttatctaacgacagtataatacacgaggtgttcattgattactatggcgacatcctcgtgaagatggaaaataacgtgattttctactctaaaatcaatactcgggacgccgtgaaactccatctgtggaccaattacacaacccgtgctttcatctttctgtccactagtggacagacgtactttctatatgcgcttgacgatggcactattcagatccaggattaccctctgcatctcgaagcccaaagcattgccttcacaacgaaagataaatgtccgtatatggcatttcacaacaacgtggcccatgtattctatttcctggacaaaggcgaggcactcacagtttggactcaaatcgtgtatccagagaatactggattgtatgtgatagtcgaaagctacggtccaaaaatcctgcaggagtcacatgaaatctccttcgaagctgcgttcggatactgcacaaaaacgttgacactcaccttctatcagaacgtggactatgaaagaataagcgactattttgagacccaggataagcataccggtctggttctggtgcagtttcgcccttccgagtattccaaagcttgcccgattgcccagaaggtttttcaaatagcagtcggctgcgatgacaaaaaattcattgctatcaaggggtttagtaagaagggatgtcaccaccatgacttctcttatgtcatcgaaaagtcttatctcaggcaccagccatctaagaatctccgcgtccggtacatctggggggaatacggttgcccactgagactcgacttcactgagaagttccagcccgtcgtccaactgtttgatgacaacggctacgtgaaagatgtcgaagctaattttatcgtttgggagattcacggtcgcgacgactatagtttcaacaacacaatggctcagtccggctgcctgcacgaagcccagacttggaaatccatgattgagttgaacaagcacctgccactggaggaagtgtggggtcctgagaattacaaacactgtttttcttacgctattgggaagccgggtgatctaaatcagccatacgagataatcaactcatctaacggcaaccacattttctggcccatgggacacagcggcatgtatgtcttcagagtgaaaatcttagatcctaattatagcttctgcaacttaaccgcaatgtttgcaattgagactttcggcctgattccttctccatcggtttaccttgtggcaagcttcctgttcgtgctgatgcttctgttctttaccattctggtgctcagctattttcgctatatgcgtatttaccgcaggtatatttatgaacccttgcacaagcctcagcggaagaggaagaagaattag

SEQ ID NO: 25038 - DNA, 309 bp, Artificial Sequence
  Description of Artificial Sequence: Synthetic coding sequence
atgacaaccgcaacgccactaggggacactactttcttctcccttaacatgactacccggggggaggattttctgtataaaagctccggggcaatcgtagcggccgtggtggtcgttgttataatcatctttaccgtggtgttgatcctgcttaaaatgtacaacagaaagatgaggactcggagggaactggagccaaaaggtccgaagccaacagcaccttccgcagtgggtcctaatagtaatggctcgcaacaccctgccacagtgaccttcagccccgtagacgtgcaggttgagactcgctag

SEQ ID NO: 25039 - DNA, 1035 bp, Artificial Sequence
  Description of Artificial Sequence: Synthetic coding sequence
atggccctccgtcatctcgcattgctggctgggctgttagttggggtggccagcaaaagcatggagaatacagcccaattgcccgaatgctgcgttgatgtggtgggtgtcaatgcaagctgtcccggcgcttccctgtgcggacctgggtgctaccgcagatggaatgccgatgggagtgcctcctgcgtgcgatgcgggaatgggactctccctgcatacaatgggtctgagtgtcgaagtttcgccggcccgggagctccattcccaatgaaccggtctagtggtacgcctggacggcctcacccaggggcaccccgagtcgccgcttctcttttcctcggtacattctttattagttctggtttaatactgtccgtggccggctttttttatcttaagcgttcgtccaagctgcctagggcatgctataggagaaataaggctcctgccctgcaaccaggcgaggcagctgcgatgatccctccccctcaaagttcaggtaattcctcgtgtagaataccactgtggggctttccctcactaggtcagtcacagggcgcgctctgggtttgtcctcagaccggcctgcccggttcagggagtaggccccctctgccaggctctccaggggatccccccacacggcaggggcaggggcgtatctggctcgttcctcctgcgttagatctgtcttggatttggccagcaccgcctgcaaggcctcctttgatccctgtgacatctatgctgttccccgtgcccgagacatggggactccaggagaggaggacacaccacgacagggcagaccctcagtacctgctactacttgaagtacagctgcatccccggaccgatgctgctggcctcagacaggcgcttttatctagccaccgattctctggtgcagggtctggcggccctaagtcccagccagtgcgaaagcctcggtacgtgcggagagaacgccctctcgaccgggccacggaccccgccgcattcccaggagaagcaagaatcagcaatgtgtag

SEQ ID NO: 25040 - DNA, 597 bp, Artificial Sequence
  Description of Artificial Sequence: Synthetic coding sequence
atggctctgcgacatcttgctctcctcgccggccttctagtcggagtggcatccaaaagtatggaaaatactgcccagctaccagaatgctgcgtcgatgtggtcggtgtgaatgcctcttgtccgggggcttccctgtgtggacctgggtgttatcgacgatggaatgcagacggctccgcctcctgcgtgagatgcggtaacggcactttacccgcatataacggaagcgagtgcagatccttcgcagggccaggtgccccttttcccatgaatcgcagcagcgggacccccggccgaccacaccccggggccccgcgggtagccgctagtctctttctggggactttcttcatatcgagcggtctgatccttagtgtagctggatttttttacctgaagcgaagctcaaagcttcctcgggcctgttacaggaggaacaaggctcccgccttgcagcccggggaggctgcagcgatgattccccctcctcaaagttccgtgcgaaagcctcgttatgttcggagggagcgcccactggaccgggccacagatccagccgcctttcctggtgaagccagaatctctaacgtctag

SEQ ID NO: 25041 - DNA, 1143 bp, Artificial Sequence
  Description of Artificial Sequence: Synthetic coding sequence
atggccttacggcatcttgctctgttggctggtttactcgtgggcgtggcaagcaaaagcatggagaatacagtaaccaggaactccacagccgtgatcaacactcaggccgagggcactcttagccctccggggctgtctagtctgcccgtcgtccgggagtgggccctgacacacacggcacaattacccgaatgctgcgtggacgttgtgggagtgaatgcctcctgccccggggcttccctatgcggccccggatgttacagaaggtggaacgccgacgggagcgcttcttgtgtgcgttgcggaaacgggaccctgccggcatataatggtagtgaatgcagatcatttgctggccctggcgcacctttccccatgaaccggtcgtctggaactccaggccggcctcaccccggagctccgagagtcgcagcttcgctctttctaggtaccttttttataagctccggactcatcctctccgtcgctggtttcttttatctcaaaagatccagcaaactgccaagggcctgctaccgaagaaataaagccccagcactgcagcccggagaggcggctgccatgattccaccaccgcagagttccggcaattcatcatgcaggatccccttgtgggggtttccatctcttgggcagtcccaaggtgctctgtgggtgtgccctcagactggccttcctggatcaggaagcagacccccactgccaggctcccccggtgacccaccaaccaggcagggacagggtcgtatctggctggtgcctccagccctcgatcttagctggatctggcccgcccctccggcgagacctccccttatcccagtcaccagtatgctctttccggttccagagacttggggcttacaggagaggcggacgcatcacgatagggctgatccccagtatctgctcctgctggaagtgcaactgcaccctcggactgatgctgcgggactgcggcaagcgctccttagcagccatcggttttcaggggcggggagtggggggcctaagtcacagcctgtgcgtaagcccagatatgtgcgtcgcgaacgacctctggatagagcgactgatcccgctgctttcccaggcgaggctcgcatatcgaatgtgtag

SEQ ID NO: 25042 - DNA, 597 bp, Artificial Sequence
  Description of Artificial Sequence: Synthetic coding sequence
atggcccttcgccacctggccctattggcaggccttctggtgggggtggctagcaagtctatggaaaatacagctcagctccccgagtgttgcgtggacgttgttggcgtgaacgccagctgtcccggtgcgtccctgtgcgggcctggatgctatcgaagatggaatgcagacggaagtgcctcctgcgtgaggtgcgggaatgggacactcccagcatacaacggaagtgagtgcagatcgtttgccggtcctggagctccttttcctatgaacagatcaagcgggactccgggacgtccacaccctggcgctccacgggttgccgcctctctcttcctgggaacattcttcataagctcgggtcttatactgagcgtcgctggatttttctacttgaaaagaagctctaagttgcccagagcgtgctaccggaggaacaaggctcccgctctgcagcccggggaagctgccgcaatgattcctcccccacaatcatccgtgcgtaaacctcgatacgtccgcagggagagaccactggaccgcgccaccgatccggctgccttccctggtgaggctcgcatctccaatgtgtag

SEQ ID NO: 25043 - DNA, 558 bp, Artificial Sequence
  Description of Artificial Sequence: Synthetic coding sequence
atggcccttcgacatttagcgttactcgccggcttactggtgggggtcgcctctaagtccatggaaaacaccgcccagttgcccgaatgctgtgtggatgtggttggcgtgaatgctagttgtcccggggcttccctttgtggccccggttgctatcgccggtggaacgccgacgggagcgcctcctgcgtgcggtgcggtaatgggactcttccagcttacaatgggtcagagtgtagatcttttgctggacctggcgcgccctttcctatgaaccgatcttcgggcaccccaggacgccctcatccaggcgccccaagggtggcagcgagtttgttcctggggacttttttcatcagcagcggactgatactgagcgtggcaggatttttttacctcaaacgtagctccaagctgccccgtgcgtgctacaggcgaaacaagggaccggcccccgccggcagcctgccgggacgctggagcagccagcagtttgggccacaggcacccgcgctacaaccgggagaagctgtctccaacccccatcatccgggctag

SEQ ID NO: 25044 - DNA, 174 bp, Artificial Sequence
  Description of Artificial Sequence: Synthetic coding sequence
atggctttgcgccacttggcccttctggccgggctgctggtcggggtggcttctaagagtatggaaaacactgcccaattgcctgagtgctgtgtcgatgttgttggagtgaatgcctcttgccctggagcctccttatgcgggcctggctgctatcggaggtggaacgcctag

SEQ ID NO: 25045 - DNA, 1143 bp, Artificial Sequence
  Description of Artificial Sequence: Synthetic coding sequence
atggctcttcgacacttagcactgctcgcaggactactggtcggggttgcatctaagtccatggagaatacagtgacacggaacagtactgccgttatcaatactcaggctgaaggaacgctatccccacccggcctgtccagcctgcccgtggtacgggaatgggcactgacccatactgcccagctgcccgagtgttgcgtcgacgttgtgggagtgaatgctagctgccccggggcttccctctgcggacctgggtgttatcgacggtggaatgcagatggctccgcctcctgcgttaggtgtgggaacggcactctgcctgcatacaatggcagcgagtgtcgatctttcgcgggaccaggggcaccctttcccatgaatcgctcatctgggacccctggaaggccacaccctggggcgcctagggtcgccgcgagtctgttcttgggcacattcttcatatcatcaggactgatcctttcggttgcggggtttttctatcttaaacgatcgtctaaactgcccagggcttgctacaggaggaacaaggcaccagctctgcaacctggtgaggctgcagccatgatcccaccacctcagtctagtggcaacagcagctgccgaatccctctgtgggggtttcccagtctaggacagtcgcaaggcgccctgtgggtgtgtcctcagactggattacccggcagcgggtctcgcccccctctacctggatcccctggagaccccccgaccagacagggccagggccggatctggctcgtcccccccgccctggatttgtcctggatctggccagctccccccgcacgcccgcctctaatcccggtgacaagcatgctcttcccggttcctgagacttggggtctgcaggagaggaggacgcatcatgaccgcgccgatcctcagtatctgcttcttctggaggtgcagctacaccccagaacagatgcagcgggcctcaggcaagctctgctgtcctcccatcgttttagtggcgccggctccggaggaccgaaaagtcagcctgtcagaaaaccccgctacgtcaggcgtgagagacccttagatagggccacggatccagcggcgttccccggcgaagcacgcatcagcaatgtgtag

SEQ ID NO: 25046 - DNA, 603 bp, Artificial Sequence
  Description of Artificial Sequence: Synthetic coding sequence
atgtcggtcgttcccatcctggaggggcaggcactcaggatctgttcttgtagctggctggcctttagctgggagtcccctgcctctccatggaggaccaggccaagttgcccctcagccgtatggatgtggtgggctagcacaccagcagcacaagcccaggtgtgcgtggtgcaggcagtgaccggggccgggacaaggaccggagccccggccgcttctgctgtcggtaccgagccgtcccagccaactaccgcaccatcagttgaggccgtggtggccgggcctggggcacccttccccatgaatagaagttcaggaacgcctggcagaccccaccccggagcaccaagagtggcagcctccctcttcctcgggacttttttcatatctagcggtcttattctgtcggtggccggtttcttctacctgaagaggtcttccaagctcccccgagcatgctaccgtcgtaacaaagcccctgctctgcagccaggggaggctgcggctatgattcctcccccccagagcagtgacgtgggttctgccggcaaggaagatccccctcgccaggggcggcccccgatcccagcaccaccctag

SEQ ID NO: 25047 - DNA, 468 bp, Artificial Sequence
  Description of Artificial Sequence: Synthetic coding sequence
atgggagggaatggatcaacatgcaagcctgacacagagcgccagggtacactgagtacggccgcaccaacaacaagtccagcaccatgcctttctaatcaccacaataagaagcacctgatcctggctttctgcgccggagtgctgctgaccctgctgctgattgcgtttatctttttgattattaagtcatacagaaagtatcggagagaacgcctgccaatcagccccggcccccttctgcgctgggtgccgctattgtcaggaaccatggccgaccatagtaaacctcaagctccagacccacatagcgatcctcccgctaagctcagctccatccccggcgagagcctgacctacgcaagtaccacctttaaactttctgaagaaaagtctaatcatctggccgagaatcacagcgctgactttgatccgatcgtttatgcccagatcaaagttactaactag

SEQ ID NO: 25048 - DNA, 393 bp, Artificial Sequence
  Description of Artificial Sequence: Synthetic coding sequence
atgggaggcaacggcagcacctgtaaacctgacactgagcggcaaggaactctgagtacggcagccccaaccacctcccctgccccgtgtctgtccaaccaccataacaagaagcaccttattcttgccttctgcgcgggggtcctgctgacactgctactgatcgcttttatcttcctcattataaagagctaccggaaatatcacagcaaacctcaggccccagacccccacagcgaccctcctgccaaactctccagcatccctggggaatccttaacatacgcttctacaacttttaagctctctgaggagaaatccaatcatctcgccgagaatcattccgcagatttcgaccccatcgtctatgcacagataaaggtaacgaattag

SEQ ID NO: 25049 - DNA, 600 bp, Artificial Sequence
  Description of Artificial Sequence: Synthetic coding sequence
atggcaagcccgaaaggcttttttaattacctgacatacttccttgccgccggagcggtgacacttgggatcggtttcttcgctttggcgagtgccctgtggttcctaatttgtaaacgtagagaaatctttcagaattcaaagtttaaggcaatagatgaaaggtgtcggcagaggccgagtatggcaaaaatcaagagccattcgcagtgcgtgttcatcagcagaaacttccacaccgggcggttccagcttcaggaggagcagaggaagaaggaggccgcccacataaaggctatcaaagaccacagcaaggacgaaccccaactggcaaccaaaaacattatctgcgatccctctgagaccagtagtaccaccaacaggtcttccgtgactttatcattgagcacactgccatccgactcctattacagtcagagcattgaggccgctgatgattggttctcagatgattcattggtcaagcggaacagccccatgccgtcactgggcgaaccgctaatggagaaagtcttttcctacctcagcaccattagcctcgaggagggcacagaatcggtgctgaacgacaccttatag

SEQ ID NO: 25050 - DNA, 519 bp, Artificial Sequence
  Description of Artificial Sequence: Synthetic coding sequence
atgctgaccgaagtcatggaggtatggcatggtctggtgattgctgtagtttcactgtttctccaagcctgtttccttaccgccatcaactacctcctaagtcgacacatggcccacaaatcagagcagatcctgaaagctgcttcattgcaggtgccgcggcctagccctggccaccaccaccctcccgccgtaaaggaaatgaaggaaactcaaacagagcgggacattccaatgtcggattctctttatcgtcacgattccgacacacctagcgactcactggattcttcttgctcctcaccaccagcgtgccaggctaccgaggatgtggattatacccaagtggtcttcagcgaccctggcgagcttaagaacgactctccactggactatgaaaatataaaagaaatcacagattatgtgaatgtaaatcccgagcgtcataagccgtccttttggtattttgtgaatcccgctttatctgagcctgccgaatatgatcaggtggccatgtag

SEQ ID NO: 25051 - DNA, 342 bp, Artificial Sequence
  Description of Artificial Sequence: Synthetic coding sequence
atgaacgagaccaataagacactggttggaccctctgagctcccgacagcttcggcagtggccccaggccccggaacaggcgcccgggcatggccagttttagttggatttgtgttaggggccgtggtgctctccctattgattgcgctggccgccaagtgccacctttgcaggcgctaccacgctagctatcgccatcgccccctcccagagacgggtaggggtggtaggccccaggttgctgaagatgaagatgacgacggcttcattgaggacaactacatacagccgggaacaggggaattaggaaccgagggcagccgtgatcatttttccctatag

SEQ ID NO: 25052 - DNA, 342 bp, Artificial Sequence
  Description of Artificial Sequence: Synthetic coding sequence
atgaacgaaactaataagactctggtgggcccatctgagctgcccacagcatccgcggtggcgccagggccaggaacaggagcccgcgcgtggccggtgctggttggctttgtgctgggagcggttgtcctgtctctgctcattgcactggcagctaaatgtcatctgtgccgcagatatcatgcatcatacagacaccgccctctacccgaaacaggaagaggtggacgtcctcaggttgcggaggacgaggatgacgacggttttatcgaagacaattacatacaaccaggcaccggcgagctaggaacggagggatcaagggatcacttttccctttag

SEQ ID NO: 25053 - DNA, 1365 bp, Artificial Sequence
  Description of Artificial Sequence: Synthetic coding sequence
atgggccgcacatatattgtggaggagaccgttggacagtacctgtcaaacatcaatctccaggggaaggcctttgtttccggcctgcttattggccagtgcagcagccagaaagattatgtcattttggcaacacgcactccgccaaaagaagagcagtctgagaacttgaagcatccaaaggcgaaactggataacttggatgaagaatgggccactgagcatgcttgtcaggtcagtcgcatgcttcctgggggcctgctggtcctgggcgtgtttatcattactacactggaacttgcaaatgattttcaaaacgcgctgcgaaggctgatgtttgccgtggagaaaagtatcaaccgtaaaaggttatggaacttcaccgaggaggaggttagcgagagagtgactctgcacatttgcgcctcaactaagaagatattttgcagaacctatgacattcatgatcctaagagctctgcaaggcctgcggactggaagtatcagtcagggctgtcaagcagctggctgtccttagaatgcacagttcacattaatatccatatacccctatcagctacttccgttagttacacactggagaaaaatactaagaacggactgacaagatgggccaaagaaatcgagaatggtgtctatctgatcaacggccaggtaaaagatgaagattgtgatctcctggagggtcagaagaagtcgagcagagggaacacacaggccaccagtcacagctttgatgtgcgagtgttaactcagctgctacttaatagcgatcatcggtccaccgcaacggtccagatttgcagtgggagcgtgaacctgaagggcgccgtaaaatgcagggcctatatacatagttccaaacccaaggtgaaggatgccgttcaggccgtgaaacgtgacattcttaacactgtagcggacagatgcgagatgcttttcgaagatctgctgctcaatgagattccagaaaaaaaggactcagagaaagagtttcacgtgctaccataccgagtcttcgtaccactgcccggctcgactgtcatgttatgtgattataagttcgacgatgaatccgccgaggagatcagagaccactttatggaaatgctggaccatactatacagatcgaagaccttgagatcgccgaggaaaccaacaccgcttgtatgtcttcctctatgaacagccaggcatcccttgacaacactgatgatgagcagcccaagcagcccatcaaaaccacgatgctcctgaagatccaacaaaacattggggtgatcgctgccttcaccgttgctgtgcttgcggcgggtattagctttcattactttagcgactag

SEQ ID NO: 25054 - DNA, 1296 bp, Artificial Sequence
  Description of Artificial Sequence: Synthetic coding sequence
atgggccgcacgtatatcgtcgaagagactgttggccagtatctttcgaatatcaatctgcaaggaaaagcatttgttagtggattactcataggacagtgctcttcacaaaaagactacgtgattttggccacacgaactccccccaaagaagaacagtctgagaatctaaagcaccccaaagccaagctcgataacctggatgaggagtgggcaactgaacacgcatgtcaggtgagccgaatgttgcccggcggtctgctagttctgggcgtttttatcatcactacactggaacttgcgaatgactttcagaacgccttgcggcggctaatgttcgccgtcgagaaaagtattaatcggaaaaggttgtggaatttcactgaggaagaggtgtcagaacgggtgaccttgcacatctgtgctagcaccaagaaaatcttctgccggacctatgacattcatgatcctaagtcgagtgccaggcctgctgattggaaataccaatccgggctgagcagttcctggttatcactggaatgcaccgtccatataaacattcatataccgctctctgctacaagtgtgtcctacacactggaaaaaaacacaaagaacggccttaccaggtgggcgaaggaaatcgaaaatggagtgtatctgattaacggacaggtgaaagacgaagactgtgacttacttgaggggcaactgctcaacagcgatcacagaagtaccgccactgtccagatctgttctgggtctgtgaacttgaagggggcagtcaagtgcagagcctatattcatagcagcaagccgaaagtgaaagacgccgtacaggctgtcaaacgcgacattctgaacaccgtagctgaccgatgtgaaatgctattcgaggatctcctccttaatgagatccctgagaagaaggacagcgagaaagaattccacgtactgccctacagagtgttcgtgcctttgcccgggtctacagtgatgctctgcgactataaattcgatgacgagagtgcggaggagatcagagatcacttcatggaaatgctggaccataccattcaaatcgaagacttggaaattgctgaagagacaaacaccgcctgcatgtcaagttctatgaattcccaggctagcctcgataacacagatgatgaacagcctaagcagccaattaagaccacaatgctgctaaagatacaacaaaatatcggcgtcattgcagctttcactgtcgccgtgctcgcggctggtatctcatttcactacttttcggattag

SEQ ID NO: 25055 - DNA, 1269 bp, Artificial Sequence
  Description of Artificial Sequence: Synthetic coding sequence
atggggaggacatatatcgtggaggaaaccgtgggacaatatctaagcaatatcaacttacagggaaaggcctttgtttccgggttgctgattgggcaatgctctagtcagaaagactacgtcatattggcaacaaggaccccccctaaggaggagcagagcgaaaatcttaagcatcctaaagcgaagctggacaatttggacgaagagtgggccaccgaacatgcatgccagctaatgtttgccgtggaaaagagcattaatcgcaaaaggctgtggaacttcactgaggaggaagtgtccgagcgggtgaccctgcacatttgtgccagtaccaagaaaatattttgtaggacatatgatatacacgaccctaagagttccgctagacctgcagactggaagtaccagtctggcttaagtagtagctggctgagcctggagtgcacagtgcacatcaatattcatatccctctgtcggcaacaagtgtgagttatacattggaaaagaataccaaaaacggcttgacacgatgggctaaagaaatagaaaacggggtctacctcataaacggacaagtgaaagatgaggactgtgacctgctggaagggcagaagaagagcagtcgcgggaatacccaggccactagccacagcttcgacgtacgagtcttaacacaactcctgctgaactcagatcatcgcagtacagccacagtgcaaatctgcagcggaagcgtcaacctcaagggcgcagtgaagtgcagggcttacattcacagctctaaaccaaaggttaaagatgcagtgcaggctgtgaagagggacattctgaacactgttgcagatagatgcgaaatgctgtttgaagatctactccttaatgagatccccgagaagaaggattcggaaaaagagtttcacgttctgccatacagagtttttgtccctctaccaggctcaacagtaatgctgtgcgactacaagttcgatgatgaatcagcagaggagattagggaccattttatggagatgctggatcacacgatacaaatcgaggatctcgagatcgctgaagaaactaacacagcgtgtatgtcatcttccatgaactctcaagccagcctggataatactgacgatgaacagcccaagcagccaattaagacaacaatgcttttgaagatccagcagaacatcggcgtaatcgctgcgtttacagtagcagtcttggccgcgggcatctctttccactatttttctgactag

SEQ ID NO: 25056 - DNA, 1008 bp, Artificial Sequence
  Description of Artificial Sequence: Synthetic coding sequence
atgggccgaacctacatagtggaggaaaccgtggggcagtacctgagtaacatcaatctgcagggtaaggcatttgtttctggtttactaattgggcaatgcagcagccaaaaagactacgtcatcctggcaacccgcaccccgcccaaggaagaacagagtgaaaatttgaagcacccaaaagcaaaacttgataacctggacgaggagtgggctacagagcacgcgtgccaggtgagtagaatgctccccggcgggctgctcgtgcttggcgtcttcattattaccaccctggaactggcaaatgattttcaaaatgccctgcgccgcctgatgtttgctgttgaaaagtccatcaacaggaagagactttggaactttacagaagaagaagtctccgaaagagttaccctccatatatgcgctagcactaagaagatcttctgccggacctacgacattcacgaccctaagagctctgcaaggccagctgactggaagtatcaaagtgggctgtccagttcttggctaagtctagaatgcacggtgcatatcaacatacacattcctctgtctgcaacctcagtgtcttataccctggaaaagaacactaagaacgggctgacaaggtgggcaaaggaaatagaaaacggggtttatttaataaatggccaggtgaaggacgaagactgcgacctactagaaggacaaaaaaagtcgagtcgcggaaacacacaggctacttcacattcctttgacgtgagggtgctgacgcagctattgttaaatagcgaccatagaagcacggctactgtacaaatctgttccggctcagtaaatctgaagggagccgttaagtgtagggcctatatccactcgtccaagccaaaggtgaaagacgcagtgcaagcggttaaacgtgatatcttaaacacagtggctgatagatgcgaaatgctgttcgaagatctgttgctcaatgagatacccgagaagaaggacttctag

SEQ ID NO: 25057 - DNA, 240 bp, Artificial Sequence
  Description of Artificial Sequence: Synthetic coding sequence
atggcagcaccttctatgaaagagcgccaagtgtgctggggtgccagagacgagtactggaagtgcttggacgaaaatctggaagatgcgtcacaatgtaaaaaactgcgttctagtttcgagtccagctgtcctcagcagtggattaaatacttcgacaaacgccgggattatcttaagttcaaggaaaagtttgaggccggccagttcgaaccctcagaaactacggcaaaatcttag

SEQ ID NO: 25058 - DNA, 378 bp, Artificial Sequence
  Description of Artificial Sequence: Synthetic coding sequence
atgggtccaggaggtccactcctcagtcctagtagggggtttttgctttgcaaaacagggtggcacagcaaccgtctgcttggtgattgtggccctcatacacccgtctccaccgcgctgtcatttatagcagttggtatggccgccccgagcatgaaggaaagacaggtgtgttggggcgcccgggatgagtattggaaatgtctcgacgaaaatctggaagatgctagccagtgtaagaaactcagatcatctttcgagtcctcgtgcccacagcagtggatcaagtattttgacaagaggcgcgactacttaaaatttaaggagaagttcgaagctggccaattcgaaccctcagaaaccaccgctaagagctag

SEQ ID NO: 25059 - DNA, 468 bp, Artificial Sequence
  Description of Artificial Sequence: Synthetic coding sequence
atggttgcccgtaagggtcagaagtcccctcggtttagacgcgtgtcctgcttcttgcggcttggacgatctaccctcctcgagctggaaccggctggccggccctgctctggacggacgagacatagagccctgcataggaggttggtggcctgcgttacagtgagcagcagaaggcaccggaaggaagctggccggggcagggccgaatccttcattgccgtggggatggccgccccgagcatgaaagaaagacaggtatgctggggggcaagggacgagtattggaagtgtcttgacgaaaaccttgaggatgctagccaatgtaagaagcttaggagtagctttgagagcagttgtccacagcagtggatcaaatattttgacaagcgcagggattatctgaaattcaaggaaaaattcgaggctggccaatttgagccttcagaaacaacggctaagtcttag

SEQ ID NO: 25060 - DNA, 471 bp, Artificial Sequence
  Description of Artificial Sequence: Synthetic coding sequence
atggttgctagaaagggtcagaagtccccccggtttaggagagtcagctgtttcttgcgcctgggacggtccacccttctggaactcgagccagcaggacgcccctgttctggccgaactagacacagggcccttcaccggaggctggttgcttgtgtaaccgtgagctcacgacgccatcggaaagaagcaggcaggggtcgcgctgagtcatctttcatcgccgtgggtatggcagccccaagcatgaaagaacgccaggtgtgctggggggctcgcgacgagtattggaagtgcttggacgagaacctggaggacgcctcccagtgcaagaagttgcgaagctcctttgagtcatcttgtccccagcagtggatcaaatacttcgacaaaaggagagattatcttaagtttaaagagaaatttgaggccggccagtttgagcccagtgaaactactgctaagtcctag

SEQ ID NO: 25061 - DNA, 660 bp, Artificial Sequence
  Description of Artificial Sequence: Synthetic coding sequence
atggccagtggctccaactggttatccggcgtgaatgtggttctcgtgatggcctatgggtcactggaccttaaggaggagatcgatattcgcctgagccgcgtgcaagacatcaagtacgaaccgcaactgctggcagacgatgatgcacggctgttgcagctggagacacaagggaaccagtcatgctacaattatctatacaggatgaaggccttggatgccatccgcaccagtgaaatcccctttcattcagaaggaagacaccctagatctctgatgggcaagaattttcggtcttatctgttggatctccgaaacaccagcacacccttcaagggcgtccggaaagccttaatcgacacacttcttgacggctacgagaccgcacggtatgggacaggagtgttcggccagaacgaatatctgagataccaggaggctttatctgaactggccaccgcggtcaaagcacggatagggtcaagtcaaagacaccatcaatctgcggccaaagacctaacacagtctcccgaggtgtcccccaccaccatacaagtcacctaccttccctccagtcaaaaatctaagagggcaaagcatttcctggagctgaagagttttaaggacaactacaataccctagaatcaactctctag

SEQ ID NO: 25062 - DNA, 606 bp, Artificial Sequence
  Description of Artificial Sequence: Synthetic coding sequence
atggcctccggttccaactggctctcgggtgttaatgtggtgctggttatggcttacggttccctggatcttaaagaagagatcgatatacggctaagccgggtgcaggacattaaatatgaaccacagcttcttgcagacgacgatgctagacttttgcaactggaaacccagggtaaccagaagatcccctttcacagcgagggtcgtcatccgagatctctgatgggtaagaatttcaggagttatcttctggatctgcgcaacacctccactccgtttaagggtgtgcgaaaagccctcattgataccctgctggatggatatgagacagcccgttacggaacaggggtcttcggccagaatgagtacttgcggtaccaagaagctctttcggagttggctacagctgtcaaggctagaatagggtctagtcagcgccaccaccagtccgcagccaaggacctcactcagagtccggaagtcagtcccaccacaattcaagttacttatctgccgagctcccaaaaatcgaagagagccaaacacttccttgagctgaaatcatttaaagacaactataacacactggaatccactctctag

SEQ ID NO: 25063 - DNA, 468 bp, Artificial Sequence
  Description of Artificial Sequence: Synthetic coding sequence
atggcttcgggctccaattggctgtctggagtgaacgttgtcctggttatggcttacggatccctcgacctcaaggaggagatcgatattcgcctttcccgagttcaagatatcaagtatgagccacagctactggccgatgacgatgcccgactgttgcaactggagactcaagggaatcaatcatgctataactatttgtaccggatgaaagctctcgacgcaatcaggacttccgagatcccattccatagcgaggggagacatccccgttcgcttatgggcaaaaatttccgatcctatctcctggacctgagaaatactagtacgccctttaagggggtgcgcaaggccctaatcgatacactgttagatgggtacgagacagcaagatacggaaccggggtcttcggacagaatgaataccttcgataccaggaggccctctccgaactggcaaccgcctag

SEQ ID NO: 25064 - DNA, 570 bp, Artificial Sequence
  Description of Artificial Sequence: Synthetic coding sequence
atggcctccggctccaactggctgagtggtgtcaatgtggtgcttgtgatggcatacgggagtctggtgttcgtgctactgttcatcttcgtcaaacggcagataatgagattcgctatgaagtctcgtcggggcccacacgtgccagttggtcataatgcccccaaagaccttaaggaggaaatcgatatcaggctcagtagggtccaggacataaaatacgaaccccaattgctggcagacgacgacgcgagattgttacaacttgaaacacagggcaatcaatcgtgttacaactacctgtatcgaatgaaagcactggatgcaattaggacctcagagataccatttcacagcgagggacgacatccacggtctctaatgggaaaaaacttccggtcatacctcctggatctccggaacacaagtaccccttttaagggagtccgaaaggcactgatagatacgctcctggatgggtacgagacggctaggtatggtacaggagtgtttggacagaacgaatatctgcgatatcaggaggctttgtccgaactggctaccgcctag

SEQ ID NO: 25065 - DNA, 708 bp, Artificial Sequence
  Description of Artificial Sequence: Synthetic coding sequence
atggcctccggatcaaactggctgtcaggcgtcaacgtggtcttagtgatggcatatggctccctcgtcttcgttcttttatttatttttgtcaagcgtcagatcatgcgattcgcaatgaagtccaggaggggcccccacgtgccagtggggcataacgcgcccaaagacctcaaagaagagatcgacatccgcctaagcagggttcaagacatcaagtacgagccccagttactggccgatgacgacgcacggctgcttcaactcgagactcaagggaaccagaagattccgttccatagcgagggaagacaccccaggtccctcatgggcaaaaatttcaggagctacctattagacctcagaaatacctctacgccattcaaaggcgtgagaaaggccttgatcgacacactcttggacggatacgaaaccgctcggtatgggacaggtgtgttcggtcagaatgagtatttgcggtaccaggaagccctgagcgaactcgccactgctgttaaagcgagaataggcagcagccagcgacatcatcagtctgccgctaaagacttaacccaatcccctgaggtgagccctaccaccatccaggttacttacttaccaagcagtcaaaagtccaaacgggccaagcactttctcgagctcaagtcatttaaggacaactataacacgctagaaagcacattatag

SEQ ID NO: 25066 - DNA, 762 bp, Artificial Sequence
  Description of Artificial Sequence: Synthetic coding sequence
atggcgtccggatcaaattggctcagcggtgtgaacgtcgttctggtgatggcttacggaagtctggtcttcgtactgctcttcattttcgttaaaaggcagatcatgaggtttgctatgaaatcccgtcggggacctcatgtgccagtagggcacaatgcaccaaaagacttaaaagaagagatcgatattagactgtctcgcgtccaggacatcaaatacgaacctcagctcctcgccgatgatgatgccagactgcttcagctcgagacacaggggaaccagtcttgctacaactacctgtatcgcatgaaggccttggacgccattcgcacctccgagatccctttccattctgaagggcggcaccctaggagcttaatgggcaagaattttcgtagctacctgctggatctaagaaacacaagtactccattcaagggcgtgagaaaagctctcatcgacacactcttagacgggtacgaaacggcgcgatatgggactggcgtgttcgggcagaacgaataccttcgctaccaggaggcattatcagaattggccacagcagtcaaggcacgcattggttcttctcagcggcatcaccagagcgcagcaaaggatctgacccagagccccgaagtctccccaactacaattcaggtaacatacctgccctcgagccagaagtctaagagggccaagcatttcctggaactcaagagctttaaagataactacaacacattggagagtaccctctag

SEQ ID NO: 25067 - DNA, 1221 bp, Artificial Sequence
  Description of Artificial Sequence: Synthetic coding sequence
atgcggggatccgttgagtgtacgtggggctggggccactgcgctcccagcccactgcttctgtggaccctgttgttgttcgctgccccattcggtctactcggagaaaaaactcgccaagtctcgcttgaggttatcccgaattggctagggcccctccaaaacctgctgcacattcgagctgtcggtactaactctacacttcactacgtatggtccagtctcggtccgttggctgtcgttatggtcgccactaataccccccattccacactctccgtgaattggtcactcctgctaagtccagagccagatggtggattaatggtgctgccgaaggattccatccaattctccagcgcgctcgtgttcactcgcctgcttgagttcgactccactaacgtgtccgataccgccgctaagccactgggccgaccataccctccatactccttggcggacttctcttggaataacattaccgattcgcttgaccccgcgactctaagtgccacctttcagggccaccctatgaatgatcccactcggacctttgccaatggttctctggcctttcgagtgcaagccttctcacggagcagccgcccggcacagcccccccgcttattgcacaccgcagacacctgccagctcgaggtcgcactcataggcgccagtcccagaggcaaccgctccttgttcggactggaggttgctactcttggccagggccccgactgtcctagcatgcaagaacagcacagtattgacgatgagtatgcacccgccgtgtttcagctagaccaactgctatggggaagtctccccagcgggtttgctcagtggcggcccgtggcatacagtcagaaacccggcggtcgtgaatccgctttaccatgccaagccagcccactgcaccctgccctcgcctacagtctccctcagtcgcctatcgtgagagctttttttgggtctcagaacaacttctgcgccttcaatcttaccttcggcgcgtcaaccggcccggggtactgggaccagcattacttgtcctggtccatgctactgggcgtcggcttcccccctgtggacggcctgtccccacttgtgctgggcataatggccgtggcactgggcgcacctggcctgatgctgttgggcggaggactggtccttctcctccatcataagaagtactcagagtaccagtccattaactag

SEQ ID NO: 25068 - DNA, 3765 bp, Artificial Sequence
  Description of Artificial Sequence: Synthetic coding sequence
atgaagaaacatagaagagcattagcactcgtatcatgcttgtttctctgttctttagtgtggctgccttcttggcgagtctgctgtaaggagagcagttcagcatccgcctctagttattattctcaggatgacaactgtgccctagagaacgaagacgtgcaatttcagaagaaggatgagcgggaaggccccatcaatgccgagtcactggggaagtctggatctaatctgcccatttctcccaaggaacacaagctcaaggatgactcaatcgttgacgtccagaacactgagtccaagaagctctcccctccggtcgtcgagaccctgcctactgtggacctccacgaggagagcagcaacgctgtggtcgactctgaaactgtggaaaacatttcatcgtcttctacctccgagatcacccctatatccaagctggacgaaatagagaaaagcggtactattcctatcgccaagccatctgaaaccgagcagtccgagaccgactgcgatgttggcgaggcactggatgcgtctgctccaatcgaacaaccttcatttgtgtcacctccagattctctggtgggccagcatattgaaaacgtctcctcctcgcacggtaagggcaagattactaaaagtgaattcgagtctaaagtgagcgcgagtgagcagggtggtggcgacccaaagagtgcacttaatgctagcgacaatctgaagaatgaatcgtcagactatacaaagccaggggacattgaccctacgtctgtggcatcacctaaagatccggaggacatccccacatttgatgaatggaaaaagaaagtgatggaggtggagaaggaaaagagccagagtatgcacgcttctagcaatggcggctcacatgccaccaaaaaagtgcagaagaatcggaataattacgcctcggtcgagtgcggcgctaagatactcgccgcgaatccagaagccaagagcacctcagccatcctgatcgaaaacatggatttgtatatgctgaatccctgttcaaccaaaatctggtttgttatcgagctgtgtgagcccattcaggtgaaacagttagacattgccaattacgaactgtttagttccacccccaaggattttctggtgtcaatctccgacagatatccgacgaacaagtggattaaactcggcaccttccatggacgtgacgagcgcaacgtccagagctttcccttagatgagcagatgtatgccaaatacgtcaagatgtttattaagtatatcaaggtagagctacttagccactttgggtcagagcacttttgccccctaagcctcatcagagtgttcgggacttctatggtggaggaatatgaggagattgcagacagccaataccattccgagcggcaggagttgttcgatgaggattacgactatccactggactataatactggggaggacaagtccagtaagaatctactgggaagcgctactaacgccatactcaatatggtgaacatagccgccaacatacttggggctaaaaccgaggatctaaccgagggcaacaagagcatctctgagaatgcaacagcaactgccgcccccaagatgcccgaaagcacacccgtttccacaccggtcccttccccagaatacgtgaccactgaagtgcatactcatgacatggagccttccactcctgatacacctaaagagagccctatcgttcagctagtccaggaggaggaggaggaagcttcaccatccacagtcaccctgcttgggagcggcgaacaagaagacgaatcatcaccttggtttgaaagtgaaacccagatcttctgttcggaactgacaacgatctgctgtatctcttccttctccgaatatatctacaaatggtgctccgtccgggttgcgctgtatcggcagagaagcaggactgcactcagtaagggcaaagattaccttgtgttagcccagccccctcttctactgcccgccgaatcagtggacgtgagtgtgttacagcctctgtccggcgagttggagaataccaacatagagagggaggccgagacggtagtgttgggggacctaagcagttccatgcatcaggatgacctcgtcaatcacactgtcgacgctgtcgagctggaacccagtcacagccagaccctgagccaaagcttgctccttgacattacccctgagattaaccctctaccaaagattgaggtgtccgagtcagttgagtacgaggccgggcatattccctcccctgtcataccccaggaaagcagcgtagaaatcgacaatgaaacggaacagaagagcgagtcattctcgagtatagagaaacccagcattacttacgaaactaataaagtaaacgagctgatggataacattattaaggaagacgtgaatagcatgcagatatttaccaaactgtcggagactatagttcctcctatcaacactgccaccgtgcctgataacgaggacggtgaggctaaaatgaacatagccgacacagctaaacaaacactgatctctgtcgttgactctagtagcctgccagaggttaaggaagaggaacagagtccggaggatgccctcttgcgaggacttcagcggactgctactgatttctacgccgagcttcagaatagcactgacttgggatacgccaacggaaaccttgtgcacggaagcaaccaaaaggagtcagttttcatgcggctcaacaatcgaataaaagcgctggaggtcaacatgtccttgagcggaaggtatcttgaggagctttctcagcggtacaggaagcagatggaagagatgcagaaggcatttaacaagaccatcgtgaagttgcaaaatacgtcccgaattgcagaagaacaagaccagcgccagaccgaggcaattcagctgctccaggctcagctcacaaacatgacacaacttgtaagtaacctctctgcaacagtagccgagctgaagagggaagtttctgacagacagtcatatttggtcatcagtcttgtgctgtgtgtggtgctggggttgatgctatgcatgcagcggtgtcgaaatacttcgcaatttgatggggattatatcagcaagctgcctaagtccaaccaatatccctctccaaaacgatgctttagctcttacgacgatatgaacctcaagcgcagaacttcatttcccctgatgcgttctaaatctctccagctcaccggcaaagaagtcgatcccaacgatctgtatatcgtcgagcccctcaagttcagtcccgagaagaagaagaagagatgcaagtataagattgaaaagatcgaaacaattaagcctgaggagcccctccacccgatcgcgaacggtgacatcaagggaagaaagccttttacaaatcaacgggatttctctaatatgggcgaagtataccactcttcatataaaggtcctccaagcgagggttccagcgagacatcttctcagagtgaagagtcttatttctgcggaatatctgcctgcacaagtctgtgcaacggtcagagccagaagaccaaaaccgaaaagcgcgctctcaagaggcggcggtctaaagtccaggaccaaggcaagctgatcaagaccctcattcagaccaaatctggtagcctgccctctctccatgacataatcaagggtaacaaggagattaccgtcgggactttcggggttacagccgtcagcgggcacatctag

SEQ ID NO: 25069 - DNA, 4221 bp, Artificial Sequence
  Description of Artificial Sequence: Synthetic coding sequence
atgcgagggttcctggctcgacctttcctgtccactaaccaacatttagcacagtggggaagtcccttacctcagggtaagggccttgtccagcttccttcgcagcacacccgccactcaagaccctttcatgagttgtgcagtaaggaagaaaactcagcaaccgttcccaagctgatctctttggtagtgtcgtctgagaccatcgatttcagcaataaaaccatggattcgagacgtgactgggagagagagaagcgtatcctcgaggggaagctgcagctgcccaaagctctagcgagaacccagcgcgcccgagatgaaggtagacgagcctggacatcccgctggctccagagacgtcggtcaccggaatcttgtgaggcccctctgagtgcccccctgtggggaccccagcgaggcctgcctggcagggaacccctgaggagtcgaagtgcgagcgcaattgcactcagaacaatcgggcacatactagcactcctgttacggctgcttcacctgggcctggggtctgggggatgtagagaagatgtgccaccgtcggggcggggtaaaaaggaggagaagatgaagaaacaccgacgagcgctggccctggtttcatgtctgtttttgtgtagcctggtctggctgccaagttggagggtgtgctgtaaagaatcgtctagtgcctctgcctcctcctattattcacaggatgataactgcgccctcgagaacgaagatgtacaatttcagaaaaaaaataccgagtccaagaagctgagcccaccggttgttgagacgctgcccaccgtggatctgcatgaagagtcgagcaatgcagttgttgacagtgaaaccgtggaaaacataagtagttcaagtacgtctgagatcacccctatatccaagctggacgaaattgaaaaaagtgggacaatccccatcgccaagcctagcgagactgagcagtcagaaacggattgtgacgtgggcgaagctctggatgctagcgcccctatcgaacagcctagcttcgtgagcccacctgacagcctggtcgggcagcacattgagaacgtttcatcatcacatggcaaaggaaagattaccaagagtgaattcgaatctaaggtctcagcctcagagcagggaggtggcgaccccaagagcgcattgaatgcaagcgacaacttgaagaatgaaagcagtgattacaccaagcccggagatatagacccgacaagtgtcgcttccccaaaagatccggaggatattccaaccttcgacgaatggaaaaaaaaggtaatggaggtggagaaggagaaatctcagagcatgcatgcctcttctaatggcggcagccacgcgacaaagaaggtgcaaaagaaccgcaacaactacgccagcgtcgaatgtggcgctaaaattctggccgccaatcccgaggcaaaaagcacatccgccattttaatcgaaaatatggatctctatatgttgaatccttgcagcactaagatttggtttgtcatcgaattgtgtgagccaattcaggttaaacagttggacatagctaactacgaattgttcagttctactccgaaagactttctcgtgagtatttcagacagataccccaccaataagtggatcaaactcggaacatttcatggacgggacgagcgcaacgttcagtcgtttccgttggatgaacaaatgtacgcgaagtatgtgaaagtcgaactactcagccactttggcagtgaacacttttgcccattatctctaattcgtgtatttggtacatctatggtcgaagagtacgaagagatcgccgacagtcaataccattctgaaaggcaggagttgtttgacgaggactacgattatccacttgactacaatactggagaagacaagtcttccaaaaatctgctggggtccgccactaacgctattctcaatatggtcaacatcgctgccaatatcctgggggctaaaaccgaggatttaaccgaagggaataagtcaattagtgaaaacgccacagccaccgccgccccaaaaatgcctgaatccactcctgtgagcactccagtgccctcaccagagtacgtgaccactgaagtgcacacacacgacatggaaccctctacccccgacacgccaaaggagtctcccatcgtgcagttggttcaggaggaagaggaggaggccagccccagtacggtgacactcctgggtagcggagaacaagaagacgaatccagtccatggtttgaatctgagactcagatcttttgcagcgagctgaccaccatttgctgcatctcaagcttcagcgagtacatctacaagtggtgttccgtgagagtggccctgtataggcagagaagccgaactgccctgtcaaaaggcaaggactatctggtcttagcccagccccccctcctgttgcccgccgaaagcgtagacgtgagtgtactgcagcctttgtctggcgaactagagaacaccaacatcgagagagaagccgagacagtggtgctgggtgatctcagcagctccatgcatcaggacgacctggtgaaccataccgtcgatgccgtggaactggagccctcgcacagccagaccctgagccaaagcctgctgcttgacattactcccgagattaacccacttcccaagatcgaggtaagcgagagcgtggaatacgaggcaggccatatccctagtccagtgattcctcaggagagttctgttgaaattgacaatgagacagagcagaaatcagagtcattttccagcattgagaaacccagtatcacgtacgaaaccaacaaagtcaatgagctcatggacaacatcataaaggaagatgttaacagcatgcagatcttcaccaagctctcagagacaatcgtgccccccatcaataccgcgacagtcccagataatgaggatggagaagccaagatgaatattgcagatactgccaagcaaacgcttatttctgtcgttgactcatcttcccttcctgaagtgaaagaagaagaacaaagcccagaggacgcgctcctcaggggccttcagcgtaccgctacagatttttatgccgagctgcagaacagcaccgatctgggctatgccaacggtaatcttgtgcacggtagcaaccagaaggagtccgtctttatgcgattgaacaatcggattaaagccctcgaggtcaacatgagcctcagtggaagatatctggaggagctctctcagaggtatagaaagcagatggaggagatgcagaaggcctttaataaaacaatagtgaaattgcagaatacctcacgaattgctgaagagcaggatcagaggcagaccgaagctattcagttgttacaggcgcagcttaccaatatgacacagctcgtgtcaaatttgtcggctaccgtggctgaactcaagcgcgaggtgtccgataggcagtcttacctggtaatcagccttgtgctgtgcgttgtgctgggactgatgctgtgcatgcagaggtgtcggaatacctcccagtttgacggagattacatatcaaagctcccgaaaagtaatcagtacccctcgccgaaacgatgcttttcgagctatgacgacatgaatctcaaacgtaggacttcctttcctctgatgagatctaagtctttgcaactgaccggtaaggaggtagaccccaacgacctttatatcgtggaacccctgaagttcagtccagagaaaaagaagaaaagatgtaagtacaaaatcgagaagattgagaccatcaaacctgaggagccgttgcacccaattgccaacggcgacatcaagggaagaaagccgtttactaaccagagagacttttccaatatgggagaggtctaccactcttcatataaaggcccacccagcgaaggctcctccgaaacctccagccagtccgaagagtcgtacttttgtggcatttcagcctgtacctcactatgcaacggtcagagtcagaaaacgaaaacagaaaaaagagcgctgaaacggcggcggtctaaggtccaggatcaagggaagctgattaagaccttgattcaaaccaaatctggatcgctgccatctctgcacgacattattaaagggaataaggaaattacagtcggtacctttggtgtaaccgccgtgtcaggccacatctag

SEQ ID NO: 25070 - DNA, 1227 bp, Artificial Sequence
  Description of Artificial Sequence: Synthetic coding sequence
atgccagtgattagcagtcggcaggactgtgactctgctacctccaccgtcactgacattctgtgcgccgccgaagtgaagagcagcaagggtacagaagacagaggccgcattctaggcgatagtaatctccaggtttctaaactgctgtctcaattccccctgaaaagcaccgagacaagtaaggttcctgataataagaatgtgctggacaaaactcgggtaacgaaggactttctccaggataacctgttcagtggccccggacccaaagagcctacgggactgagtccgttcctcctgctgccccccagaccgccaccagctcgccccgacaagctacccgagctacccgcccagaaacgtcagcttccagtgttcgccaagatatgttccaaaccaaaagcagaccctgcagtggaaaggcaccacctgatggagtggtccccgggcaccaaagagcccaaaaaagggcagggctcgctctttctgagccaatggccacagtcccagaaggatgcttgtggggaggaggggtgttgtgacgccgtgggcactgcctcgttgactttgcctcccaagaaacccacctgtcctgctgaaaagaacctcctgtacgagtttctgggagccaccaagaatcccagcggccagccgagactacgcaacaaggtggaagtagatgggccagaactcaagtttaacgccccagtcactgttgctgacaagaacaaccccaagtacactggaaacgtgtttactcctcacttcccaacagccatgacgagcgctacattaaaccagccactttggctgaacctgaattacccccctccccccgtgtttaccaaccattccacttttctgcagtatcagggactgtacccccaacaggccgcgcgtatgccctaccagcaagccttgcacccccagctgggttgttattctcaacaggtaatgccctacaatccccaacagatgggacagcagattttccggtctagttacacccctcttctctcatacatcccttttgtccagccaaattatccttacccgcaaaggactcctcctaaaatgtctgccaaccctagggaccctcccttgatggcaggcgacggaccacagtatttgtttccccagggttacggctttggaagcacctccgggggtcccctaatgcactctccatattttagtagtagcggtaatggaatcaatttttag

SEQ ID NO: 25071 - DNA, 1797 bp, Artificial Sequence
  Description of Artificial Sequence: Synthetic coding sequence
atgagagggggcggtggttgcgtactagctctgggcgggcagagggggttccagaaagagcggcgtcggatggcctctggaaacggcctgccgagcagtagcgcactcgtggccaaggggccttgtgcgttgggtccatttccccggtatatttggatccaccaggacacacctcaggattccctggataagacctgccacgaaatctggaagagagtccagggcttaccggaagccagccagccttggacgagcatggagcaactgagcgtgccggtggtgggaacactgcgaggcaacgagctgagttttcaggaggaggcattagagctgagtagtgggaaggatgaaatctctctgttagtggagcaggagttccttagcctgaccaaggagcactccattctggtggaggagtctagcggggaattggaggtccccggcagttccccagagggaacaagggagctcgccccctgcatcctcgcgcctccactggttgccggtagtaatgagcgacctagggcctctatcatcgtaggagacaaactgttgaagcagaaggtggccatgcctgtcatttctagccgacaggactgtgattctgccacctctaccgttactgacatcttgtgcgccgccgaggtaaagtccagcaagggaacggaagacagggggaggatcctgggggactctaatctacaagtgtcaaagctcctctcacaatttcctctcaaatctactgaaacatccaaggtgccagacaacaaaaatgtcttagacaagaccagagtcacaaaagatttccttcaggataatctcttttccggtccaggccccaaagaaccaactggactttcaccctttttattgctacccccccgtcctccccctgctagacccgataaactgccagaattgcctgctcagaagaggcagctacctgtatttgccaagatatgctctaaacccaaagctgacccagctgtggagaggcatcaccttatggagtggagcccaggtacaaaagaacccaagaaaggccagggatccctctttctgtcacagtggcctcagtcccagaaggatgcatgcggcgaagaggggtgttgcgatgccgtgggaactgcctcactgactcttccccccaagaagccaacctgtccagctgagaaaaacctgttgtatgagttcctgggagcaaccaaaaatcctagcgggcagccccgcctgagaaacaaggttgaggtcgatggtcccgagctcaagttcaacgccccggtcacagtagccgataagaacaaccccaaatatacagggaacgtgttcactcctcacttccctaccgccatgaccagcgccactctgaaccaacccctgtggctcaacctcaattaccctcccccccccgtctttaccaatcattccacgttcctgcaataccaagggctttatccccagcaagccgcacgaatgccctaccagcaagcactgcaccctcaactgggctgttattcccaacaagtgatgccatataacccccagcagatgggccagcagatcttccgatcaagttacacgcccttgctgtcctacattccgttcgtccagcccaattacccttacccgcagcgaactccacccaaaatgtccgcaaaccctcgtgatccacccctgatggctggagacggtcctcaatacctcttcccacaggggtacggctttggctctacctccggcgggcccctaatgcattccccatacttctcctcttctgggaatgggattaacttctag

SEQ ID NO: 25072 - DNA, 426 bp, Artificial Sequence
  Description of Artificial Sequence: Synthetic coding sequence
atggaacctagccataaagatgcggaaacagccgctgctgccgcagcagtggcagctgctgatccgcgtggcgcctcttcctcttcaggcgtggtggtgcaagtgcgagaaaagaaaggacctcttagagcagccattccatatatgcctttccctgttgcagtgatttgccttttccttaatacatttgtgcccggcctggggactttcgtgagcgcatttaccgtgctctgcggggcgaggacagatcttccagatcgccacgtgtgctgtgtgttttggcttaatattgctgcagcgctaattcagatactcactgcgatagtgatggtgggttggatcatgtcaatcttctggggtatggatatggtaattttggctatctcccaggggtacaaggagcagggtataccccagcagctatag

SEQ ID NO: 25073 - DNA, 426 bp, Artificial Sequence
  Description of Artificial Sequence: Synthetic coding sequence
atggagccgtcacacaaggacgccgagacagctgccgctgctgctgcagttgccgcagctgacccaaggggcgcctccagttctagcggcgttgttgtccaggtgagagagaaaaaaggtccattgagagctgccattccttacatgcctttccccgtcgcagtgatctgtctgttcctgaacacatttgtacctggtctggggaccttcgtgtccgccttcaccgtcctctgcggagcgcgtacggatctcccagataggcacgtttgctgcgttttctggctgaatatcgccgcggctctgatacagattcttaccgccattgttatggtagggtggataatgtctattttttgggggatggacatggtgattctcgccaccagcaccgggtacaaagagcagggcattccacagcagttgtag

SEQ ID NO: 25074 - DNA, 639 bp, Artificial Sequence
  Description of Artificial Sequence: Synthetic coding sequence
atgcgttcccgattgctcctgagcgtggctcatctacctacaattcgcgagaccacagaggagatgctgttgggcggccctgggcaggagcccccccccagtccttcgttggatgactacgtgcggagtatatccaggctcgctcagcccactagtgtgctggacaaggctaccgcccagggccagcctcgaccaccccatcgtcccgctcaagcctgcaggaaggggaggcccgccgtttctctcagggatattacagcccggtttagtggacagcagcctactctgccaatggccgatactgtcgatccactggattggctcttcggtgaaagtcaggagaagcagcctagccagcgcgatctcccacggcgtacagggcctagtgctggtctctggggacctcatcgccagatggactcttcgaaacccatgggtgccccaaggggaagactgtgcgaggcaaggatgcctgggcactccctcgctaggcctcctcaggatggacagcagtcaagcgaccttcggagttggacatttggccagagtgcgcaggcaatggcttctcgtcataggcctaggccctcctcagtgcttcggaccttgtacagccacttgccagtcattcacgagctgtag

SEQ ID NO: 25075 - DNA, 384 bp, Artificial Sequence
  Description of Artificial Sequence: Synthetic coding sequence
atgcgtagccgcttattactgtctgtggcacacctcccaacaatccgcgaaaccacagaggagatgctgttgggaggcccagggcaggagccccctcccagtccttctttggatgattatgtgagatccatttccaggctcgctcagcctacttctgttttagacaaagccaccgctcagggccaacccagaccacctcatcgacccgcccaggcatgccgtaagggacgcccggccgtgagtctcctggcctcaggcgtgcacatcgacagatggactgcagctagtccatgggggccgccggaaggcggatccgtcaaaccaggctgcctcggtatcccctggcaggaccacaggcggatgggatccagggctttgacatag

SEQ ID NO: 25076 - DNA, 255 bp, Artificial Sequence
  Description of Artificial Sequence: Synthetic coding sequence
atgcgaagtcggcttctcctgtctgtggcccacctccctacaattcgcgaaaccaccgaggagatgctgctagggggccccgggcaggagcccccccctagcccttccttggacgactatgtacgctcaatctcacggttagcccagcctacctctgtgcttgataaagccaccgcacaggggcaacctcggccaccccatcgcccggcccaggcttgtcgtaaaggccggcccgctgtgtccctgcgggattag

SEQ ID NO: 25077 - DNA, 504 bp, Artificial Sequence
  Description of Artificial Sequence: Synthetic coding sequence
ctcggcttgttggtcgaacgtcaggagtctgaaggattgcctcgtgttcgtccacccgtgcacggcagaccccaggcaacagctgccggcataacaggggccatgtccactgaaggtccttcgttggcaagctcacctgctatttccccactggccttcctctccgccccagtgacccctggaaccctggccgaagcaacagacccgctgcctatgctcatcgctctggcatgtatattcctccttcttgctacctgtttgcttttcatgacactgtgtaaacccgccgccctcgaccctagccgccgacgcgctcacgaatgtatgccacaccatccaggtagcccatccgaaccccagctgagactgtggaaacggctcggaagtctgaggctgtccctgcactcttttagacacgggcgacctacagtgcctcgccaacccctgcctggcccagaagataatcgatcgcactgcgactacatggaatcaaccaagatgtag

SEQ ID NO: 25078 - DNA, 402 bp, Artificial Sequence
  Description of Artificial Sequence: Synthetic coding sequence
atgagcaccgaaggcccgagtctagcttcatcccccgccatatctccgctggcattcctgagcgcccctgtaactcccggcactctggcagaggcaacagaccccctgccaatgctcatcgcccttgcttgcatcttcctgctgttggcaacatgcctgttgttcatgaccctctgtaagccagccgcccttgatccttcccggcgtagagcccatgagtgtatgcctcaccatcccggatcccctagcgagccccagctccggttgtggaagcggctgggttcactccgcctttctcttcacagctttcgtcacggcagacccaccgttcctaggcagccactgcctggacctgaggataataggtcccactgtgactatatggagtcgaccaaaatgtag

SEQ ID NO: 25079 - DNA, 402 bp, Artificial Sequence
  Description of Artificial Sequence: Synthetic coding sequence
atgagtaccgagggacccagcctcgcgtccagtcctgccatctctccactcgcttttctgagcgctcctgttactccaggcactctggcggaggcaaccgatcccctacccatgctcatcgccctcgcctgcatcttcttactactggccacatgcctgctgttcatgactttatgcaagcccgccgctcttgaccccagtcgaagacgggcccacgaatgtatgccccaccaccccggttccccatccgaacctcaactccggctatggaagcgcctgggcagcctccgtctgtcacttcattctttcaggcacggccgcccaacggtgccacggcaaccactgccagggcccgaggacaataggagtcactgtgactacatggagagtaccaagatgtag

SEQ ID NO: 25080 - DNA, 468 bp, Artificial Sequence
  Description of Artificial Sequence: Synthetic coding sequence
atggaatcccttcagacgccgcagcatagagagaatcaggataagagagagaaggaatacggcgtgaagcacatgccgatgggaaacaatgctggaaatttagaacctgagaaaaggaaggcggttcgcgtggcactgtcttctgctaccgccgcacaaaacatcccaagcagtgtccactgtggatgcagtaagcagtggagacttcgactgccctcagaatcattacagtcaaggggtcaggtcatgaagcggccaaataacatccttaaactccgcaacctcgatctgctgatctatccttggcccgaactaaggagaagacaagtggcatcggacctgatgagtcttctgttgctcccagccttttctgggctcacttgggcaccattcttattcctgttcacctatctccctccctttctgaatctgctcaccgtgggatttgtgagttacttccttgtgtag

SEQ ID NO: 25081 - DNA, 1524 bp, Artificial Sequence
  Description of Artificial Sequence: Synthetic coding sequence
taggagtgccccaggggccgctccgcccttctcaaaggccctccccaggagaaaccaaaccgtcggagtgctctgttgagcgtgggcgaaatttcagagctgtgcccagaaatcacagactttttgtgccgtgataaaaagtgcattgcctcccatctcctatgtgactacaaacctgattgtagtgaccggagtgatgaggctcactgcgctcattatacgagtacaacaggctcatgcaacttcgagacctcttccggcaattggacaaccgcttgcagcctcacccaggatagcgaagacgacttggactgggctataggtagccgaatcccagcgaaggctttgattcctgactcagaccacactccggggtccggccaacatttcctctatgttaactccagcggttccaaggagggaagtgtcgcccgcatcactaccagcaaatcctttcccgcgagccttggaatgtgtacagtcaggttttggttctatatgatcgatccgcgctccatggggattcttaaggtgtatactatcgaggagtccggactcaacatactagtatggtccgtgattgggaataagagaactggatggacatacggttccgttccactctcctctaactcaccattcaaggttgcctttgaggccgatctggacggaaacgaggacatttttatcgccctggacgatatttcttttacgcctgaatgtgttactggtgggcccgtccccgtccagccatcgccatgcgaagctgatcagttttcatgcatttatactctccagtgcgtgcccctgagtgggaaatgcgacggccatgaggactgtatcgatggctcagatgaaatggattgtccactcagcccgactcctcccctgtgcagtaatatggaattcccttgttcaaccgatgagtgtatcccaagcttgttgctgtgcgatggggttccagattgtcactttaatgaggacgaattaatttgttcaaacaaaagttgttctaacggtgcgctcgtgtgtgcatcttcaaacagttgcatccccgcccaccagcgctgcgatggatttgctgactgcatggatttccagctggatgagagcagttgtagcgaatgccctctcaattattgtaggaacggcggtacatgtgtagtagaaaaaaacgggcccatgtgtcggtgtagacaggggtggaaagggaataggtgccacatcaagtttaacccacctgcaactgatttcacttatgcccagaacaacacatggacattgctgggtatagggctcgcttttctgatgacccacattaccgtggcggtgctgtgtttcttggctaatcgcaaggtaccaatccgtaaaacggaagggtctggcaattgcgctttcgtgaacccagtctatggcaactggagtaatcccgagaaaacagagtcttccgtgtactcctttagtaaccccttgtatggtaccaccagtgggtcattagaaaccctgagtcaccatctgaaatag

SEQ ID NO: 25082 - DNA, 4461 bp, Artificial Sequence
  Description of Artificial Sequence: Synthetic coding sequence
ccccgtgatcatagcctcaatgcctcacagggacacttcatgtttatcctcaagaagtcaagctctctgtggcaggtggctaagttgcaaagtcccactttctcccagacaggcccagggtgcatcctcagcttctggttctataactacggactctccgtgggcgccgctgagctgcagttgcatatggagaactctcacgattcaacggtaatatggagagtgctgtataatcaggggaagcagtggttggaagcaacaattcagctgggtcgattaagtcagccattccacctcagtctggataaggtgtctttaggcatctacgatggtgtgagcgcaatcgacgatattaggtttgagaactgcactctgccattgccagctgagtcttgtgagggcctcgatcacttttggtgtaggcacacgcgcgcctgtattgagaagctacggctttgtgaccttgtcgacgactgtggtgatcggaccgacgaagtgaattgcgcacctgaattgcaatgtaactttgaaaccggcatctgtaattgggagcaggatgccaaagacgacttcgactggacccgtagccaggggcccacccctactcttaacacaggccctatgaaagacaacaccctgggcacagccaaaggtcattatctctatattgagtctagcgaaccccaagccttccaggatagcgcggccctcctgtcaccaatcctcaacgcaactgatacaaaaggttgcaccttccggttctactaccacatgtttgggaagcgaatataccgattggccatttatcagcggatctggtctgattctagaggccagttgctttggcagatcttcggcaatcagggcaaccggtggatccggaagcatctgaacatctcctctcgccagccattccaaattctggtggaggcctcagtcggagatgggttcacaggcgacattgccattgacgacctgagtttcatggactgtacgttgtaccctggaaacttgcccgctgacttgccaacgcctccagaaacctctgtgcccgtcacacttcctccgcataattgcacggacaacgagtttatctgcaggtcagatggtcattgtatcgagaaaatgcagaaatgtgactttaaatacgactgccccgacaagagcgatgaggctagctgtgtcatggaagtttgttcttttgagaagagatccttatgcaagtggtaccagcccatacccgtccacttgctccaggattctaataccttcaggtgggggctgggaaatggtatctcaattcatcacggagaggaaaaccataggcccagcgtcgaccatacacagaatactaccgatgggtggtatttgtatgccgactccagcaacggcaaattcggggatactgcagatatcctcactcccatcatcagccttacagggccaaagtgtactctcgtgttttggacacatatgaatggagccaccgtaggcagccttcaagtgctgattaaaaaggacaacgtcactagcaagttatgggcgcagacaggccagcagggcgcccagtggaagagagcagaggtatttcttggcatccgtagccatacgcagatagtgttcagggctaagcgtggtatttcatatattggagacgtggctgtagacgacatcagcttccaggattgctctcccttactgtctccagagaggaagtgtaccgatcacgagtttatgtgtgcaaataaacactgtatcgccaaagataaactgtgcgactttgtcaacgattgcgccgataactctgatgagacaacctttatctgtaggacaagcagtggccgatgcgatttcgagtttgacctctgcagctggaagcaagagaaggatgaggattttgactggaacctgaaggcttctagcattcctgctgctggaaccgaacctgccgccgatcatacactagggaactcctctggccactatatatttattaaatcactgttcccccagcaacccatgagagccgcccgtatctcctcacctgttatttcaaagcggtccaaaaattgtaaaattattttccactatcatatgtatggtaatggaataggtgctcttacccttatgcaggtaagcgtaacaaatcagacaaaagtcctgctgaacctgaccgtggaacagggcaacttctggcggagggaagagctgtctctttttggagatgaggactttcagctgaagtttgaggggcgcgtcgggaaaggacagaggggtgacatcgcgttggatgacatagtcttgactgagaactgtctgagtttgcacgattccgtgcaagaggagttggccgtaccgctgcccaccggtttttgtcccctgggctaccgagaatgccacaacggcaaatgttataggttggagcagagttgcaacttcgtggacaattgtggagacaacaccgatgaaaatgagtgtgggtccagttgcacctttgagaaaggctggtgtggttggcagaattcccaggctgacaatttcgattgggtcctgggtgtgggcagccatcagagtctcaggcctccaaaagaccataccctggggaatgagaacgctatactcctgatgaggcggcacaaatacccaatcagaagtgtgaatcttcacaccgtgaagcatgtcctaaaggcccagaccgtaggcaactgctctgtctctaaactggaggcacgcctgctggattttctgagcgtaccgaatgaaaatacattcggtagctccgaccacaccaactggcattttatgtacctagaagccacagctgtcggccttcgaggagataaagcgcactttaggagtacaatgtggcgggagagctcagccgcctgtactatgtctttttggtacttcgtaagtgcaaaagcgactggtagcattcaaattctcataaaacgcgggcggagacgcagaagggcaccaaatccagtgcttagtgggtccccgaccatacccaggcaggggagccagcagttaggcggctggcgcggtggctccgcacggcaccgcgccagggcctttcccgaacccgaatgccctcgtggaaggagtgccttgttgaaagggccaccacaggaaaagcctaacagacgaagcgccttattgtctgtcggcgaaatcagcgaactctgccccgagattacggacttcctctgccgcgacaaaaagtgtatcgcctcacacctgctctgcgactacaagcctgactgttcagaccgatcagacgaggcacactgtgcccactacaccagtacaacaggctcttgtaacttcgagacctcttccggtaactggactactgcttgttctctgacacaggattctgaggatgacttggattgggctatcgggtcacgaataccggccaaagcactgatccccgatagcgaccacacacctggttctgggcagcacttcttgtatgttaattcgagcggcagtaaagaggggtccgtggcgcgcataaccacctccaagtcattccccgcttccttgggcatgtgtactgtccggttttggttttatatgattgacccaaggagtatgggaatcctgaaagtgtacaccatcgaagaatccggactgaacatcctcgtgtggagtgtgatcggaaataagagaacaggatggacctacggctccgtccccttgagctccaattccccctttaaggtggccttcgaggcagacctcgatgggaacgaagacatcttcattgctctggacgatatctcttttacccctgagtgcgtgacgggcggccctgtgcctgtccagccatccccatgtgaagcagatcagttttcttgtatttatactcttcagtgtgttccgctatctggcaagtgcgatggtcatgaggactgtattgatggcagtgatgagatggattgcccactcagcccgactccaccactatgcagtaacatggagttcccatgttccactgatgaatgtataccctcattactgctgtgtgatggggtgcctgattgtcacttcaacgaagacgaacttatctgctcaaacaagtcttgttcaaatggagcattggtttgtgcctcatctaacagctgtatcccggcccatcaacgttgcgacgggttcgcagactgcatggacttccagcttgacgagtcctcttgttccgacacctggacactcctcggtatcgggcttgccttccttatgacccacatcaccgttgcggtcctatgcttcctggcgaatcggaaggtccccatcagaaagaccgagggaagtggcaactgtgcctttgtgaatcccgtatacggcaattggagtaatccagaaaagaccgaatcaagcgtgtattctttctccaatccattgtacgggaccaccagcgggtcactcgagactctctcgcaccatctaaagtag

SEQ ID NO: 25083 - DNA, 777 bp, Artificial Sequence
  Description of Artificial Sequence: Synthetic coding sequence
ctgaaattcgaagggagggtcggaaaggggcagcgcggagacatcgccttagatgacattgtgttgactgagaattgcctaagtttgcatgattcagtgcaagaggagcttgccgttccactgccgacaggtttctgccctctcggatacagggagtgccataatggcaagtgctacagactcgaacagtcctgcaactttgttgataattgtggtgacaatactgatgagaacgagtgcggatctagctgtacatttgagaaaggatggtgcggttggcagaactcacaggccgataatttcgactgggtcctaggcgtaggctcgcatcagtctctgcgacctcccaaggatcataccttggggaatgagaacggtcactttatgtacctcgaggccacggctgtggggttgcgtggcgataaggctcacttccggtctacgatgtggcgagaatcttcagcggcgtgtacgatgagcttctggtattttgtgagcgctaaagctactggatctatccaaatcctgattaagacagagaagggcttgtccaaagtttggcaggaatctaagcagaatcccgggaatcattggcagaaggccgacattctgttgggcaagctgaggaatttcgaggtgattttccagggcatcaggacacgtgacctgggcgggggcgcagctattgatgacattgagttcaagaattgcaccaccgtcggtgagatatccgaactgtgcccagaaataactgatttcctctgcagagacaagtag

SEQ ID NO: 25084 - DNA, 4422 bp, Artificial Sequence
  Description of Artificial Sequence: Synthetic coding sequence
atgttcattctcaaaaaatcctcatcattatggcaagtggcaaaactgcagagtcctacgttttctcagactggaccggggtgtatactcagcttttggttctataattatggcctgtcagtgggtgccgccgagctgcagctccacatggagaactctcacgacagcacagtgatttggcgagtcctgtacaatcaggggaagcaatggctcgaggctacaatacagctgggccggctcagccagccatttcatctgtctctggataaagtctctctgggtatttacgatggagtgtcagccatcgatgacattagattcgagaattgcaccctgcccctgcctgcggagtcatgtgaagggctagatcatttttggtgtcgtcacactcgcgcctgtatcgagaaacttcgcctgtgtgatcttgtggacgattgtggagacagaaccgacgaagtcaactgtgctccagagttacagtgtaattttgagactgggatttgcaattgggagcaggatgctaaggacgactttgactggacacgcagccagggtccaactccgaccctaaatactggccctatgaaagataacaccctgggtacagccaaggggcattatctctacatagaatccagcgagccccaagcctttcaagattcggccgcactgctcagtccaattctcaatgcgacagatacaaagggatgcacttttcgattctactaccatatgttcggcaagcgtatctacaggctagctatctaccagcgtatttggagcgatagtcggggccagctactatggcagatctttgggaaccaggggaaccggtggatacgcaagcacctcaatatttcttcccgccagccgtttcagatcctcgtcgaggcctctgtgggcgatggctttactggcgatatagccatcgacgacctgtccttcatggactgcactctgtatcccggcaatttacctgctgatctgcccacccctcctgagacttccgtgccagtgacgttaccccctcataactgcacagacaatgagttcatatgccggtcggacggtcattgcatagaaaaaatgcagaagtgcgatttcaaatacgactgtcctgataagtctgacgaagccagctgtgtgatggaggtgtgttctttcgagaagcggagtctttgtaagtggtatcagcccattccagttcacctgctgcaggatagcaatacctttcgatggggccttgggaacggtatctccattcaccacggagaagagaaccaccgcccgtctgtggatcacacacagaacacaacggatgggtggtatctctacgccgactcttcgaacggcaaatttggggacacagccgacattctaacccccatcatcagtctcaccggcccaaaatgcacactagtgttctggacccacatgaacggcgccactgtgggaagtctccaagtattgattaagaaggataacgttacttctaaactgtgggcccagactggccagcagggagcccagtggaagcgcgctgaagtgttcctcggtattcggagtcacacccagatcgtgttcagggctaaaagaggaatctcctacattggcgatgtggccgtggacgatatctcctttcaggactgttcccctttgctctcacccgagcgcaaatgcactgaccatgagttcatgtgtgctaacaagcattgcatagcgaaggacaagttgtgcgacttcgtgaacgactgcgcagataactccgacgaaactacgtttatttgtcggaccagcagcggaaggtgcgatttcgaatttgatctctgcagctggaaacaggaaaaagacgaggactttgattggaacctgaaagccagtagcatccctgctgccggaaccgagccagcggctgatcacactctcggcaattcctccggtcactatatattcattaaatctctttttccacaacaaccgatgcgggcagcacgcatatcctcacctgtcatctccaaacgctctaagaactgtaagataatcttccactaccacatgtatggcaatggtatcggcgcactgacacttatgcaagtctccgtgactaatcagaccaaggtgttactgaacctcaccgttgagcagggaaacttctggaggagggaggagttatctttgttcggggacgaggatttccagctcaaatttgaaggcagagtgggcaaaggccaacgcggtgacatcgcactggacgacatcgtccttaccgaaaactgcctctcactgcatgacagcgtacaggaggaacttgcagtccccctcccaaccgggttttgtcccttggggtacagggaatgccataacgggaagtgttaccgacttgaacaatcttgcaattttgtggacaactgtggagacaataccgatgagaatgaatgcggctcctcgtgtaccttcgagaaaggttggtgcggttggcagaacagccaggctgacaacttcgactgggtcttaggcgtcgggagtcaccagagccttcgtccccccaaagatcacaccctcggcaatgaaaatgccattctcctcatgcggaggcacaagtacccaatacgctcagttaacctgcacactgtcaagcacgtcttgaaggcacagaccgtgggaaactgttctgttagcaagctcgaggcacggctgctggacttcctctcagtgccaaatgaaaatacattcggatcctcagatcacaccaattggcacttcatgtacctggaggcaacagccgtggggcttcggggagataaggcccacttcagaagcacaatgtggagggagagttccgccgcgtgcactatgtctttctggtacttcgtgagtgctaaggcaaccggaagcatacaaatacttataaaacggggccggcggaggcgtcgggcccctaatccagtgctgtccggcagtcccacaattcccaggcaaggatcacaacagctcggcggctggaggggagggtcagcacgccacagagcccgtgcctttcccgagcccgagtgccctagaggccgtagcgcactgctgaaggggccaccacaggaaaagccaaataggcgcagcgctcttttgtcagtcggtgagatcagcgagttgtgcccggagatcactgacttcctctgcagggataaaaagtgtatagcaagccacttgctgtgcgattacaagcccgattgctcagataggagcgatgaagcccattgcgctcattatactagcacaacagggtcttgtaacttcgagacctcttccggcaattggacgacggcctgtagcctgactcaggattctgaggatgacctcgactgggcgatcgggtcacggatccccgctaaggccctcatacctgactctgatcacacacctggcagtggtcaacatttcctgtacgtgaactcatctggctctaaagagggttccgttgccaggatcactaccagtaaatcgtttcctgccagcttgggcatgtgcaccgtgagattctggttttatatgatcgaccctcggtccatgggcatcttaaaagtctatacgatagaggagtcaggcctgaacatcctggtttggtctgtgattggcaataagagaactgggtggacatacggcagtgtaccgttgtcatcaaactcacctttcaaggtcgccttcgaagcggacctcgacggcaacgaagatatttttatagcactggacgacataagcttcacaccggagtgtgtaactggaggcccggttccagtacagcccagcccctgcgaggccgatcagtttagctgcatatatacactgcaatgtgttccactgtctggcaagtgtgacgggcacgaggattgtatcgacgggagtgatgaaatggactgcccgctgagcccaactcctcccctgtgttctaacatggagtttccatgttcaaccgatgagtgcattccctcgttactgctgtgtgacggcgttcctgattgtcatttcaacgaagatgagctcatttgttctaacaaaagctgtagtaatggagccctcgtatgcgcttctagcaactcttgcatcccggcacaccagcggtgcgacgggttcgccgactgtatggattttcaacttgatgaatctagctgctccgacacgtggaccctgctgggcatcggattagcgttcctgatgacacatataactgtggctgtcttatgtttcctggcaaatagaaaggtgcccatacggaagacggagggtagtggaaattgtgccttcgtgaatcccgtgtacgggaactggtccaaccctgaaaaaacagagagtagcgtttattctttctccaatcctctgtacggtacaacctccggttccctggagacactaagccaccacctgaagtag

SEQ ID NO: 25085 - DNA, 1053 bp, Artificial Sequence
  Description of Artificial Sequence: Synthetic coding sequence
atgtgcaccgtcaggttttggttttatatgatcgaccctagatcgatgggcattttaaaagtctacactattgaggaaagcggactgaatatactagtgtggtctgtcatcggtaacaagcggaccggctggacttacggcagcgtgcccctgagctcaaactcaccgttcaaggtcgctttcgaggctgaccttgacgggaacgaggatatattcatcgctcttgatgacatctctttcacaccagaatgcgttactggcggacctgtccctgtgcaaccatcaccatgtgaggctgatcagttctcgtgcatctatacactgcagtgtgtcccactgtccgggaagtgcgatgggcatgaagattgcatagatggatccgatgagatggattgtccactatcacctacccccccactttgcagcaatatggaatttccttgttccaccgatgaatgcatcccgtctctgctcctgtgtgacggggtgcccgactgccactttaatgaagacgagctcatatgttcaaacaagtcctgttctaacggcgcactggtgtgtgcaagttctaactcatgtatcccagcacaccagcgttgtgacggtttcgctgactgcatggactttcaattggacgagagttcttgtagtgagtgcccactgaactattgccgcaacggtggaacttgcgtcgtcgagaagaacggtcctatgtgtcgttgtcgccaaggatggaaaggcaataggtgccatattaaattcaacccacctgctaccgactttacctatgctcaaaacaacacatggaccctgctgggcatcggattggcttttttgatgacgcacatcactgtggccgtcctctgcttccttgccaaccggaaggtccccatcagaaagacagagggcagcggcaattgcgcctttgtgaatccagtgtacggaaattggagcaatcctgagaaaaccgaaagctcggtctactcgttttccaatccactgtacggcactacctccggatctttagagacccttagccatcacctgaaatag

SEQ ID NO: 25086 - DNA, 318 bp, Artificial Sequence
  Description of Artificial Sequence: Synthetic coding sequence
atgaatctcggcgtctctatgctgcgcatcctctttttactggatgtcggcggggcccaagtgctggctactggcaagacgccgggggcggagatcgactttaagtatgccctaataggcactgctgtaggcgttgctatttcagccggctttctggctttgaagatctgcatgattcgacgccacctctttgatgacgactcctccgatctgaaatcgaccccaggagggttatcagataccatcccactaaagaaaagggcccctcggcgcaaccataacttctccaaaagagacgctcaagtgatcgagctctag

SEQ ID NO: 25087 - DNA, 1443 bp, Artificial Sequence
  Description of Artificial Sequence: Synthetic coding sequence
atgctgggaagattccagccatttagtctagtgcggagttttcgtttggggtttgaggcttgttgctatccaaatcagaaatgcgctacacagaccatccggccaccggactctagatgccttgtccaggctgtgtcacagaatttcaatttcgcaaaggacgtgctggatcagtggagccaactagagaaagacggtttgcgagggccctatcctgcactctggaaagtcagtgctaagggggaggaagataaatggtccttcgaacggatgacacagttatctaagaaagccgcgagcatcctgtcagatacttgtgcgctctcgcatggtgatcgtttgatgatcatcctgcctcccacacccgaggcctattggatctgtctagcctgtgttcgcttaggcatcactttcgtcccaggcagcccccagctcaccgccaaaaaaatcaggtaccaactccggatgtcaaaggcacagtgcattgtggctaacgaggccatggccccagttgttaactccgccgtgtctgactgccccaccctgaagactaagcttctagtctccgacaaaagttatgatggctggcttgacttcaagaaattaatacaagtggcccccccaaagcaaacatacatgcgtactaagagccaagacccgatggcaattttttttacgaaaggaaccactggcgccccaaagatggttgaatacagtcagtacggcctaggaatgggctttagtcaggcatctcgaaggtggatggacctccagccaactgacgtgctgtggtcgctcggagatgcctttgggggttcacttagcctgtccgcggtgctaggtacgtggtttcaaggtgcttgtgtcttcctctgtcatatgcctactttttgtccagagacggtgctaaacgttttgtctaggttcccaattacgacgctgagcgcaaatcccgaaatgtaccaagagttactacaacacaagtgcttcaccagctacaggttcaagagccttaagcagtgtgtggcagctggcggtcctatttcccccggtgttattgaagattggaagcggattactaaacttgacatatatgagggttacggccaaacagagacgggcctcttatgcgctacatcaaaaaccattaagctgaagccttcttcactgggcaagccactgccaccgtacatcgtccagatcgtggacgagaactcaaacctcctgccccccggcgaagagggcaacatagccattcgcatcaaactcaatcagcctgcctccctgtactgtccacacatggtgagttgggaggagtatgcctccgctcgcggacatatgctgtacctgacaggcgacagagggatcatggatgaggatggctatttctggtggtccggacgggtggatgatgtggcgaacgctctggggcagcgcctgtag

SEQ ID NO: 25088 - DNA, 1443 bp, Artificial Sequence
  Description of Artificial Sequence: Synthetic coding sequence
atgctgggccgcttccaacctttcagtcttgtgaggagctttcgtctgggatttgaggcgtgctgttatcctaaccagaagtgcgcaacacagaccatcaggcccccagattcccgttgcttggttcaggccgtttcccagaatttcaatttcgccaaggatgtcctcgatcagtggtctcaattagaaaaagatgggctcagaggcccataccctgcactctggaaggtgagcgccaagggcgaagaggataagtggagtttcgaaaggatgacgcagctcagcaagaaagcagcaagtatactgtcagatacctgcgcactgagccacggagatcgtcttatgattatactgccacctaccccagaagcttactggatctgcttggcctgtgttagacttggcatcacctttgttccaggatccccccagctaactgccaaaaagatccggtaccagctccgtatgagcaaggcacaatgcatcgtggccaatgaggccatggctccagtggtaaactccgccgttagcgactgtccaactttgaagacaaagctccttgtgagcgataagagctacgatggctggctagatttcaagaaactaatccaggtagcccccccaaaacagacttatatgaggaccaaaagccaggacccaatggcgatattttttaccaagggcactaccggagcccctaagatggtggaatattcgcagtacgggctgggcatgggattttctcaagcatcacgccgctggatggatctacagcctactgatgtactgtggtcactgggagacgcgttcggtggaagtcttagtctgagcgctgtgttgggcacctggtttcagggggcatgcgtctttttatgccacatgccaacattttgtcccgagactgtgctgaatgtgctttccaggtttcctattacgacactgtctgccaaccccgagatgtaccaggagctgctgcaacataaatgcttcactagctatagattcaagagtttgaaacaatgtgtggctgccggtgggccgatctctcccggggttatcgaggactggaagcgcattaccaagttagacatttatgagggatacgggcagacagaaacgggactcctgtgcgcaacctctaaaacgatcaaattgaagcctagcagtctgggcaaaccacttcccccttatattgtgcaaatcgtggacgaaaactcaaacctgcttccgcccggagaggaaggcaatatagcaattcgcatcaagctcaaccagccggcttcgctgtattgcccccacatggttagttgggaggaatacgcctcagcacggggccatatgctgtacttaaccggagaccggggcatcatggacgaggacggatatttttggtggagtgggagagttgacgacgttgccaatgcccttgggcagagactgtag

SEQ ID NO: 25089 - DNA, 561 bp, Artificial Sequence
  Description of Artificial Sequence: Synthetic coding sequence
atgagcaaggcacagtgtatcgtcgcaaacgaagcgatggcccctgtggtaaattcagctgtgtcagactgccctactctgaagacaaaactgcttgtctccgataagtcttatgatgggtggctagatttcaagaagctgattcaggttgcacctcccaagcagacctatatgaggaccaagtctcaggatccaatggctatttttttcacaaagggaaccaccggagcacctaagatggttgagtatagtcagtatgggctggggatgggtttcagccaagcttccaggaggtggatggacttgcaacccacagatgttttgtggagtctgggtgacgcttttggtggcagtctttccctgtctgcggtcctgggcacttggtttcagggagcttgcgtctttttgtgccacatgcccacattttgccctgagacagtgctcaatgtgctcagccgctttcctataacaacactttcagccaaccccgagatgtatcaggagttgctccaacacaagtgcttcacccgggtctactccgttcccttgccgaaacaatag

SEQ ID NO: 25090 - DNA, 1521 bp, Artificial Sequence
  Description of Artificial Sequence: Synthetic coding sequence
atgctgggccgtttccagcccttcagtctggttcgttccttccgtctgggattcgaggcttgctgctatcctaatcaaaaatgcgctacccagacgatccgtccacccgatagccgttgtctcgtgcaggccgtgtcgcaaaactttaacttcgcaaaagatgtcctggatcagtggtcacagctcgaaaaggacaacggactgcagctccatccttgctgctgtaagagacaagacttcatcctctttcacggctgcctgttttatattgatgggctgcgaggtccctacccagccctctggaaggtgagtgccaagggcgaagaggacaagtggtcctttgaacggatgactcagcttagcaaaaaggccgcgtcaatactgtctgatacatgtgccctcagccacggcgacaggctgatgatcatccttccccctactccagaagcctattggatctgtctggcctgtgtaaggctgggaattaccttcgttcctggctctccacagctgaccgcgaagaagatacggtaccagcttaggatgagcaaggcgcagtgcatcgtcgccaacgaagcaatggcacccgtggtgaatagcgcagtatccgattgccccaccctgaaaaccaaactgttagtttcagacaagagttatgacggatggttggattttaaaaagctcattcaggtcgccccgcctaaacaaacatacatgcgcaccaagagtcaggacccgatggccattttttttacaaagggtacaaccggcgctccaaaaatggtcgagtactcccagtacggtttaggcatgggattcagccaagccagtagacggtggatggatctccaacctacagacgtcctgtggagcctcggtgatgcctttggcgggtccttgagcctctccgccgtgttggggacctggtttcagggcgcttgcgttttcctgtgccatatgcctaccttctgtccagagaccgtgctgaacgtgttatcacgcttcccgattaccaccctgtccgctaacccagagatgtaccaggagcttctgcaacataagtgcttcactagttatcgctttaagagtctgaagcagtgcgtcgcagccggtggtccaatcagccccggagtcattgaggactggaaacgaatcacaaaactggatatatatgaaggttacggtcagaccgaaacagggctcctctgcgcaacttccaaaacgatcaaactgaagccatcctcactgggaaaacctcttcctccctatatcgtccagattgtagatgaaaacagcaacctactaccacctggggaggaaggcaatattgccatacggatcaagctaaatcaacccgcgtctctgtactgcccacacatggtctcctgggaggagtatgctagtgcccgtggacacatgttatacctaaccggcgatcgcggtattatggatgaggatgggtatttttggtggtctggaagagtggacgacgtggctaatgcgcttggacaacgactgtag

SEQ ID NO: 25091 - DNA, 366 bp, Artificial Sequence
  Description of Artificial Sequence: Synthetic coding sequence
atggtcaggatcctggcaaacggcgaaatcgtccaagatgatgaccctagggttcgtaccacgactcagccacctcgcggttctattcctcggcaatcattcttcaatcggggtcatggagctccacccgggggcccaggtcctagacagcagcaagctggcgctagactgggggctgcccaatcccctttcaatgacctgaaccgacagttggtcaatatgggtttccctcagtggcatctaggaaatcacgccgtcgaaccagtcacatcaatactgctcctctttttgctaatgatgttaggcgttcgcgggctgctgctggtgggcctggtttatttggtttctcatctaagccaacgatag

SEQ ID NO: 25092 - DNA, 312 bp, Artificial Sequence
  Description of Artificial Sequence: Synthetic coding sequence
atgtctccagtcttgtcggggatccattctatctactccgcttgggtgacctccgtaaacattaccgactgtaaaccaccgtcaatcagtggggctgcacaccagggacctaccgccccaggcagaatggtcaggattttagctaacggggagatcgtgcaagacgacgacccacgtgtgcgtaccactacccagccaccgagaggatctattcctcgccagtcattctttaaccgagggcatggcgctccgcccggcgggcccggccctaggcagcagcaagccggtgccagacttggggctgcgcagtag

SEQ ID NO: 25093 - DNA, 924 bp, Artificial Sequence
  Description of Artificial Sequence: Synthetic coding sequence
gcatctcctcgcagaccaaggcctgctaggtcgccagcgccagaggttccactccgcgtgcgtagacgccacggccggccccacgggcccggcggccggcagctggcactcggcattccggcgctgaggagcctgcctgggtgcgtcccccggttgctggggccggtcgacaagggtcatgatgttacattctacaaaacatggtaccgtagctcacggggggaagtgcagacttgttccgaaaggcgacccattaggaacttaacattccaagacttgcatctgcatcacggaggccaccaggccgccaacacttctcatgacctagcgcagcgtcatggtcttgaaagcgcatcagaccaccatggaaattttagcattaccatgagaaatctgaccctgctcgactcaggcctgtactgttgcctggtagtagagattcggcaccatcacagcgagcatagggtgcatggcgccatggagctgcaggttcagacgggcaaggacgctccttcaaattgtgtcgtctatccttctagttctcaggactcagaaaatatcacagccgcagcattggccacaggcgcatgcattgtgggtatcctgtgtttgcctctcatcctgcttctggtttacaaacagagacaggccgccagcaataggctcgcccaagagctgcttgctcaggattcaaatatccagggaattgaaaatccaggcttcgaggcttcccctccggcccagggtattcctgaagccaaggtcagacacccgctgagctacgtagctcagaggcagccatctgaatcaggcagacaccttctgagcgagccatccaccccactcagcccgcccgggcctggcgatgtttttttcccatccctcgacccagttcctgattcacccaatttcgaggtcatatag

SEQ ID NO: 25094 - DNA, 936 bp, Artificial Sequence
  Description of Artificial Sequence: Synthetic coding sequence
atgggggtgcccaccgccctagaggccggcagttggcgctggggctctctcctgtttgccctgtttctggccgcgagcttgggcccagtggcagccttcaaggtggcaaccccatattccttgtatgtgtgcccagaggggcagaatgtgactcttacatgccggctgttgggtccagtcgataagggccatgacgtcaccttctacaagacgtggtatcggtcttctcgtggcgaggtccagacctgttccgagcggcggcctattcggaacctaaccttccaagatctgcatcttcaccatggcggccaccaggctgcaaatactagccacgatctcgctcagcgacatggactggagtccgccagcgaccatcacggaaatttcagtataaccatgcgaaatttaactctcctggactctgggttgtactgttgcttggtcgtagagattaggcaccaccatagcgagcatcgggtgcatggcgctatggagctacaggttcagacgggaaaggatgctcccagcaattgtgttgtgtatcctagtagtagtcaggactccgaaaatatcacagccgcggctttggctacaggagcctgtatcgttggtatcctgtgcctgcccctgattctgttgcttgtttacaaacaaagacaagctgcttctaacaggagagcccaagagctggtcaggatggattcaaatattcagggcatcgagaaccccgggttcgaggcatccccacctgcccagggcattccggaggctaaggtgcggcatcctctgagttatgtcgcgcaacggcaaccaagcgaaagcggacggcacctgctgtcagaaccttccacgccactgtccccccccggaccaggagacgtgttttttccgagcctggatccagtacccgattctccaaatttcgaagtcatttag

SEQ ID NO: 25095 - DNA, 435 bp, Artificial Sequence
  Description of Artificial Sequence: Synthetic coding sequence
tagacggctggcgagctgcccgcgaactcagtgtcagggttcttcaagcgcatggtcaaatccgaagctagtaatgccgccacggcatactttcgaccagcccgtccgttgccttctctcgttaccgttctagggttgggatattttgcctgggttgtcttttggcctcagtccattccgtatcagaacctcggtcccctcgggccttttactcagtacctggtcgatcaccatcacacccttctatgcaatggatattggttggcatggcttatccacgtgggagaatcattgtacgcaatagtgctctgcaagcacaaaggaataacatccggacgggcccagctgctctggtttctgcagaccttcttttttggaatagcgtctctgactatcctcatagcctacaaacgcaagcggcagaaacagacgtag

SEQ ID NO: 25096 - DNA, 312 bp, Artificial Sequence
  Description of Artificial Sequence: Synthetic coding sequence
atggccacggccgctggcgcaacttacttccagcgaggcagcctgttctggtttactgtgattaccctgtctttcgggtattatacgtgggtcgtgttttggccgcagagcattccctatcagaatctcggcccactggggccgttcacacagtacctggtggatcatcaccatactttgctctgtaatgggtactggctggcatggctgattcacgtgggtgagagcctctatgcaatcgtgctctgcaaacagaacgaactgcggatcagaatcaagatgcggaaattaatactgcgggactctgagtag

SEQ ID NO: 25097 - DNA, 255 bp, Artificial Sequence
  Description of Artificial Sequence: Synthetic coding sequence
atggcaactgctgccggagctacatacttccagaggggaagcctgttctggtttacggttattaccttgagttttgggtactacacctgggtggtattctggccacagtctatcccgtatcagaacttgggccctctgggccccttcactcagtatctcgtggatcatcatcacaccctgttatgtaacggatattggctagcttggttaattcacgtgggggagtctctgtatgccatcgtgctgtgcaagtag

SEQ ID NO: 25098 - DNA, 312 bp, Artificial Sequence
  Description of Artificial Sequence: Synthetic coding sequence
atggccaccgcagcaggcgccacatatttccaacgcggaagcttgttctggttcactgtcatcactctgagcttcgggtactacacatgggtcgttttttggccacaaagcatcccctatcaaaatcttggccccctgggccccttcacccaatacctcgtggatcaccatcacacactgctgtgtaacggctattggctggcatggttaattcacgtgggggaatcactatatgccatcgtgctttgcaagcaaaacgaactgcgtataagaattaagatgaggaagcttattctgcgcgattctgaatag

SEQ ID NO: 25099 - DNA, 372 bp, Artificial Sequence
  Description of Artificial Sequence: Synthetic coding sequence
atggccactgcggctggcgcgacctattttcagagggggagccttttctggttcaccgttatcactttatcctttggttactacacctgggttgtgttctggcctcaatccatcccataccaaaatctggggccattaggaccttttacccaatacctggtcgaccaccaccacacgctcctgtgcaacgggtattggcttgcctggcttattcacgtcggtgagagtctctatgccattgtcctgtgcaagcataagggaattacatcaggcagggcacagctgctctggtttctgcagactttcttctttggcatagcttcattgaccatactgatcgcctataagaggaagagacagaagcaaacatag

SEQ ID NO: 25100 - DNA, 306 bp, Artificial Sequence
  Description of Artificial Sequence: Synthetic coding sequence
tgagagtttctgagaagcgtttgggtagtgttttggccacagagtattccctatcagaatctgggccccttggggccttttactcagtatctcgtggatcaccaccataccctactatgtaatggctactggctggcatggcttatccacgtaggcgagtcactctatgccatcgttctgtgcaaacataaggggatcacctctggcagggcccagcttctgtggttcttgcagacattcttttttggaatcgccagcctcacaattctcattgcgtacaaaagaaaacgacagaagcagacttag

SEQ ID NO: 25101 - DNA, 285 bp, Artificial Sequence
  Description of Artificial Sequence: Synthetic coding sequence
agcgtggagttgcctctcgacgccgacgtgcagacctctaatctgctgatcaccttcctgaaatactcatctattgttatgcaggacaccaaagatgaacaccgactccactcagggaagctgtgtctgattattctgacatgtatcgccgagccgatgcgacataggaaaaaagctgcagacaagaatcttccctgtagacccctggtgtgcgcggtcctggacctgatggtagaatttattgttactcacatgatgaaagagttccctatggatctgtattag

SEQ ID NO: 25102 - DNA, 597 bp, Artificial Sequence
  Description of Artificial Sequence: Synthetic coding sequence
atggctcaggttgagaagcggggggggctgttgcgaaaatcatctgcttccaagaaacctctaaaggaaaaggttgttctcatgtacgatgaaatcttcatgaccgaggatccttctaaatgctccccgcggttttgggaggagctttttctcatgaaagtaaatctcgaatatctggaggggaagctggaatcactggatggagaagaattgatgaagattaaagataacatcaactgcctatttcagcattgtattcaagcccttggggaggaacatcccattcgggtggtgaacgctctgcaaacactgtgtgcactgattcgtggagtgcaccaaaaaaataagagtacctcaggtttcgacattattaatatgctaatgggctttgacaaggctgagttgtgcatgaaggtacgtcataagctgcaaatgtgtctgtggatggctgcgagcgacagctgctcgtggacactgtcagctgacaagtgcacccagcgtttcggactccgtaaaatacagatgattgagtttggactcgcctttcgatgcttttactttacggaccttctgtacctcaacaagggtaaattttag

SEQ ID NO: 25103 - DNA, 2070 bp, Artificial Sequence
  Description of Artificial Sequence: Synthetic coding sequence
atggcacaagtagagaaaagggggggcctgcttcggaagtcttctgcaagcaaaaaaccgcttaaggagaaggtggtgcttatgtacgacgagatttttatgacggaagacccatctaagtgctctccacggttttgggaggagctcttccttatgaaagtcaacctggagtatctggagggaaagctggaatccctcgacggggaagagctgatgaaaattaaggacaacatcaactgccttttccaacactgcatccaggctctgggagaggagcaccctatccgagtcgttaacgcactgcagactctgtgtgcattgataagaggggtgcaccaaaaaaacaagagcacaagcggcttcgacataataaacatgctgatgggtttcgataaggccgagctttgcatgaagaacttgatggagtcacttgactcactcctttgtgcagaggggtccgaaagcctcaaatcgctgtgtcttaaattgttgctgtgtctggtaactgtgaccgataacatttcccagaatactattctggagtacgtgatgataaactccatcttcgaggccatcttgcaaatccttagccatcccccttctcgccgggaacatgggtacgacgcggttgtgctcctcgcccttttggtcaattatcgcaagtacgagtccgtgaatccctacatagtgaagctgtctattgtagatgacgaggcaaccctgaacggcatgggcctcgtaattgcacaggccctttccgagtataataggcagtacaaagacaaggaggaagaacaccagtccggctttttcagtgcgctgacaaacatggtcggctccatgtttatcgccgatgcgcacgagaaaatttctgtacagacaaatgaagccatcctcttggccctgtacgaagctgtccacctgaatagaaatttcatcactgtccttgcccagtcacatcctgagatggggctagtcacaacccctgttagccctgcccctacaacacctgtgacccccctagggacgacacccccatcttcagacgtcatcagcagcgtagagctcccactcgatgcagatgttcagacctcgaacctgttaattactttccttaaatatagttctatcgtcatgcaggacacgaaagacgaacaccgactccattcagggaaactctgtctgatcatcctgacctgtatcgccgaagaccagtatgccaacgccttcctgcacgacgataacatgaattttcgcgtaaacctgcacagaatgccaatgagacatcgcaaaaaggctgccgacaagaacttgccttgtcggcctctggtgtgtgccgtgcttgacctgatggttgaattcattgtaacacacatgatgaaggaattcccgatggacctgtatattaggtgtatccaggttgtgcataaactgctctgttaccagaaaaagtgtcgggtgcggttgcattatacatggagggagctctggtcggctctgataaacctgctgaagtttcttatgagtaatgagactgtgctcctggcgaagcataacatcttcaccttagcactgatgatcgtaaatctcttcaatatgttcatcacttacggggatacatttttacccaccccaagctcgtacgatgaattgtattatgagataatccgcatgcatcagtcgttcgacaatttgtactccatggtgttgaggttgagcacaaatgcaggtcagtggaaggaagcagcctccaaggttacccatgcattagtgaatatccgcgccattattaaccactttaaccccaaaattgagtcctacgctgcagtgaatcacatttcccaactctcagaagaacaagtgctggaggtggtacgcgccaactatgacacactgactctcaaacttcaggacgggctggaccagtacgaaagatacagcgagcagcataaagaagcagctttcttcaaggagctagtgaggtccatctccactaacgttcggcggaatttggcattccataccctgtctcaggaggttctcttaaaggagttcagcaccattagttag

SEQ ID NO: 25104 - DNA, 285 bp, Artificial Sequence
  Description of Artificial Sequence: Synthetic coding sequence
agtgtagaactacccctggatgccgacgtgcagacttcaaacctgctgattaccttcctcaaatacagcagcatcgtgatgcaagataccaaggatgagcacaggctgcactcaggtaagctgtgtctgatcatcctaacttgcatcgccgaacctatgcgacaccggaaaaaggcggctgataaaaaccttccttgcagaccattagtgtgtgctgtcctggacctgatggtggagtttattgtcacacatatgatgaaagagtttccaatggatctctactag

SEQ ID NO: 25105 - DNA, 240 bp, Artificial Sequence
  Description of Artificial Sequence: Synthetic coding sequence
atggaactggaagcaatgtcacgttatacatctccggttaaccccgccgtgttccctcatttgacagtggtgctgctggccatcggcatgttttttacagcttggttttttgtgtacgaggtgactagtactaagtataccagagatatctataaggagctgctgatctccctggtagcctctcttttcatgggcttcggggttctgttcttgttgctgtgggtgggaatctatgtctag

SEQ ID NO: 25106 - DNA, 240 bp, Artificial Sequence
  Description of Artificial Sequence: Synthetic coding sequence
atggagttggaggccatgtcccgatatactagccctgtgaaccctgcagttttccctcacctgacagtggttctgttggctatcggcatgttttttaccgcttggttcttcgtatacgaggttacctcaaccaagtatactcgagatatatacaaagagctgctaataagcttggtggcttctttattcatgggttttggcgtgctgtttctcctgctttgggtcggcatttatgtgtag

SEQ ID NO: 25107 - DNA, 2349 bp, Artificial Sequence
  Description of Artificial Sequence: Synthetic coding sequence
atggctgctgcggcagcagctgggcctagcccaggcagcgggccaggcgactccccggagggacccgagggcgaggcccctgagaggaggcgaaaagcacacgggatgttaaaattgtactatggtttaagtgaaggggaagcagctgggcgccccgctgggcccgaccctctcgatccaactgatctgaacggagcacattttgatccggaggtttacctagataagctgcgtcgggaatgcccgctagcacagctcatggacagtgagaccgacatggtgagacagattcgggccctggactcagatatgcagacactggtttatgagaactataacaaattcatctctgcgacagatactatacgaaagatgaagaatgactttcgcaaaatggaggatgaaatggacaggctcgctacgaacatggctgtgatcaccgatttcagtgccaggatttccgccactcttcaagataggcatgagagaattaccaagctcgctggagttcacgccttactcaggaaactccaattcctgtttgagcttccctctaggctgaccaaatgcgtcgagctgggggcttacggccaggccgtgagataccagggccgcgcccaggccgtgttacaacagtaccagcacctgccctcatttagagccattcaggatgattgccaggtgattacagcccggctagcacagcagctgcgacagcggtttcgagagggaggctccggggcccctgagcaggctgagtgcgtagaacttttgctcgccctgggcgagccagcggaagaattatgcgaggagtttctggcacatgctagagggcgcctggagaaggaactgaggaacctggaggccgagctggggccatccccaccagctccagatgtgctagagttcacagaccacggtgggtcgggcttcgtgggaggcctttgccaggtcgcggccgcttaccaggagttgtttgccgcacagggtccagccggggcagagaagctggccgctttcgcccgtcagctgggtagccgctactttgccctagtggagcgcaggctggcccaggaacagggcggaggggacaactctctactggttcgagctctcgatcgatttcataggaggcttcgcgcccccggcgcgctgctagccgccgccggcctggcggatgctgctacagagatcgttgagagagttgcccgtgagcggttgggacaccacttacaaggactcagagctgcattccttggatgtctaaccgacgttcgccaggctctggctgcccccagagtagccggaaaggagggccccgggctcgccgaactgctcgctaatgtcgcaagttcaattcttagccatataaaagcgagccttgccgcagtccatctgtttaccgccaaggaagtgtctttttcaaacaagccgtacttcaggggcgaattctgcagtcagggggtacgggaggggttaattgtgggtttcgtccactcaatgtgccagacagcccagagcttttgcgatagcccgggagagaaagggggcgcaacccccccggcattactcctccttctctcaaggctctgcctggattacgaaactgctacgatatcttacattctcacactcacggatgaacaatttctagtgcaggatcagtttcccgtaacaccagtgagcactttgtgcgccgaggcccgagagaccgcccggagactgttaacacactacgtgaaggtccagggcctggttatctctcagatgttgcggaaatctgtggaaacaagagactggctcagcacgcttgaaccaaggaatgtgagagcagtgatgaagagggtggtggaggatacaaccgcaattgatgtccaggtcggactactatacgaggaaggagtgcgcaaggcccaatccagtgactcctctaagcgcacattttctgtgtacagcagcagcaggcagcaggggcgctatgcccctagctataccccatctgcgccaatggacacaaatcttctcagcaatatccagaaacttttctctgagcggatagacgttttttctcctgtggagttcaataaagtaagcgtgctcactggcattatcaagatctcacttaaaacactactggagtgtgtcagactccggacattcggtcgtttcgggcttcagcaggttcaggtcgattgtcatttcctgcagctatacttgtggcgcttcgtagccgacgaagagttggtgcacctcttgctggatgaagtagtggcctctgctgccctaaggtgccccgaccctgttcctatggagccctcggtggtcgaagtgatttgtgagcgcgggtag

SEQ ID NO: 25108 - DNA, 594 bp, Artificial Sequence
  Description of Artificial Sequence: Synthetic coding sequence
atgagtgcacgtgcacctaaggaactgcgcttagcactgcccccctgccttctaaaccgtacgtttgcgtccccaaacgcttctggctctggcaatacaggggcacgcggccccggcgccgttggatccggaacctgtattacccaggtgggtcagcagttgttccagtccttcagcagcaccctggtgttgatcgtgctggtgacattgatattttgtctgatagtcttatcactgagcactttccatattcacaagcgtagaatgaaaaaaagaaagatgcagagagcccaggaggagtacgagcgggaccattgttcggggtcacggggcggggggggtctgcctcggccagggcggcaggctcctacacacgctaaggaaaccaggcttgagcggcaacctagggactctccattttgcgccccaagcaacgcctcgtccttgagttcttcgtcaccagggctcccctgtcagggcccttgtgccccccctcctccgccccctgcgtcaagccctcaaggggcccatgctgcaagcagctgtcttgacactgccggtgaaggcctgctgcagacagtcgtattatcttag

SEQ ID NO: 25109 - DNA, 1131 bp, Artificial Sequence
  Description of Artificial Sequence: Synthetic coding sequence
atgggacatcagtttctccggggcctgttgacacttctgctaccccccccacctctgtacactagacaccgaatgctgggcccagagagcgttcctccccctaaaaggagtagaagcaagttgatggcgcccccccgcattggcacacacaacggcacctttcactgtgatgaggccctggcgtgcgctcttctgcgtctgctgcccgaataccgcgacgccgagatcgtgaggacaagggaccctgaaaagctagcctcatgtgatatcgtagtcgatgtcggcggcgaatacgaccccagacgacacaggtacgaccaccaccagagaagctttaccgaaacaatgtcatctctttctcccgggaaaccttggcagaccaagctcagcagcgccggactgatttacctccacttcggccataaactacttgcacagctcctcgggaccagtgaggaggactctatggtggggaccctctatgataaaatgtatgagaatttcgtcgaagaagttgacgcggtggacaacgggatttcacaatgggctgagggagagcctagatacgcccttaccactacactgtccgcccgcgtggcaaggcttaacccgacctggaaccatcctgaccaagacacagaagcaggctttaagcgggccatggatctggtccaggaggaatttttacagagactggatttctatcagcatagctggctcccagccagggctctagtggaggaagccctggctcagcgcttccaggtagatccttccggcgaaatcgttgagctggccaagggcgcctgtccatggaaggaacacttgtaccatctggaaagcggcctatcaccaccggtggcaatcttttttgtcatttataccgaccaggcaggccagtggcggatccaatgtgtacccaaagagccacactcgttccagtctaggctaccacttccagaaccctggcgcgggctgagagacgaggccctggatcaggtgtctggaattcccggatgtatctttgtacacgcttcgggctttaccggcggtcatcacaccagagagggagccctcagcatggcacgggcaactctagctcaacgttcgtatttgcctcagatttcatag

SEQ ID NO: 25110 - DNA, 978 bp, Artificial Sequence
  Description of Artificial Sequence: Synthetic coding sequence
atgggtcatcaatttcttagggggctcctgactcttcttctgcctccacctcctttgtacacacggcatcgcatgttgggtccggaatctgtgcccccccctaagaggtcccgtagtaagctgatggcacccccacgcatcggcacacacaatggcacttttcactgcgacgaggccttggcctgcgctctgctgcgcttactgccagagtaccgggatgcagagatcgtgaggactcgagaccccgaaaagctggctagttgcgatatcgtagtcgatgtggggggcgaatatgaccctaggcgacaccgatatgaccaccatcaacggtctttcacagaaacaatgtccagtttaagcccaggcaagccatggcaaaccaaactgagtagcgccggcctcatttacctccattttggccataagctcttagcccagctccttgggaccagcgaggaggattcaatggtcggaaccctgtatgataaggccggctttaagcgggcaatggatctcgtgcaggaggagttcctccagcggctggacttttaccagcactcgtggctgcctgcacgagcactcgtcgaggaggctttagcgcaacggtttcaagtcgacccgtccggagagatcgtcgagctggccaaaggggcatgcccatggaaggaacatctctatcacctcgaatctggcctgagcccccccgtagccattttctttgtcatatacactgatcaggcgggacaatggaggatccaatgtgtgcctaaggagccacattcttttcagtcgaggttacctctgcccgaaccttggagaggcctgcgggacgaggctctggaccaggtctccggaatccctggctgcatctttgtgcatgctagcggattcacaggcggacaccatactcgcgagggcgctttgagcatggctcgggctacacttgctcagagatcttacttgccacagatctcctag

SEQ ID NO: 25111 - DNA, 351 bp, Artificial Sequence
  Description of Artificial Sequence: Synthetic coding sequence
atgaatcagaccgataagaatcaacaggaaattcccagctacctcaacgacgaacccccggaaggatccatgaaggaccatcctcagcagcagcccggcatgctgagtcgcgtgaccggcggcatcttttccgtgacgaaaggagcagtaggagctaccattggtggcgtggcgtggataggaggcaaatctctcgaggtgactaagacagcggtcactaccgtgccgtccatgggcatcggactggttaagggcggagtatctgctgtggcaggaggtgtcactgccgtgggttccgccgtggtgaataaggtaccactgacgggaaaaaagaaggacaagagcgactag

SEQ ID NO: 25112 - DNA, 351 bp, Artificial Sequence
  Description of Artificial Sequence: Synthetic coding sequence
atgaatcagaccgacaaaaatcagcaggagatcccctcctatttgaacgacgagccccctgagggtagcatgaaggatcacccacagcagcaacctgggatgttatcgagagttactggggggatctttagtgtgacgaaaggagctgtcggagccactatcgggggggtcgcatggattggcggcaagtctcttgaggtgactaaaactgcagtgaccaccgtgccttcaatgggcatcggcctggtgaagggaggggtatctgccgttgccgggggtgtaaccgccgttggaagcgctgtcgttaataaggtgcctttgaccggcaagaagaaagacaagtcggactag

SEQ ID NO: 25113 - DNA, 351 bp, Artificial Sequence
  Description of Artificial Sequence: Synthetic coding sequence
atgaatcaaaccgacaagaaccagcaggagatcccttcctatctcaacgatgagcctcctgaggggtcaatgaaggaccatccgcagcagcaacctggcatgctctcgcgtgtcacaggagggatcttctctgtcactaagggcgcagtgggagctacgataggaggcgttgcttggatcggtggcaagtcactggaggtgactaaaaccgccgtcaccactgtgccaagtatgggcattggtttggtgaaagggggagtgtccgccgtcgccggtggagtgaccgctgtgggaagtgctgttgtcaataaagtgcccctgacagggaaaaagaaagacaagtctgattag

SEQ ID NO: 25114 - DNA, 351 bp, Artificial Sequence
  Description of Artificial Sequence: Synthetic coding sequence
atgaatcagacagacaaaaatcaacaagaaattccctcatatctgaatgatgagcctcctgagggaagtatgaaggaccacccacagcagcagccgggtatgctgagcagagtaaccggcgggatttttagtgtgacaaaaggcgctgtaggagccacgatcggaggagtggcatggatcggtggaaagtcactggaggttaccaagaccgcagtgacaaccgtcccaagcatgggcatcggcctggtcaagggaggcgtgtccgccgtcgccggaggggtcaccgcggtgggaagtgcagttgtcaacaaagtgcctcttactggcaagaaaaaggataaaagcgattag

SEQ ID NO: 25115 - DNA, 351 bp, Artificial Sequence
  Description of Artificial Sequence: Synthetic coding sequence
atgaatcagactgataaaaatcagcaggagataccaagctacctaaacgacgagccgcctgagggatctatgaaagaccaccctcaacagcagcctggaatgctttccagagtgacagggggtatttttagcgttacaaagggggctgtgggagcaacaattggtggagtagcctggattggcggtaagtcactggaagtgacaaagacagcggtaacaacagtcccgtctatggggatagggctggtgaaggggggggtgtccgccgtcgccggaggggtgacagccgtcggctctgcggtcgtgaacaaggtccctctgaccggcaagaaaaaggacaagtccgactag

SEQ ID NO: 25116 - DNA, 351 bp, Artificial Sequence
  Description of Artificial Sequence: Synthetic coding sequence
atgaatcaaacagataagaatcagcaggaaattccatcctacctcaacgacgagcctccagagggatcaatgaaggatcaccctcagcagcagcccggcatgctttcacgagttacaggaggcattttttcagtgactaagggagcagtaggagcaacgattgggggagtggcttggatcggcgggaaaagtctggaggttacgaaaaccgcggttaccacagtgccaagcatgggtataggtttggtgaagggcggggtctcagctgtcgctggcggcgttaccgctgtaggcagtgcagttgtcaataaagtcccattaacaggtaaaaagaaggataaatcggattag

SEQ ID NO: 25117 - DNA, 12741 bp, Artificial Sequence
  Description of Artificial Sequence: Synthetic coding sequence
atgggacttctcttggtgttccccctgatacagagtcaaagcaggacggatccctcactgtgtaacatcacggctgaagtcttactgaactgtctgagagactgccagcctctgagcttaaccaaggaacccgccgattgtctcaatgggatcgagactctgctgtgtagctggcttgaggaaacatccgacactggtagacacattccccacaaacagaaggagaacgctgctgcagcattggtcgccctggcttgcgcccgcggctcactgaagaccttcgtgcacaccgttcacctccttcagaaacagaccgacctggggagtctgccggtggcagatgtgttatatagattgctgcttttagaaggagggcctggaagcccttcgtgcctccttggcggaaagcatatcgtcagctggggctatgaggacatgctgcccgcacctgactccaacaccgggtccagttcggaaaacaaagatgcagatctgggtcggtgcttgaccgctgacggtttgtatctctacacaacaaactccgtaggacgcggggtctccaagctgggaagcggcctgcacgggaccttacggggcttcgtatattgtaggaacgaagagctggaaccaggatgggtggcgtttggcagcggcagcttgctgcatagacccgtgtccttcgacaataagcctcattccctcttccaggtgatcgatcagaacacactgcaggtgtgtcaggtagtgccaatgcccgccaaccacctccccataggaagcacgatgtcaacagtgcacttaagcagcgatgggacttacttttattggatttggtctcccgccagtctgaatgagaagaccccaaaggggcatagcgtgttcatggatatttttgagctggtggtggagaatggcgtgtttgttgcaaacccgctgcaggaacgaactattttaatgcgcaaagagggcgagtctgctaagtccattaacgaaatgttgttgagcagactgagccggtacagagcctccccttcggctactctggcagccctcaccggctcaactatcagcaacacactgaaggaagaccaggcagcaaatacaagctgcggcctgcctttgaagatgctccggaaaacccctatctacacctgtgggacatatctggtaatgctggttccaccacctggagggagcggctcatcggccactcgatctctgttcggcgggacaagcgggctgagtagcttgaaacgcgcctgctacgatactgtgaacaatatgctctggacttgtagcaacgactacattgaccagtggtgcaatccaggtaatcaggcattccattacgtatgtcaacgacttggcgtctcacatattatcaccgagcctaaagaggaggcgattactacaaacgaggtcataaaccagctcctacaccatgtgggcgccatgtgtattcatcaacttaacctgctggccactaatcctaacctgcccatcactagtgtactcgggaagcagcatcccatcgaagcgcatcatctatccagtatctgcgatattatggaaaaggccatggtaaatggtgatacatgtatcatacgttgtatcttagtagtcttccaggtcgtattcaagttctttttctcacctcaaactgaacgcaatagggatattatcaggcgcagcgggctgttgctttggcagctgttgatggctcccaaagatcagatttgccctgaaatccagaaggaggtctgtttggctatctcctccggacttaacattctgtatccaggagaaactgagatcaataacctgctgaaacttgttttgacagaaggcgagcgcaattcaggcctatctcagctgcgcgacgtcattttgacaaatctggccgagcagcttcagaacaatagattcgggagcgatgaagatgaccactataggctgaacgacgagcttctgcactatattctgaagatcgtggtgagggaatcttgtatcctcatcacgaaatgtcagacggtgtcaaaggatgattttcagaaactcctctccacggtgcccgcagctagttcatgtctcagatatctgatggctgtgcagaatcacctactctctaacactatcctgatcaaacctgatgagaatgacgacagtgattcgagtcttcagggcgaaacgctcaaagttcaggaactgaaagtcagcatactcgcactcgcaactcagattctgacaggatgcgacgaggtattggagatgttgcagcaggtcacgaccgcacttataaattctgacatcgcagaccgagagcaacggctcaagggtcttgagcaggtgactaaagctactatgttgggacacctgttgccagtattgcttaccagtttaatgcacccaaacctccagacgctcatcatggccgacgctctaatgccccagcttgtccagctggttctgtacacctcacagaccgccttattgctgaagacacagtgccctgtcttcgccgaagtgggatgctctccttgcggtgccccggaccagaagtgccgactgtttcctgatgagcgtatgctggaagagaaagaggaacctggcttcctcaccggactcaagataccagccccatgggccgctggaaagaccgttgagactgtccatccggtccgcgataactataaattcaaggagaccgtccacatacccggcgctcgctgtctgtacctcagattcgacagccgctgctcctcacaatacgattatgacaagctcgtaatctacgcagggcccaataccaattctcggaaggttgccgaatacgggggcaatacccttggttatggctccagatccgtgctcgggaccgggtggcctaaagacctggtgaaatgcatctcccctcccagtttgaactttaaagtggaaggcgacaccgtgaccttctcattcgaaatgcgctcaggccgggaacataatacccccgacaaggccatgtggggattcgcatgtaccgtacgggctcaagagagctcagaggacgtgagcggcggcttaccattcctggtggacctcgcactcgggctgtctgtgttagcttgctcaatgctcaggattctatataacggtcctgagatcactaaagaagaggaagcctgtcaggagctgctcagaagtaagctacttcagcggtgccagtggcaggtggaagctaacggcgtgatctctcccgccctgacaccatcccccagtcccctgcccctgaccatcgaggaagatcgggagtttacttacccatcagacgtcctagtcccccccgtgggaaactactttgacttgccccgcattcgacttcctcctggtatcatgattaagcttagggagatatctggaagagccagaccccagtttcgcccatctataaaagaggtgatccagccagacgtgatggaagagatggtcgtctcctgcgtaatcaagcatctgaacctggtcgatgcactgcagtcacttatcaacttccagtatcaagaggagcacgctgaggagtatgatctgttgtgtaagatcatgggcgaaacgttcaagaagctgaatgccatggagcgacagttgcagtctgtggccgaacttgaacagaagtggcaaagcgaggtcgatgacgccatgcagggaaagctggagaacaacatgcctttcttttatgactatcatttcaacgagaacaaaatgaaggaactggaactgctttgtagtatgaaagaggtctcattcgacggtaatgatctggaaaacatggtactgtctctccgtgaaaagttccttcaagaggtgaattccctcattcaaaagccaagccatcccctcgccaaaaccaagacactcgttaagagccttatgaaccgggccgaattgctgctacacgtcactatagctgcccaatctgggctgacacgatccataagtgggaccccggcagagactcctgcatgcaagtcggcctctgagaccaaagtgattagccacgcagtcagacaacctgtgtttctgaggtcaatgtctgccccgtcagatctagagatgattgggaacgaggacttggagttcacgagagccaatcagaggcggcgacatgtcacctcccacagatcctcgtcgtttaccctgctgcagagcctcgccatcgaggacagtcgggacaagccgacatattctgttctgcttggacaactgttcgcgttcatcgggactaatcctgaccaggctgttagctcgagttcattcctcctagcggcgcaaactagatggcggcgcgggaatacacgcaaacaagcactcgttcacatgcgcgagctcctgaccgccgcagttcgggtcggaggcgtgacacacttagtgggacccgtgacaatggtgctgcaagggggccctagaatcgaggaattgacttgcggcgggatggtcgaacaggtccaagaagcatttggtgagactatgacctcggtggtttccctttgcgctcgctatcccatcgcttgcgccaacagtataggcctactgtgtactatcccatacacccgaagcgaagagaagtgcctcgtacggagcggacttgtccaactcatggataggctttgtagtctctcaaaccaaacggagtcctcctcttctgagaagcagacaaaaaaacagaaagtggcgactatggcctgggcggccttccaagtgctggctaaccgatgcgtggagtgggaaaaagaagaaggagggtctaccgaggctgtccactccgggctggccagacaagtcagttctctccttaccaaccatttggcacgcgccacagaatgctgcgggaatcaggccgccgggaatgatgccctccaggacgtcctcagtctgctgaatgacttgtcaagatcacacatcggcaaagcaattttgtcccagccggcctgcgtctctaaacttctctcactcttattggaccagcgcccgagcccgaaattggtgttgattatactgcaactatgcagagcagcactgccgctcatgtccgtggaagattgcgggaatgtcgagctccctccgtggagctatagcgtgccgtcattaaatagcgaacaggaagatccgtccgatcccgccagcaaaatcgccagcctgttgctggccaagttagcagactatgttgtacctggttgtcagaccgttctcagccccacagcatcagagcctgatactaccctgacaaaaacctcaccaaaaaactcgctgaaaggcgacaaagatcctggcgaagagagtgaggccgtggacggaaaactctctatttttatccataaaagagaggatcagagctcccacgaagtgctgcagcctttgttgagtagctccgagggaaggcccttccgcttagggactggtgccaacatggagaaggtggtgaagatggacagggacatgacgaagggcgggtgttgtgaagtgatcacagaggaagccgctgctgccttgaggaaggcgaccaaatgggcccagtctgggcttatcgtgtccattgggccaccagttgaatcaatcaaccccgaaaccgtaagtggccttagcactggggacaaaaaaaagactgcccaaacatcgatctgtagagagcgtaactccgaactggcaagaacggaccctgttcggcccttcattagcggacatgtggctaatagtatggctgcagaagtgattgccctgctgcatagcctcctcatggccccagaaagtaacgctgcccagatttggactacaacagcggagaaggtgcttagccgagctctcatgtacattccccagctcggtaagtacgctgaatctatcctagagaacggtagctcctcaggccggaaacttgcaaaactgcagcgcatagcgagacaggccgttgcagccttatgcgctttgggaggcttcaaggaaacaatcaagataggcagcgaagtgcaagtcttaggcagaggcatcagcggcagcatcggtgtggtggcctctatcaatgagcaagaagggattgcaacggtgcggtttcctccaatcgactgccggaagaccagtcaggcaagcgacaccctgaccatccccctgtcccgactgtgtgttccccggtctgaagcactgccgttgcataaactgagcatcaccgagaaggttgtgcaagctgtccagagcatgctactgcctcaggaaggatctctgtctattcacactagcttgcctgccacgggcgatgggtcagccccggtcatggccgtggtcaggttgctcgctgagatccgaactcgagcctgcttggttatggcccagctgctggaggactctctcttctgcgaagagttcatccagcaatgtccagctgctgttgaagtacttaatctcgtcgcacaagaatgctcagcaggcgaacggctggccgtggtagaagtgcaatgcgaaaggttgagaatgctgtatagggactgtgccaggccccccccgcctccattgcaagctgacagaaggcagcctaaggaaattacgtggagtccaagcagagtgtttccgcccgtgcgggcctgcatgttttcgagccaccttacaagtgtgacctttctcgccgacccttcagccggcgggggtctccccaggggcacgtttatctatgctacttctccgttacccgtgcaggcccctagtttctactgggaaatcgaaatcgttagttacggcgatacagacgacgacacagggcccatcgtttctttcggcttcaccaccgaggcagagaagcgcgacggggcctggacgaacccagttgggacatgcctgttccacaacaacggtcgcgcggtacactataacgggagttctttgctgcagtggaagagcgtgagactcgatgtcacactgagccctggcgatgttgccgggatagggtgggagagaaccgagggtacacccccaccaccaggacagcccgccaaagggcgagtttattttacctactgcggtcagcgtctgtcaccatacctcgaagatgtgtctggaggcatgtggcctgtggtgcacattcaaaaaaagaacactaagacccgcgccaattttggctctcgtcccttcgcctatgccgaagggcaggctcatcgcaatgctgccgatctctgcactgacctggccgaagagatctctgcaaactttgaggcactcccatttgccatggccagtgattctgacaatgacgcggggacatccatagcctcagatcctggtacccacgggcccccatgcaggatcgccgctgtggccacggctcagcagcaatatgactcagacacctcatgccactataaggtagaactgtcctatgagaacttcatcactagcgggcccgaccctcatccaccacccatagccgatgacgagagtgatgatgatgacgacgacgacatcccacaggaggaccactacgccctgcttgttaaagcatgggaaaccaaagtctttcctaccatccgcagacgattccggaatgaagccgagcgcaaatcagggctcgatcagatcaagggcgctctccaactggggatggtggacatagccagacagacagtggagtttttatatgaggagaatggtggcatacctcgggatctgtacctacctactatagaagatattaaggatgaggccaataagttcaccatcgataaagtccggaaagggttgacagtcgtgaccagatctcccgactccaataatgtagcctcgtctgccgtggggactgctctgccaaaattcgcgatccgggggatgctgaagaccttcggcctccatggtgtggtactagatgttgacagcgtaaacgaactcgtgcaggtggaaacttacctaagatcagagggtgtgttggtgcggtactggtatcccatcgacatgttggaaaggcctcccgccgggtataggcgaactgccaccaatggcttggtgacactggataataccaatctgcagattcaccgcgagctgctgcgctgtgaggcggcactcgccagactgtactgccgcatggccctgcttaacatcttcgctcctaagttaccccatctctttactcggctgttccacattcctgctatccgggatattaccctggagcacctgcagctgctgtccaaccagctgttggccccccccctgccagatggtacaattagctcaagttccattttgctcgcgcagagcctgcaacattgtattcactcacagaactgttctgcgacggatctcttttatcagggcaattctcaaactgtacgcgagtggttgaacgtcgccataacccgcaccctacaccagggtgaagagtctctcctggagctaaccaaacagatctgctcctttttgcagacagctccggagcagttcccctcagaggaattcccgatctctgagagcaaagtaaacatggatgttaatttccctggagccgcgtttgtggttgtatcttgtaaagaatcgcaatctggcttcagaaaagattcttctctgtacaaagcaccctgggccagagtactcgtgtacggattagggcataaggtgaaacgaaacggccagttgaatcttattgaagccgcctgctaccctagagatgcgtctcctgcaaacaccggactcgcgccccccccgaccgctgaccaatacccatccgtagtgctgtccactgatcgggtccacattaaacttggggtctctccaccccccggcgccgtattggtactgcatagcctccctttggagttccccctggcgatggcatttgctgagcagctgttgtcatggaagagtgaggacagcgaagggaagtcagaagatgagcctgataccattccaacaagcgtcctgctccaggtcgtggagctgctcggcaactttctgtggaccacagacatggccgcatgtgttaaagagctagtcttccatctcctggccgaactccttcggactgttcacaccctggaacagcgtcgacacccagcaggactatccagtagcatcgcgctccagctaaacccttgtctggcaatgcttatggctctgcagagcgaactgcataaactttatgacgaggaaacccagaactgggtgtccggcggtgcctgcggaggcagtggcggtgccgccgccggggaccagggccgtttcagtacatatttccacgccttaatggagggctgcttggccgtggctgaggtgacactgcccacaaatatgtcagtgaccgcatcaggcgttacctctgcaactgcccctaatttatctgactcttcttccagctcatcgtctagcccaggacaaactcctcagagcccaagcctcctgtctaagaggaaaaaggtcaaaatgaaaagggaaaaggcctcctcttccggcaagaggcagtcttcacggactgtcgactccgatccaactgtcctaagcataggcggctcaaagcctgaggacatgttatggtttcatagagccctgactttgcttatcattcttcgccatcttactcgcaaagacccacagggtcttggagtgacctcagacgccattgccgatgcctgccaagccttggtgggaccaaccgcacacagtcgtctgcttgttatcagtggcatccctacgcaccttgatgaaggggtggtgcgtggggccatacggaaggcctgcaatgcccatggcggtgtgtttaaggacgagatttacatcccacttcaggaggaggacacaaaaaagcctaaagacaaagcagaaggcggggacggcaaagtcgagcctgagaagacactggccttccccgggaccgactctatggaagtgagtaccagctcatctctcacacccgcaatgagcatcagtgccagtgcaagtacgtctcaggcctctatatgcagttcacaggggataagccagactgtctcagatttaagcgttgacccactccccgcaggtctcgagctacccattccccctgggctcctggagccacacgccgtatcttcccaagagtccctggacatctccctatgctcaaccggcagcctcggctcactcggatctctgggagagcctcttgataatgctgagaccgcctccgtgagcgatatggggtcaatgtacacggtgacctccctggacaaccagcctctcgcagcacggccaataaaagggttcgccgtggtggaaatccggagcagggctaaaattgagaagataagagcaagcctgtttaacaacaacgatctaatcggactgtccagcctggatggtgaggacgagctgatggaaatgagtactgaggagattctcacagtttccgtggtcaaccagtccctctttgatacccagggcagtccggggctcgaggattattttaatgataagagtatcaaaggggaaaaactggtgcccggggccagggaagtgctgactgaaatcttcaagtcctgcgctcatagtgagcagaccttatcccttactccagccaagccgatccgggtgtcagacatctaccttagtaaagaacagatcaactcacagactccagggaatctgttgcacctgttctttactaatgtgcgaccccctaaaaaggtgctggaggatcaactgacccagattcttaggaagtatggggtgcctaagcctaagttcgataagtctaaatattctaaagcgggaaaagagcagcacccagtaaaggtagttagcactaaaagaccaatcacaaaaccgccagcaaaagataaagctgtactcaactctgtctctcgaactgcacttagtgagaaaaaaccaaccgtgaagccgaagtcacccgagaaatctaagccagacgaaaaagatcctgaaaagtcccctactaaaaagcaggaagtacccgaggagaagtacttgacgttggaagggttccataagttcgtcattgatcgggctcgccaagacatccggagcgtttggcgcgctattttgtcatgtggatatgatctccacttcgagaggtgcgcctgcatcgatgtgcggcacgcccaaaaagcaagccgaaaatggacactcgagatggatgttgccctggtgcagtacatcaaccagctctgtagacacctggcaattaccccagcccgccttcaccctcatgaggtctatctggatccagcagatgctgccgatcctagggttgcctgtctgctgaacgtgccaattgaaagtctacgactcagattcgcgctgctgcagtcgctaaacaccacactcgagaccttctttctgcccctggtggaactgcgccagaccccgatgtatacccactccatcgcggccctgctgaaggaagccaaaggactcattttttacgataccaaggtgaccgttatgaacagagtactcaacgccaccgttcagcgcactgcggaccatgccgcccccgagataacactggaccctctggaaattgtgggcggagagatcagagcttccgaaaattcttacttctgtcaggccgcaaggcagctggcaagcgtccctagtagtcaactgtgcgtaaaactggcatccggaggggaccccacctacgccttcaacatacgattcaccggtgaagaagtacatgggacaagcggaagcttcagacacttcttatggcaggtgtgtaaggagctgcagtcttcttctctctctcttctgctcctgtgccccagcagcgccgtgaataaaaacaaagggaaatacattcttacgccatctcctatcacttatggagaggaacagctgctgcatttcctaggacagctgcttggaattgccattagagctgacgtccctctgccgctggatctcctgccaagcttctggaaaaccttagtgggagagccactggatcccgaacaggatctgcaggaggctgatattttgacgtacaattatgtcaagaaattcgaatcaatcaatgacgaaacagagttagaggcactatgtgccgagatagcttcacagcaccttgccacagagtcaccagactcacccaataaaccttgctgcaggtttacgtatctgaccatgaccggggaggaggtggagctgtgctccaggggcagacacattctggtcgcctgggaaaataaagacatttacgcagccgccatccggtccctgcggctgcgcgagctacagaacgtggaatgcgtcactgccgtgcgggcaggattgggctcaataatccctttgcagctgctcaccatgctgtctccactcgagatggaactgcgaacctgcggacttccctatataaacttggagtttctgaaggctcatactatgtaccaggtcggactgatggaaaccgaccagcacattgagttcttttggggagcgctagagatgtttacccaagaggagctgtgcaaattcattaagtttgcttgtaaccaggagaggatcccctttacgtgtccttgtaaggatggagggcctgacacggcccatgtgccgccctacccaatgaagattgccccaccagacggtactgctggctcccctgacagtcggtacatccgtgtagagacctgcatgttcatgattaagctgccccagtactcctcgctggaaattatgcttgagaagctccgatgtgccatccattatagggaggatccactgagcggctag

SEQ ID NO: 25118 - DNA, 11991 bp, Artificial Sequence
  Description of Artificial Sequence: Synthetic coding sequence
atgccggccaatcaccttcccatagggtctactatgagcaccgtccacctctccagtgacgggacctacttctactggatttggtcccccgccagcctgaatgaaaagacgcccaagggacattctgtgtttatggatattttcgagctggtcgtggagaacggtgtgttcgtggctaacccactgcaggaacggaccattctcatgagaaaggaaggagagagcgccaagtcaatcaacgagatgttattgtctagactgtctagataccgtgcctctccgagtgcaaccctggccgcgctcacggggagcacaatcagcaatacattaaaggaggaccaggccgcgaataccagctgtggactcccacttaaaatgctgcgtaagaccccaatctatacgtgtggtacttacctcgtgatgctcgtgcctccacctgggggtagtgggtcttcagccacgagatctctgtttggcgggacatccggactgtcatctttaaaacgagcctgttacgatactgtgaacaacatgctgtggacgtgctcaaacgactacatcgaccaatggtgtaaccccggcaatcaagccttccactacgtatgccagcggctgggcgtgtcccacatcatcactgagcctaaagaagaagctatcaccaccaacgaggtgatcaaccagcttctccaccatgtgggtgctatgtgtattcaccaactaaacctcctggccaccaaccccaacttgccaattacctcagtcctcggaaaacagcatcctatcgaagcacaccacctgagctccatttgcgacattatggagaaagccatggttaatggtgacacctgtattatccgctgcatacttgtggtgtttcaggtcgtgtttaaattcttcttctctcctcagactgagcgcaatagggatattataagaagaagcggactgctcctctggcagttgctgatggcacctaaggaccagatttgccccgaaattcaaaaagaagtctgtcttgctatctcaagcggcctgaatatactctaccctggagaaacggaaatcaacaacctacttaagctcgtgctcacagaaggtgaacgcaatagcgggctgtcccagctacgggacgttatcctaaccaacctggccgaacagctgcagaacaaccggtttgggtctgacgaggatgaccactaccgattgaatgatgagctgctccattatatcctcaagatcgtggtgagagagtcttgtatactgatcaccaagtgtcagacagtgagcaaagatgatttccagaaactgttgtccaccgttcctgccgctagcagctgtctgagataccttatggctgttcaaaaccatctgctctctaacacaatactaataaagccggacgagaacgacgactccgattccagcttgcagggcgaaaccctgaaggtgcaagaactaaaggtctctatcttggccttggcaacacagatcctgaccggatgcgatgaagtgctggagatgctccagcaggtgactaccgcccttataaattccgacattgccgacagggagcagagactgaagggactagagcaagtaaccaaggccacaatgctgggacatctgttacccgtgctcctgactagtctgatgcatcctaatctgcaaacactaataatggctgatgccctgatgccccagctggtacaactggttctctacacgagtcagacagccttgctgctcaaaactcagtgtcccgtttttgccgaggtagggtgttccccatgtggggctcctgaccagaaatgtcgtctcttccccgacgagagaatgctggaagaaaaggaagagcccggatttcttacagggcttaagatccctgcgccgtgggccgccggcaagactgtcgaaactgtgcatcccgtgagggataattacaagtttaaagaaacggtgcacatccctggcgctcgctgcctgtacctgcggtttgactcacgatgctcttcccaatatgattacgacaaactggtcatttacgcagggcccaacacaaatagcagaaaggtcgcagaatacggaggcaacaccctcggatacggaagccgctccgtgcttggcaccggctggcctaaggacctggtaaagtgtatctcaccaccgagtctcaacttcaaggtggagggagataccgttaccttctctttcgaaatgcgctcaggacgagagcataatacacccgataaggcaatgtggggattcgcctgcaccgtaagggcccaggagtcatcggaggacgtaagtggcggactgccattcctcgtagacctcgcactggggttatccgtgctggcctgttcaatgctgcgcattctgtacaacggtcctgagatcacaaaggaggaagaggcctgtcaagaactcctccggagcaagctgcttcagaggtgtcagtggcaagtcgaggcgaacggcgtcatcagtcccgctctgactccctctccatccccactccctctcacaatagaggaagacagggagtttacctacccctcagatgttcttgtcccccctgtcggtaattactttgacctgccccggatccgcctgccacctggcattatgatcaaactgagggagatctccggtcgcgccagaccacagttcagaccaagcatcaaagaagtcattcagccagatgtcatggaggaaatggtcgtgtcctgtgttattaaacatctaaacctcgtggacgcccttcagtctctgatcaactttcagtaccaagaggaacacgctgaagaatatgatttgctatgtaagattatgggagagaccttcaagaaacttaatgcgatggaacgacagctgcagtctgttgccgagctcgagcagaaatggcagagcgaggtagacgacgccatgcagggtaagctggaaaacaatatgccgtttttctacgattatcatttcaatgaaaataaaatgaaggagttggagctgctgtgttctatgaaggaggtgtcgtttgacggtaatgacctggagaacatggtactctctcttcgcgaaaagtttttacaggaggtgaacagtctcatccagaaaccgtctcatcctttggccaagaccaaaacccttgtcaagtcattgatgaatcgcgccgagttattgctgcacgtgactattgcagctcagagcgggctgaccaggtctatttcaggtacccccgcggagacgcctgcctgcaagtccgcttcagaaacaaaagttattagccacgccgtgagacaaccggtctttctgagaagtatgagtgctccttcagacctggaaatgataggcaatgaggacctcgagtttacccgcgccaaccagaggcggaggcatgtgaccagtcaccgttcaagttcattcacacttctacagtcacttgccatcgaagactcccgtgacaagccaacctattctgtgctcctgggccagctcttcgccttcatcggtaccaacccggatcaggccgtgtcttcctcatcttttctcctggccgcccagaccagatggcgccgcgggaacactaggaaacaagcccttgtccacatgcgtgagctactcactgctgccgtccgtgttggcggggttacccatttggtgggacctgtcacaatggtgctccaaggcgggccccgcattgaagagctgacctgcggcggtatggtcgagcaagtgcaggaggcatttggggagacaatgacatctgttgtctccctgtgcgccagatacccgatcgcatgtgccaactcaatcggtcttttatgtacaatcccgtatacccgctccgaagaaaagtgcctggtgcgaagcggcttggtgcagctaatggatcgcttgtgcagcttgtctaatcagacagagtcttcctccagtgagaaacagactaagaagcagaaagttgctaccatggcctgggctgccttccaggtactggccaatcgctgcgtagaatgggagaaagaggagggaggcagcactgaggccgtccattccggactggcacggcaggtgtccagcttgcttactaaccacctcgcccgggccacagagtgttgcgggaaccaggccgcaggaaacgatgccctgcaggatgttttgtccctgcttaacgatctttcacggagccatattggtaaggcaattctgtcccaacctgcatgtgtgagcaaattactgtcactgcttctggaccagaggccctctcccaaactcgttctgattattctgcagctttgccgggccgccctgcccctgatgtccgtggaggattgtggaaatgtggaacttcctccttggagctactcagtcccaagcctcaactccgaacaggaggacccctctgatcctgcctctaagattgcgtctctgcttcttgccaagttagccgattatgtcgtccccggctgtcaaacagttttgagtcctaccgcctcggaaccggacactacactgacaaagacctctcctaaaaatagcctgaagggagataaagatcccggggaggagagcgaggctgtggatggcaagctttctatattcatccataagagggaagaccagagttctcacgaagtgttacagcctctgctaagctcgtctgaagggagaccttttcggctcggcaccggcgcaaatatggagaaagtagttaagatggatcgtgatatgaccaagggggggtgttgcgaagtcatcactgaagaggccgctgcagcactcaggaaggctaccaagtgggcccagagcggcctcatcgtctctataggcccgcccgtagaatcaatcaaccctgaaactgtctccggactatcaaccggagacaagaaaaaaacagcccagacatccatttgccgggagcgtaatagcgaactggccaggacagacccggtccggccttttatcagtggtcacgtagctaattcaatggccgccgaggttatcgctttgttgcattccctgctgatggccccggaatctaatgccgcgcagatatggactacaaccgctgagaaggtcctgagccgagctctgatgtatatccctcagttggggaaatacgcagagtccatcctggaaaacggcagttcttcagggaggaagctggctaagctccagagaatcgcccggcaggctgtggccgctctgtgtgccctgggagggtttaaagagactattaagatcgggtctgaagtccaagttttaggacgtggaatctcaggaagcataggcgtggtggcctccatcaacgaacaagagggaatcgccaccgtccgatttccccccatcgattgtcgcaagacctcgcaagcctccgacacgcttactattcccctttctcggctgtgcgtaccccgatcagaagctctcccgctgcacaaactgtccattactgagaaagtggttcaggcggtgcagtccatgctgttgccccaggagggctcgctgtctatccataccagcctacccgcgaccggagatggtagcgctccagtgatggcagtggtgcgcttgttggccgagatcagaactcgggcctgtctggtaatggcccaactactggaagactcccttttttgtgaagaattcattcagcaatgtcctgccgccgtggaggtgctgaatctggtggcccaggagtgctcagccggagaacggttggccgtcgtggaggtccagtgcgaaagactacgcatgctctatagagattgtgcccgcccaccgcccccaccactacaggccgaccgtcgccagccaaaggagatcacctggtccccatcacgtgtgttccctcccgtgcgtgcctgcatgttttcatctcaccttacatcagtgaccttcctggcagatccaagcgccggggggggactgcccaggggtacattcatttacgccacgagtcccctcccagtgcaggcccccagcttttactgggagatcgaaatagtgagctacggcgacaccgatgacgatacagggcctatcgtgtctttcggattcacaaccgaggcagaaaaaagagatggggcctggaccaacccagtgggcacatgcctctttcacaacaacgggcgcgctgtgcattacaatggttcctccctgctgcagtggaagagcgttcggctcgacgtcaccctgagccccggggatgtggctggtattggctgggagcggaccgaggggacgccacctccccctggacaaccagcgaagggaagagtgtattttacgtattgcggccagcggttgagcccatacctcgaagacgtgtccggcggtatgtggccagtggtacatattcagaagaaaaatacgaagacccgagctaacttcggcagtaggccattcgcttatgctgagggccaagcccaccgcaacgcagctgatctgtgcacagatctagccgaggagattagcgccaactttgaagcactgccgtttgccatggcttccgattccgacaacgacgctggtacaagtatcgcctcagaccctggcacacacggcccgccttgtaggatcgcggctgtggcaaccgctcagcagcaatacgactcagacacatcctgccattacaaggtagagctctcttacgaaaattttataacatccgggccagatcctcatccccctccaatcgcagacgatgagagtgacgacgacgacgatgacgatatcccacaagaggatcactacgcccttcttgtcaaggcatgggagaccaaagtgttccctaccatacggcgccggttccgaaacgaggccgaacgcaagagcggcctcgaccagatcaagggcgcactgcaattgggaatggttgatatcgcgcgccagactgtcgagtttctgtacgaggagaacgggggcattccccgcgacctctatctgcctaccatagaggatattaaagatgaagctaacaagttcactattgacaaggttcgtaaaggcctgaccgtcgtcactagatcaccagacagcaacaacgtggcctccagcgccgttggaacggctttacccaagtttgccatccgcggaatgctaaagacttttgggctgcatggagtggttctcgacgtagattccgtgaacgagctcgtccaagtcgaaacgtacctcagatcagagggagtgctcgttaggtattggtatccaatcgatatgctggagcggcccccagccggatatcgccgaacggccactaacggtttagtcactttggataacactaatttacagattcaccgggagctgcttcgctgcgaggccgctttggctaggttatactgtcgtatggcgctgctcaatatcttcgctcctaagttgccccatctcttcacacggctgttccatattccggctattcgcgacatcactctggaacatctccagttattgtccaaccagctgttagctccccctcttcccgatgggaccatatcaagctcctccatattgctggcacagtcgctgcagcattgtatccactcacaaaactgttccgctacagacctcttctatcagggaaactcacagacagttagggagtggctgaacgtcgccataaccagaacgttacaccagggagaagagagccttctggaacttacaaaacagatatgttcctttctacagactgcgcccgagcagtttccatccgaggaatttcctatcagtgagagcaaggtgaacatggatgtgaacttccccggggcagccttcgtggtcgtcagctgcaaggaaagtcagagtggattccgaaaagattccagcttatataaggccccttgggcaagagtgcttgtgtatgggctcggccataaggtcaagagaaatggccaacttaatctaatcgaagccgcctgctatccaagggacgcttccccggcaaataccggtttggcccctccgcccaccgctgaccaatatcccagtgtggtattgtccactgatcgggtgcacattaaactgggtgtcagtcctcctcctggggctgtcttggtattacactccctcccacttgaatttcccctggccatggcctttgctgaacagctgcttagctggaaatctgaggacagcgagggaaaaagcgaggacgaacccgacaccattcccacctctgtgctgcttcaggtcgtcgaattgctcggtaatttcctgtggaccacagacatggctgcctgtgtgaaggagttggtctttcacctgctcgcagaactcctacgcactgtacacaccctcgaacagagacgtcatccagccggactctcttccagtattgctttgcaactgaacccctgtcttgccatgcttatggccttgcagagtgagctgcataaactgtatgatgaggagacccagaactgggtgagcgggggagcctgcggcggatcgggcggggcagctgctggcgaccaaggacgctttagcacttactttcacgcattgatggagggctgtttggcggtagccgaggtcactctgccaactaatatgagcgtgacggcctcaggggtgacttcggccaccgcccctaacctttccgacagttcctcaagttcaagcagttctcccggacagacgccccaaagcccttcgctcctctccaaacggaaaaaggtgaagatgaagcgcgagaaagcctcaagctctggaaaacgtcaaagttcacggacggtggattcagaccccacagtgttgagtatagggggctcaaagcctgaggacatgctttggttccaccgggccttgaccttgttaataatcctgaggcacctaaccaggaaagaccctcaaggcctgggggtcacgagtgacgctattgcggatgcatgtcaggccctggtcggcccaacagctcattcacgcctgttggtgatcagcggtataccaacccacctcgacgagggcgtggtgcgcggcgccatccggaaggcctgtaacgcacatggcggtgtgtttaaggacgagatttatattcccctgcaggaggaagacactaaaaaaccaaaagacaaggctgaagggggtgatgggaaggtggagcctgagaaaacacttgccttcccagggacagactccatggaggtctcaacttcatcctcactaacccctgcaatgagcattagcgcctcagcatctacttcccaggcatcaatctgctcatcacagggtatcagccaaacagtctctgacctgtcagtcgatccactcccagctggcctggagttgcctatcccccccggactattggaacctcacgcggtcagctcacaggagtcattggacatcagtctgtgtagcactggatcgctaggctcattgggatcactaggcgaaccactcgataacgccgagaccgctagcgtctcagacatgggcagcatgtacaccgtcacatccctcgataaccagcccttggcagcccggcccatcaagggctttgcagtagtggaaatcaggtcccgggctaagatcgaaaagattcgagcctcgctgttcaataataacgacctgattgggttatcttcgctggacggagaagacgagttgatggagatgtcgactgaagaaattctgacagtttccgtggtgaaccaatccctcttcgacacacaaggctccccgggcctggaggattatttcaatgacaaaagtatcaaaggggaaaaactcgtcccaggagccagggaagtcctaactgagattttcaaatcgtgtgcccacagcgagcagactctctccttaactccggccaaacctatcagggtcagcgatatctacctgagcaaggaacagatcaatagccagacccctgggaatctccttcacctttttttcacaaacgtacgacccccgaaaaaggtgctggaagatcaactgacgcagatacttcgtaagtacggcgtacctaaacccaaatttgacaaatctaaatattcaaaggctgggaaagagcagcatcccgtcaaggtggtctcaaccaaacggcccataaccaaacccccagccaaggataaagctgtgctcaactccgtgtctagaactgccctgtcagagaaaaaacccacagtgaagccgaaaagcccagaaaaatctaagcctgatgagaaagacccagagaagtcgcccaccaaaaaacaagaggttccggaggaaaaatatcttacactggagggatttcacaaatttgtgattgaccgggcaaggcaagatattcgaagcgtgtggcgcgcaatcctgagctgtggatacgacctgcacttcgagaggtgcgcttgcattgacgtcaggcatgcacagaaggccagcaggaagtggacgctcgagatggacgtcgctcttgtgcagtacattaatcaactgtgtcgccacctagccataacccctgcccgtctgcatccacatgaagtctacctggatccggcagatgccgctgatccccgggtggcctgtttgctgaatgtgcccatcgagtctttgcggctgagatttgctttgctgcagagtctgaacacaaccctggagacctttttcctgccgttagttgaactccggcaaactcccatgtatacacatagcattgccgcccttctcaaggaagcaaagggactaattttttatgatacgaaggtgacagtgatgaatagggttttaaacgccaccgtccagcgcactgccgatcatgctgctcccgagatcaccttggatcctctggagatcgtcgggggcgagataagagctagcgaaaattcctatttctgtcaggccgctaggcagctggcgagcgtgccaagttcccagctctgcgtaaagttggccagcggcggtgacccaacctacgcttttaatatacgatttacgggagaagaagtccacggaacctccggatcctttaggcatttcctgtggcaagtgtgtaaagaattacagtctagttctttgtcgctgctccttttgtgtccaagttctgccgtaaacaaaaataagggaaagtacattctaacaccatccccaatcacatacggggaagagcagttgctccacttccttggccagcttctgggcatcgccatcagggccgacgtccccctcccgctggatttactgccctccttctggaaaacactggtgggagagccactggacccggaacaggatcttcaggaagctgatatcctcacttacaactacgtcaaaaagttcgagtccattaatgatgagacagagctagaagcactgtgcgccgaaattgcttcacagcacttggcaactgagagtcccgattcacctaacaaaccatgttgccgattcacttacctcacaatgaccggcgaagaagtggagctctgttccaggggccggcacatccttgtggcctgggagaacaaggacatctatgccgccgcaatacggtcattgaggttgcgggaactccagaacgtggaatgcgttaccgcggtcagggccggactgggaagtatcattccactgcagttactgacgatgctgagcccgctggaaatggagctgcgcacatgcggcctgccgtacattaacctggaatttctgaaggcgcacactatgtaccaggttggcctaatggaaactgaccaacacatagaatttttttggggcgctcttgaaatgtttacacaggaggaattgtgtaaatttataaagttcgcctgcaaccaggaacgcatccctttcacctgtccatgcaaggacggcgggcccgatacagcccacgtgccgccataccctatgaaaattgccccaccagatggtaccgccggctcacccgattctcgctacatccgtgtggaaacctgcatgtttatgatcaaactgccacagtactcaagcttggaaattatgctggagaagcttagatgtgccatccattatagagaggacccactgtcaggctag

SEQ ID NO: 25119 - DNA, 849 bp, Artificial Sequence
  Description of Artificial Sequence: Synthetic coding sequence
atggagagccgcatgtggccagcactgctgttgagccatttgctccccctatggcccctgctcctcctcccactgccgccaccggcccaggggagtagttccagccctaggacacccccagcacccgcaaggccaccctgtgccaggggggggccatccgctcctcgccacgtgtgtgtgtgggagcgtgctccacccccctcacggtctccacgagtgccacgcagccgaaggcaggttcttcccggcacagcacccccagcaactccatctgggttcgaggaaggacccccttcatcccagtacccatgggccattgtttggggaccaacagtaagcagggaggacggaggcgatccaaattccgctaaccccgggtttctcgattatggcttcgctgccccccacggactggctactccacatccaaattctgacagtatgcgaggggacggggacggacttatcctcggcgaggctccggctactctaagaccgttcttattcggcgggagaggggaaggagtcgaccctcagctgtacgtcacgataacaatctccatcataatagtgttggtggctacaggtataatctttaagttctgttgggaccgctcgcagaagcggaggaggccctctggccagcagggggccctgcgccaggaggagtcacaacagcctctgactgacctctctccagctggagtcactgtgctcggcgcgttcggtgacagtccgacgccgacccccgaccacgaggaacctcgggggggccctcgaccagggatgccccatcccaaaggcgcccctgccttccagttgaataggattccacttgtgaatctgtag

SEQ ID NO: 25120 - DNA, 771 bp, Artificial Sequence
  Description of Artificial Sequence: Synthetic coding sequence
atggagtccagaatgtggccagctctgctcctgtcacacctactgcccctttggcccctgctcttgctgccgctacctcctgcaccccgccatgtgtgcgtctgggagcgggcccctccccccagccgtagcccccgggttccccgctcccggcgccaagtgcttcccggcacagctcctcctgccacgccctccggattcgaggaaggaccaccaagctctcaatatccgtgggctatcgtgtggggccccacggtctctagggaggacggaggtgatcctaactccgctaaccctggtttcctcgactatggttttgccgcgccacatggcttggccactcctcatcccaacagcgactccatgagaggtgatggcgacggattgattctaggagaagctcctgccaccctgagacccttcctgttcggggggcggggtgagggcgtcgatccccagctttatgtaactatcactattagtatcattatcgtcctggtggctactggaatcattttcaagttctgctgggataggtcccagaaacgtcgaagaccctccggacagcagggggccctcaggcaggaagagagtcagcagcctctcaccgacctctcacccgcaggggtgacggtgctgggtgccttcggtgattccccaacccctaccccagatcacgaagagccaagaggtggcccacgccccggaatgccacaccctaaaggggctccagctttccaactcaaccgcatccccttagtcaacctgtag

SEQ ID NO: 25121 - DNA, 831 bp, Artificial Sequence
  Description of Artificial Sequence: Synthetic coding sequence
atggagagcaggatgtggccagcccttctgctgtcacaccttctgcccctctggccattgcttctgctaccactcccacccccggcccagggatcctccagcagccctcgcactccacccgcccctgccagaccaccttgcgctcgcggcgggccgagcgctccacgccatgtttgcgtttgggagcgcgcaccaccgccatcaaggtctccccgggttccacgctcaagaaggcaggtcttacccgggaccgccccccctgccaccccaagcggctttgaggagggccccccctccagccagtatccctgggctattgtgtggggacctacagtgtctcgggaggatggaggcgatccaaattctgccaacccagggttcttggactacgggttcgctgcacctcacggcttagcaacccctcatccaaactctgatagtatgagaggggacggcgacggtctgatactgggcgaagccccggccaccctgcgacccttcctgtttggcgggcggggcgaaggggtggatccacagttatacgttacgatcacaatttcaatcataatcgttctggtcgctaccggaataatctttaagttttgctgggacagaagccaaaagcggcgacggccttcgggccagcagggcgccctgcggcaggaggagagccagcaacctctgacagatctaagtcccgctggtgtgactgttctaggagccttcggtgattcccccacacctacacccgaccacgaagaacccaggggcggacccaggcccggaatgccacaccctaagggcgcacccgcattccaactaaatcggtag

SEQ ID NO: 25122 - DNA, 849 bp, Artificial Sequence
  Description of Artificial Sequence: Synthetic coding sequence
atggaaagccggatgtggcccgcgctgctactcagtcacctcctgccgctgtggccgctgctccttctccctctcccgccacccgctcaaggatcctcttcctccccccgtacaccaccagcgccagctcgcccaccatgcgcccggggcggaccctcagccccgcggcacgtctgcgtttgggagcgggccccacccccaagccgatcccccagggtgccaagaagccgccggcaagtgctccccggaaccgcccccccagctactccttccggcttcgaggaaggacccccaagcagccagtacccttgggcaattgtgtggggccctaccgtttctcgggaggacggaggtgaccccaatagtgcgaacccggggtttctggattatggtttcgccgccccacatggcctggctacaccacacccaaattctgactccatgcgcggcgatggcgatgggctaatcctgggagaggctccagccactcttagacccttcttgtttgggggtcgaggtgaaggggtcgacccacaactgtatgtcactatcaccatcagcatcatcatagtcctggtggcaactggtatcatcttcaagttttgttgggatcgaagccagaaaagacgccggcccagcggacagcagggtgctctgcgtcaggaagaaagtcaacagcctctaacagatctgtccccagctggtgtgacggtgttaggcgcattcggagacagtcccacccctacacccgaccacgaagagcctaggggcggaccacgaccaggcatgccccatcccaagggtgcccctgcgttccagcttaataggataccactggtgaacctgtag

SEQ ID NO: 25123 - DNA, 492 bp, Artificial Sequence
  Description of Artificial Sequence: Synthetic coding sequence
atgagctggaggcctcagccgtgttgtatttctagctgctgtttgaccaccgattgggtacatctgtggtacatatggctgctcgtcgtgatcggggcgttgctcctcctatgtggattgacaagtctctgcttcagatgttgctgcctgtcccggcagcagaacggggaggatggaggccctcctccctgtgaggtgaccgtgattgcattcgatcacgactccacattacagtcaacgattacatccctgcagagcgtctttggtcctgccgcccgcagaattctcgctgtcgcacacagtcactcttctctgggtcaactcccgtctagtcttgacacgttacccggctacgaagaagcactgcatatgagcagattcactgttgctatgtgtggccagaaggcaccagacttacccccagtgcccgaagaaaaacagcttccaccgactgaaaaggagtctacccggatcgtggacagctggaactag

SEQ ID NO: 25124 - DNA, 552 bp, Artificial Sequence
  Description of Artificial Sequence: Synthetic coding sequence
atgggagtaagagtccacgtcgtagctgctagcgcactgctttatttcattctgctgtccgggacgcggtgcgaggaaaactgtggcaaccctgagcactgcctgacaaccgattgggttcatctgtggtacatttggctgcttgttgttatcggggctcttctgctgctgtgtgggctcactagcctctgcttccggtgctgctgcctgtctagacagcagaatggcgaggacggagggccacccccatgcgaggtgacagttatcgcattcgaccacgactctaccctgcagtctactattactagtttacagtctgtattcgggccggcagcaaggcgaattttggctgttgcgcacagccattcttctctggggcaactaccgagcagcctagacaccttgcccggatacgaggaggcgctgcatatgagtagattcacggtcgctatgtgtggccaaaaagctcctgatttacccccagtccccgaggagaaacaactccctccaacagaaaaggaatccacacgaattgtagacagctggaattag

SEQ ID NO: 25125 - DNA, 552 bp, Artificial Sequence
  Description of Artificial Sequence: Synthetic coding sequence
atgggagtacgggtgcatgttgtggccgccagtgccttattgtacttcatactgctctccggcacgagatgtgaagagaactgtggcaatcctgagcactgccttacgaccgattgggtgcacctttggtacatctggttgcttgtcgtgatcggggcccttcttctgctgtgtgggctgacttcgctctgctttaggtgctgctgtctaagccgccagcaaaacggggaagatggaggaccccccccgtgcgaggtgacggtcatagcatttgaccatgactctacgcttcagagcaccattacgtcattgcagtccgtcttcggacctgccgctaggaggatactggccgtcgctcactcccactcaagccttggtcagctgccctcttcactcgataccctgcctggctacgaggaggccctccacatgtcacgcttcactgttgccatgtgtggacaaaaggcacctgacctgccgccagtgcctgaggagaagcagttaccgccgactgaaaaagagagcacccgcatcgtcgactcttggaactag

SEQ ID NO: 25126 - DNA, 273 bp, Artificial Sequence
  Description of Artificial Sequence: Synthetic coding sequence
atgggcgtaagagttcacgtggtcgccgcatctgcattgttatactttattttgctgtctggaacgcggtgtgaggagaactgtggtaatccagaacactgtttgaccactgattgggtgcatttgtggtacatatggctcctggtggtgatcggtgcccttctgctgttgtgcggactcacctcactgtgtttccggtgctgctgcctgtccagacagcaaaacggtgaagacggaggtccccccccctgcgaggtgactgtaatagcatag

SEQ ID NO: 25127 - DNA, 174 bp, Artificial Sequence
  Description of Artificial Sequence: Synthetic coding sequence
atgcccaccgggaaacagctggcggatatcggttataagaccttctctacgagtatgatgttgcttaccgtgtacggcggatacttgtgttcggtgagagtgtaccattattttcaatggcgccgtgcgcagaggcaagctgccgaagagcagaaaacatctggaatcatgtag

SEQ ID NO: 25128 - DNA, 174 bp, Artificial Sequence
  Description of Artificial Sequence: Synthetic coding sequence
atgcccacagggaagcagttagcagacattggttacaagaccttcagtactagcatgatgctgctgacagtctacgggggctacctgtgctcggtgcgagtctatcactactttcagtggcgcagggcccagcggcaggctgccgaggagcagaagacttccggaatcatgtag

SEQ ID NO: 25129 - DNA, 174 bp, Artificial Sequence
  Description of Artificial Sequence: Synthetic coding sequence
atgccgaccgggaagcagctcgccgacatcgggtataagactttttccacatccatgatgctgctgactgtgtatggtggctacctctgctccgtccgggtgtaccattattttcagtggcggagagctcaacggcaagctgccgaggagcagaaaacatctgggatcatgtag

SEQ ID NO: 25130 - DNA, 174 bp, Artificial Sequence
  Description of Artificial Sequence: Synthetic coding sequence
atgccaactggcaagcaactcgccgatatcgggtataaaacattttccacatcaatgatgcttctgacagtttacggagggtacctgtgttcagtccgtgtctaccactacttccaatggcggcgagcacagagacaggcagcagaagagcaaaagacaagtggtattatgtag

SEQ ID NO: 25131 - DNA, 678 bp, Artificial Sequence
  Description of Artificial Sequence: Synthetic coding sequence
atggcccagtctgattttctctatcctgagaatcccaaaaggagggaggaagtcaatcggcttcatcaacagctcttggattgtctgtcagatagctttgacgttacgaacaaacttactgaggtcttgaatatgcatctcggctgcaggttggcttctattgagatgaagcgtgatggtaccatcaaagagaattgtgatctgattatacaagctattatgaaaatacagaaggagttacagaaggtcgacgaggccctcaaggataagctcgagccaaccctataccgaaaactgcaagacatcaaagagaaggaaaccgacaagattgccatcgtgcagaaggtcattagtgtaatacttggagaggcgacaagcgctgccagtgccgtagcagttaaactagtggggtcaaacgttacgacaggaatcattaacaaactggtaactgtgctggcacagattggcgcctcccttctgggctccattggggtggctgtgctcggcttaggcattgatatgatcgtgagagcaatacttggtgcagtagagaaaacccaactgcaagctgccataaagtcatacgagaaacatttggtggaattcaagtcggcaagtgaaaagtataaccatgccataacagaggtgatcaataccgtgaaacaccaaatgaaatag

SEQ ID NO: 25132 - DNA, 456 bp, Artificial Sequence
  Description of Artificial Sequence: Synthetic coding sequence
atggagtatgtgctggaggtcaaaaattctcccaggcatctgctgaagcagttcacagtctgtgatgttcctttatatgatatttgcgactacaatgtgtcaagagaccgctgccaagagttagggtgctgtttctacgagggcgtttgctacaagaaggcagttccgatctacatccacgttttcagcgcgctgattgttatcattgcgggtgcctttgtgataaccatcatctacagagttatccaggaatcccggaaagagaaggccatcccagtggacgtggctctaccacagaaatcatcagagaaagcagagctggcttcttcttccagcaaacttggtttgaagccagcctcccctgggcctccgtcagctggtccgagcatgaagtctgatgaagataaggatgatgtcaccggcacaatcacagaggcagaagaaacagaggattag

SEQ ID NO: 25133 - DNA, 258 bp, Artificial Sequence
  Description of Artificial Sequence: Synthetic coding sequence
atggaggcaggcgaacggatcgatgcttctcagttacctcatcgagtgctggagacgagagggcacgcaataagtatattatttggcttttggacctctttcatctgtgacacttatatagtgctcgcgtggatttcaaagattaaaggttccccagatgtttccgcctcatctgacgagccatatgcgagaatccagcagtccagacgtcaatgtcatgctgaggaagaccagtcacaagtgcccgaagcagggtag

SEQ ID NO: 25134 - DNA, 2124 bp, Artificial Sequence
  Description of Artificial Sequence: Synthetic coding sequence
atgagtcctcacggagatggcagaggccaagcgcagggtcgcgctgtgagagttggactacggcgctccgggggcatccgagggggtgtggctgttttcgccgccgttgctgccgtcttcacctttacgctgcccccatcagtgccaggcggggacagcggtgagcttatcaccgctgcgcatgaactcggcgtagcccaccctccaggttatccactgtttactctcgttgccaaacttgccattacactatttccttttggcagcatcgcttatcgtgtgaatcttctgtgcggacttttcggggccgtggctgctagtcttctcttctttacagtcttcagactaagcggaagttcagcaggcggcattctggcagctggtgtcttctcgtttagtcgactgacttggcagtggtctattgcagccgaagtctttagcctgaacaaccttttcgtcggtcttttgatggcgctcaccgtgcattttgaagaggccgccacggccaaggaacgatctaaagttgctaaaatcggggcattttgctgcggcttgagcctgtgtaaccaacacactatcattctatatgtgctgtgcattataccctggatcctcttccagttactgaagaagaaagagctttcgttgggatctttgttaaaactttcgctatacttcagcgctggcctgttgccttatgtccacttgccgataagctcatatcttaaccatgcacggtggacttggggtgatcagaccacccttcaaggtttcctgacccactttttaagagaagagtatggtacattcagcctagcaaaatctgaaattggttcatccatgtcagagatcttgttaagccaagtgacaaacatgcgcaccgagctgtcattcaacattcaggccctagccgtatgcgccaacatctgtctggctacaaaggataggcagaatcccagtctcgtgtggctgttcactggaatgttctgtatctattcactgttcttcgcctggcgtgccaatcttgacataagcaagccattattcatgggtgtggtggagcggttctggatgcagtccaatgcagttgtggccgtgcttgcgggcatcgggttagccgcagtagtctctgagactaatcgggtcctgaattctaatgggttacaatgccttgaatggctgagtgcaaccttgtttgtcgtataccaaatttattctaattactcagtgtgcgatcagcggacaaactacgtgatcgataagttcgctaaaaatcttttaacatcaatgcctcacgacgctattattttgctgaggggcgacctacctggtaatagcctgaggtacatgcattactgcgagggtctgcggcccgacatctcgctggtggatcaagagatgatgacctacgaatggtatctcccaaaaatggcgaaacacttgccaggcgtgaatttccctggcaaccggtggaatccagtagaagggatacttcccagcggaatggtgacgtttaatttgtatcactttctggaagtgaacaagcaaaaggagactttcgtttgtatcggaatacatgagggagacccaacctggaagaaaaattatagtctgtggccgtgggggagctgtgacaaattggtgcccctcgagattgtgttcaaccccgaagaatggattaagctgaccaagtctatctacaattggacagaagagtacggtcgcttcgacccgtcaagctgggaatctgtggctaatgaggagatgtggcaggctcgaatgaaaacccccttcttcatcttcaatcttgccgagaccgcccacatgcccagcaaagtgaaggcccagctctacgctcaggcctatgacctgtataaagaaatagtctatctccagaaggagcaccccgtaaactggcataagaactacgccattgcttgtgaaaggatgctcaggctccaggcacgcgatgccgacccggaggttctcctgagcgagactatccgccacttccgactatactcgcagaaagccccgaacgatccacagcaagcagacatattaggcgccctgaaacatctccggaaggagcttcaatcactgagaaatagaaaaaatgtgtag

SEQ ID NO: 25135 - DNA, 726 bp, Artificial Sequence
  Description of Artificial Sequence: Synthetic coding sequence
atgatgacgtacgagtggtacctcccaaagatggccaagcacctgcccggcgtgaacttccctggaaacagatggaaccctgtagaagggattctcccctcagggatggtgacctttaacctgtaccatttcttggaggtgaataagcagaaggagacttttgtgtgtatcggtatccacgagggagacccgacctggaagaagaattacagtctttggccctggggcagctgtgataaactcgtccctttggaaatcgtgtttaatcctgaggaatggattaaattaaccaagtcaatctacaattggacagaggaatacggccgttttgaccccagctcctgggagtcagtagctaacgaggaaatgtggcaggcccgtatgaagacgccgttcttcatcttcaatctggctgaaacagcacatatgcccagtaaagtgaaagcccagctatatgctcaggcatatgacctctacaaggagattgtgtatttacagaaagagcatccagtgaattggcacaagaactatgcaatagcatgcgagcgcatgctgcggctccaagcaagagacgcagatcccgaggtactgctgagtgagaccatacgtcactttcgtttatatagccagaaagctcctaatgatccccagcaggctgacatactgggagccctgaaacatctaaggaaagagctacagtccttacggaataggaagaatgtttag

SEQ ID NO: 25136 - DNA, 1230 bp, Artificial Sequence
  Description of Artificial Sequence: Synthetic coding sequence
atgagcccacatggtgacggaagaggccaggcacagggaagggccgtgagggtggggttgcgccgtagcgggggtattcgaggtggggttgccgtgttcgcagccgtggcagcggtcttcacttttaccttacctccctcagtccccggaggcgatagcggggaactcattactgccgcccatgaactcggtgttgctcacccaccaggatacccactgttcaccttggtggctaagctggctataactctgttcccattcggcagtatagcctatcgcgtcaacctgctgtgcggcctattcggcgccgtggctgcaagcttgctgttttttaccgtcttccggctcagtggctcatcagcaggtggaatccttgccgccggcgtgttctccttttcgaggctcacttggcaatggtccatcgctgctgaggttttttctctaaacaatctgttcgtcggactgctgatggccctgaccgtccactttgaggaagctgccacagcaaaggagagatctaaggtggctaaaataggcgccttttgctgtggcctttcattgtgcaatcagcacaccataatcttgtacgtgctgtgcatcatcccttggatcttgttccagcttctgaaaaagaaggaactgtccttaggaagcctattgaaactgtccctgtacttctccgctggacttctcccctacgttcacctgccgatttcatcttacctcaatcacgcacgctggacttggggcgaccaaacaactttgcagggctttctgacgcatttccttagggaggaatatggcaccttttccctggcaaaatcggaaatcggctccagcatgtcagagattcttctgtctcaggtgacaaatatgcgaactgaactgtcatttaatatacaggcccttgcggtgtgcgcaaacatttgcctggctaccaaggaccgccagaatccttccctggtgtggttattcactggcatgttttgcatctatagtctattcttcgcttggcgcgccaacttagatatttctaaacccctatttatgggggtagtagagagattttggatgcagagcaacgccgtagtggccgttctggcaggtatcggcctcgcggccgtggtgagcgagacaaatagagtgcttaatagcaacggcctccagtgcctggaatggctctcagccaccctttttgttgtttatcagatttatagtaattaccgctag

SEQ ID NO: 25137 - DNA, 396 bp, Artificial Sequence
  Description of Artificial Sequence: Synthetic coding sequence
atgatgaactttcgccagagaatgggatggattggggtcggactttacctgttggcctctgccgctgccttctattatgtctttgaaatttccgagacctacaatcgactcgcgttggaacacatccagcagcatccagaggaaccactggaaggcaccacttggacccatagcctcaaagctcaactcctctctctccctttctgggtctggaccgtgattttccttgtgccatacctgcagatgttccttttcctgtattcctgtactcgcgctgatccaaaaactgtgggctattgcataatcccaatctgtttagctgtcatttgcaaccggcaccaggcctttgtaaaggcctctaaccagatctcacggctccagcttatcgatacgtag

SEQ ID NO: 25138 - DNA, 510 bp, Artificial Sequence
  Description of Artificial Sequence: Synthetic coding sequence
atgctggctttcagtgagatgccaaaacctccagactactccgaactgtccgactctcttaccctggctgtaggaacgggccgattttccggcccactgcacagagcctggcgtatgatgaacttcagacagcggatgggttggattggtgtcggactctatctattagcatccgccgcggccttctactacgtcttcgagatcagtgagacctacaatagattagcccttgagcacatccaacagcatccggaggagcctcttgaaggtacgacttggactcacagcctgaaagcgcagctgctcagccttccgttttgggtgtggactgtcatctttctggtaccctatctgcaaatgttcttgttcttgtactcctgcactcgagcagaccctaagactgtgggatattgcataatcccaatttgtctggctgtgatttgcaatcgccatcaggcttttgttaaagcttcaaaccagatctcccggctgcagctgatcgacacttag

SEQ ID NO: 25139 - DNA, 522 bp, Artificial Sequence
  Description of Artificial Sequence: Synthetic coding sequence
atgatggcacagctgttccttctgcaggcaaatgcagtcctgccgttaagtcacgagattaaggttaagcggcagattagactgcccgcaccattgtatcctcccgagaggaatgactctaggtcgttccaaattcctcaggatctgcgcgagaaaggctgggaagaaggtcagcagcacttcgcaggtaaggccgccgatgcctttcccgcccctgttcagttagaaggcctggaagctggccagactaccctggcctctcccgaagtgggaccctggcgacctaaacgtctgtccggggtgtgcctgctgtctgcactcttgccagatccatgcaaaacaaacgggacatttttgctacagaaacaccaccttccgtcattgctggctgttattctcttccccgttatcattctgacaggggcaagcttcgcccaccttttcgtcgccctctttgtgtctcacctgttacttaaactacctctcggcgctggaatgaggatgcaaagggatgcccgttag

SEQ ID NO: 25140 - DNA, 522 bp, Artificial Sequence
  Description of Artificial Sequence: Synthetic coding sequence
atgatggcccaattattcctcctacaggctaacgctgtgctgcccctttctcacgagatcaaggtgaaacgacagattcgcctgccagcaccgctgtaccctccggagcgcaacgactctagatctttccagataccccaagatcttcgagagaaaggttgggaggaagggcaacagcatttcgccggcaaggccgctgacgccttccccgcccccgtccagcttgaggggctggaagcgggccagaccacgctagcgagtcccgaggttgggccttggagacccaagagactctccggcgtgtgtctactgagcgcactcctcccagatccatgtaagacgaacggcacatttctgctgcagaaacaccacctgccctccctcctggccgtgatactgttccccgttattatcctcaccggagctagtttcgcacacctgttcgtagcgctctttgtgagtcacttgttactcaagctccccctcggtgctggcatgaggatgcaacgagacgctcggtag

SEQ ID NO: 25141 - DNA, 2817 bp, Artificial Sequence
  Description of Artificial Sequence: Synthetic coding sequence
atgccagccttagagcacatgaatcaaattttgcacatattgtttgtgttcctgccttttctctgggctctgggcaccctacctccgccggacgcactcttgttatgggcgatggagcaggtcctagaattcggtctgggaggcagctctatgagtacccacctgaggctgttggtgatgttcatcatgagcgccggaaccgctatagcgagctacttcatacccagcactgttggagtggtcctgtttatgacaggattcggttttttgttatccctgaacctgagcgatatggggcacaaaattggtacgaagtcaaaggaccttccgtctggacctgaaaagcacttctcctggaaggagtgcttgttctacataattattctggtgttggcattgctggaaacctcgctcctacaccacttcgcgggcttttcccagattagcaagtccaactctcaagctattgtgggctacgggctgatgattctgctcatcatactctggatacttagggagattcagtccgtctacatcatcggaatcttccgcaatccattctatcccaaggatgttcagactgtcacggtcttcttcgagaaacagaccaggttaatgaaaattgggatcgtacggagaatcctgctgactctcgtgagcccatttgcaatgattgcattcctttctctggactcatctctccaaggcttgcacagcgtgagtgtatgcatcggttttacacgtgcttttagaatggtatggcagaatactgaaaacgcactccttgagaccgtaatcgtgtccactgtccatctcatttcgtctacagatatctggtggaataggtccctcgacactggattaagacttctcctcgtaggaatcattcgggacaggctcattcagttcatttccaagctccagttcgcagtgacagtccttctgacctcctggacggagaaaaagcagagaagaaaaacaacagctacactgtgcatccttaacattgtgtttagcccattcgtgttagtgattattgtgtttagcacccttttgagttcccctctcctcccattatttacactccctgtcttccttgtcgggttcccaaggcccatccagtcttggcctggcgcagccggtacaacggcctgtgtgtgtgcggataccgtctactactatcagatggtcccccggctgactgctgtactccaaaccgcgatggctgctggttctctcggactgctgctccctggatcgcactatctgggccggttccaggatcgcctcatgtggatcatgattcttgaatgtgggtatacatattgctccattaatatcaaaggactggagttacaagagacaagctgccatacagccgaagctagacgggtcgacgaagtttttgaagatgcctttgagcaagagtacacacgtgtctgcagtcttaatgaacacttcggtaatgttttgacaccttgcaccgtgttaccagtgaagctctactcagatgcccgaaatgtgctaagtggaattattgacagtcacgagaatctgaaggaattcaagggggacctcataaaagtgttggtttggatcctagtgcagtattgttcaaaacgccctggtatgaaggagaacgtccataacactgagaataagggcaaggcacctctcatgttacctgcactgaacactctgcctcctcctaagtcgcctgaggacatcgacagccttaattccgagacttttaacgactggtccgacgacaatatatttgatgacgaacccacgattaagaaggtgatcgaagagaagcatcagcttaaggatctccctgggactaacctgttcattcccggtagcgtcgagagccagcgggtgggagatcactcgacgggaaccgtacctgagaacgacctctataaagctgtgctgctgggataccctgctgtggacaagggcaaacaggaagacatgccttatattccccttatggaattttcgtgctcacattctcacttggtgtgtcttccagcagaatggaggacctcctgcatgccatccagcaaaatgaaggagatgtcaagtctgttccccgaggattggtaccagtttgtgctgaggcagcttgagtgctatcactccgaggagaaggccagtaacgtcctggaggagatcgccaaagataaagtgctgaaggacttttatgtccacacggtgatgacgtgttacttctctctctttggtatcgacaacatggccccctctccaggccatatactccgggtgtacggcggcgtgctcccatggtcagtcgcccttgactggctgaccgaaaaacccgaactcttccagctggctctcaaggccttcagatataccttgaaattgatgatcgacaaagccagtctcggccctatagaggactttagggaactgataaagtatctagaggaatatgaaagagactggtatataggactcgtctctgacgaaaagtggaaagaggctatactccaagaaaagccctatctcttcagtctcggttatgatagcaacatgggtatatacactggtagggtcttgtcgctacaggaactgctgattcaggttggaaagctcaacccggaagcagtgcgcggccagtgggccaatctgtcctgggagttattgtatgccactaatgatgacgaggaacgttactctattcaagctcatcccctgctgctacgcaacctgacagtgcaggcagcagagcctcctctcggatacccaatctacagctctaagcccctgcatattcacctctattag

SEQ ID NO: 25142 - DNA, 3519 bp, Artificial Sequence
  Description of Artificial Sequence: Synthetic coding sequence
atgtcccccgacgtacctctgctcaatgattataaacaggactttttccttaagcgttttccccagacagtattggggggacctcgattcaagcttggctattgcgctcccccctacatctatgttaatcagatcatcctgtttttgatgccttgggtatggggaggtgtgggaacccttctataccagcttggcatactgaaggattattacaccgcggccctcagcggggggctgatgctgttcaccgcatttgtgattcagttcacttccctgtacgctaagaataagtctaccaccgtggagaggatcctcaccacagatatcttggccgaagaagacgagcacgaatttacctcgtgcactggagctgagaccgtcaagttcctgatcccaggcaaaaaatatgtggccaatactgtttttcacagtattctggctggactcgcatgtggcctgggcacatggtacctgctgcccaaccgcattaccctgttatacgggtccacaggaggcaccgcccttctgttcttcttcggctggatgactttatgcattgctgaatattccctcattgttaataccgcaactgagaccgctacattccagactcaggatacatatgagatcattccactcatgcgtcccctgtatatcttctttttcgtttcagtggatctcgcacatcgctttgtagtcaatatgcctgctctcgagcacatgaatcagatactacatatcctgtttgtattcctcccttttttatgggcccttggtacattaccgccacccgacgctttacttctatgggctatggagcaggtgctggagttcggcctgggagggagctcaatgagcacccatctgaggctgctggtgatgttcattatgtctgctggtacagctattgcttcctatttcataccgagcacagtgggcgtcgtactgtttatgacagggttcgggttccttttgtctctcaacctgagcgacatgggacacaaaattggaaccaagtctaaggatctgccaagcggccccgagaaacacttttcctggaaggagtgtctgttctacatcatcatactagtcctggccttattggaaacaagtctccttcaccacttcgctgggtttagccagatctcaaaatcaaattctcaagctattgtcggctacggactgatgatactcttgatcatcctgtggatattacgtgaaattcagagcgtgtacatcataggcatattcaggaatcctttctatccaaaggatgtgcagaccgtgaccgtgttttttgaaaagcagacaaggttgatgaagatcggtatagtacgacggatcctcttgacgctggtctctcctttcgcaatgatcgcctttctgtctctggatagtagtcttcagggtctacacagcgtgtccgtctgtatcggcttcacccgagcttttcgtatggtatggcaaaacaccgaaaatgctcttctcgaaacggtgatcgtatccacggtgcatctgatttcctccactgacatttggtggaatagatccctcgatactgggctgcggctgctgctggtcggcataattcgtgatcgactaatccagttcatcagcaagctgcagttcgctgtcacagtgttgttgacctcatggacggaaaaaaagcaacggcgaaaaacaaccgccacgctgtgtatcttgaatatcgtgttctcaccttttgtcctcgtgataatcgtgttctctacattgctaagctccccactgctgcctttattcacgctgcctgtatttctggtgggtttcccacgacccatacagagctggcctggtgccgccgggacaacagcttgcgtctgcgccgacacggtttattactaccagatggtaccacgccttactgctgtccttcaaaccgcaatggccgccggaagtctgggcttacttctgccagggtctcattacttaggacgctttcaggacagattaatgtggatcatgatactggagtgcggctacacctactgttccatcaacatcaaagggctggaactccaggaaacctcttgccacacagctgaagcccgcagagtggatgaggtttttgaagacgcttttgaacaggagtacacacgggtgtgttcccttaatgaacattttggtaatgtcctcaccccctgtactgtgttgcctgtgaaactgtactccgacgcaagaaatgtgctctctgggatcattgacagtcacgagaatctgaaagagttcaagggggatctgattaaagtcttggtctggatcctggtgcaatactgcagtaaaaggcccgggatgaaagaaaacgttcacaacacagagaataagggcaaggctcccttgatgctcccagctctgaatactctcccacccccgaagtcacccgaagatattgactctcttaacagcgaaaccttcaacgattggtccgatgacaatatcttcgatgacgaaccaaccattaaaaaggtaatagaggaaaaacatcaactgaaagacctccctggcacaaacctgtttatcccaggctccgtggaatcgcagcgcgttggggaccactcaacaggaacagttcccgaaaatgacctgtacaaggcggtgctcttgggctatcctgctgtggacaagggaaaacaagaggacatgccgtatatcccattgatggagttctcttgcagccacagccatctggtgtgcctgccagcagaatggcgcactagctgcatgccaagttcaaaaatgaaggaaatgagcagtttgttccccgaggattggtatcagttcgtgttgagacaactggagtgctatcatagcgaggagaaagccagtaacgtgctcgaggagatagctaaagacaaggttttaaaagacttctacgtgcacacggtcatgacatgctacttctctctgtttgggatcgataacatggccccatcacccggccacatcctcagggtttacggcggggtcctgccatggagtgtggctcttgactggctaactgagaaacccgaattgtttcagcttgccttgaaggcctttcgctatactcttaagctgatgatcgacaaagcatcactgggccccattgaggatttccgggagctcatcaaatacctagaggagtatgagcgtgattggtatattggcttagtgtccgatgagaagtggaaagaggcaatactgcaggagaagccgtacctcttctccctcgggtatgattccaacatgggaatctacaccgggagagtcctgtcgctgcaagaactcctgattcaagttgggaaactgaaccctgaagctgttcgcggtcagtgggccaatctgtcctgggagctgctctacgccaccaatgacgacgaggagaggtattctatccaagctcatcctctgcttcttagaaacctgaccgtccaagcggcagagccccctttaggatacccaatttatagttccaaaccccttcacatccacctatattag

SEQ ID NO: 25143 - DNA, 3519 bp, Artificial Sequence
  Description of Artificial Sequence: Synthetic coding sequence
atgagccctgacgtaccactgttgaatgattacaagcaggacttcttcctcaaacgcttcccacagacagtcctcggcgggcccaggttcaagctgggatactgtgcgcctccttacatttatgtcaaccaaataatactgttccttatgccttgggtgtggggaggagtggggactcttctttatcaattggggatccttaaggattactataccgcggctctctcgggcgggctgatgctcttcacagcattcgtgatccagtttacttccctgtatgctaaaaataaatcgacgacagtagaaaggattctaactaccgatatcttggcggaagaagacgaacacgaatttacgtcgtgcacaggggctgagacagtgaaattcctaattcccggcaaaaagtacgtagccaacacagtctttcattctatcctggcaggtctggcatgtggcttgggcacctggtatctattgcccaatcggattacactgttgtatgggagcactggcggcacagccctgctattcttcttcggatggatgaccctgtgcattgctgagtactcgttgatcgtaaacaccgccactgaaactgctactttccaaacccaggatacatatgaaatcatccctctaatgagaccgttatacatcttctttttcgtctctgtggacctagcacaccgatttgtagtgaatatgcccgctctggagcacatgaatcaaatcctccacatcctgtttgttttcctcccattcctttgggcattgggcacactgccccctcccgacgctctgcttttgtgggctatggagcaagtgctggagtttggacttgggggatcctcaatgagtacccatcttcgcctgctcgttatgttcatcatgtctgctggaactgcaatagccagctactttattccctccacggtgggtgtggttcttttcatgactgggttcggctttctgctgagcctgaaccttagtgatatgggtcacaagattggaacaaagagtaaagacctcccaagcggtccagaaaagcatttctcatggaaggagtgcctgttctatattatcatcctggttttggcactactggagactagtctacttcaccatttcgcagggttttcccagatctccaagagcaattcacaggcaatcgtgggatacggcctaatgatactgctcattatcctctggatcctccgtgagatccagtctgtttacatcatcggcatttttaggaaccccttttatcctaaggacgtgcagacggtaactgtgtttttcgaaaagcagacaaggttgatgaagatcggcattgttcgtcgcattctcttgaccctcgtgtccccgtttgcaatgatcgcattcctgtctctggactcgtcattgcagggattgcactccgtgagcgtctgcatagggttcacccgagcttttcggatggtgtggcagaatactgagaatgccctgctggaaaccgtgatagtgagtacagttcatctgatctcaagtacggacatttggtggaatcgctccctggataccggcctgagactgctgctggttggcataatcagagacagactgattcagttcatctccaagctccagttcgcagttacagttctattgaccagttggacagagaaaaaacagagaagaaagactacagcgacactttgtattctgaatatcgtgttttctcccttcgtcttagtcatcatcgtgttctcaacattgctcagttcacccctcctgcctttatttactctgccagtattcctcgtcgggttccccagacctattcagagctggcctggcgctgccggcaccaccgcatgtgtgtgcgcggatactgtgtattattaccaaatggtgcccaggcttacagctgtgctccagaccgctatggccgcggggtctttgggactactgctccctggctctcactacctgggcagattccaggacagactgatgtggatcatgatcctcgagtgtggctacacttattgttctatcaacatcaagggacttgaactccaagagacttcttgtcacaccgctgaggcacggagagtggatgaagtgttcgaggatgctttcgagcaagagtacacaagagtgtgttccttgaacgaacactttggtaacgttctgaccccttgtacagtgctgcccgtgaagttgtattcggatgctcgcaacgtgctctctggcattattgactcacacgaaaacctgaaggaatttaaaggcgaccttattaaggtgctggtttggatcttggtgcagtactgtagcaaaagaccaggcatgaaagagaacgtccacaacacagagaacaaaggcaaggctcccctgatgctgcctgcattgaataccttgcctccgccaaagtcccccgaagacatagatagcctcaatagcgagacttttaatgattggagtgacgataatattttcgatgatgaacctacaatcaagaaagtaattgaggagaagcaccagttgaaggacttgcccggcactaatctatttatccccggatcagtggagtcacagagagtaggtgaccatagtacagggaccgtcccggagaatgatttatataaagctgtgctgctcgggtatcctgcggtggacaaaggtaagcaggaagacatgccatatattcccctgatggagttcagctgctcgcattcccacctggtgtgtctgcctgctgaatggaggacgagctgcatgcctagttccaaaatgaaagagatgtcctctctttttcccgaagactggtaccagttcgtcctgcggcaactggaatgttaccacagtgaagagaaggcttcgaatgtgctggaggagatcgccaaagacaaggtgcttaaggatttttatgtccacactgttatgacctgctacttcagtttgttcggcatcgacaacatggccccatcccctgggcatatcttgagagtgtatgggggtgttcttccatggtctgtcgccctggactggctgaccgagaagccagaactcttccaacttgccctaaaagcctttcgatacacccttaagctaatgatagacaaggcctcattggggccaatcgaggactttcgggaactgattaaatacctggaggagtacgagcgggattggtacatcggcctcgtgagcgatgaaaagtggaaggaggccattctgcaagaaaagccttacctattctctctgggctatgatagcaatatgggcatttacacaggacgagttctctctctgcaggagttgctgattcaagtaggtaagttgaacccggaagctgtgcgggggcagtgggccaatttatcctgggaactcctgtacgccacgaacgacgatgaggagcggtacagtattcaagcacatcccctgcttttacgaaatttaacagtgcaagccgccgagcctcccctcggataccctatttacagctccaagcccttgcatattcacctgtattag

SEQ ID NO: 25144 - DNA, 897 bp, Artificial Sequence
  Description of Artificial Sequence: Synthetic coding sequence
atgctgcccgccctaaatactttaccgccacccaaatctccggaagacatcgattccctgaattcggaaaccttcaatgactggtccgatgataacatttttgacgacgagccgaccatcaaaaaggttatcgaggagaagcatcaactgaaggatctgcctggcaccaatctgtttatcccggggtccgtggaatcccagagagtcggcgaccactccactggaacagtgccagagaacgatttatacaaggccgttttgctaggttaccccgccgtggataaaggcaagcaagaagacatgccgtacatccccctgatggagttttcctgctcacattcccatctcgtctgcctgcctgcagagtggagaacatcttgcatgcctagttcaaagatgaaagagatgtcctccttgttcccagaagattggtaccagttcgttcttagacagttggagtgctaccattctgaggagaaggcttctaacgtgcttgaagagatagcgaaggacaaagtgctgaaagatttttatgtacacacagtcatgacatgctacttctctttattcggtattgataatatggccccatctcctgggcacatcctgcgggtgtacggtggtgtgctgccgtggagtgtcgcgctggactggttgacggaaaaacccgagttgttccaactggcactgaaagcatttcggtacaccctaaaactcatgattgataaggccagcctaggcccaattgaagattttagggagctaatcaagtatttggaagaatacgaacgcgattggtatatcgggctcgtgtccgatgaaaaatggaaggaggctatcctgcaggagaagccctatctgttctcactcggctacgattccaatatgtacctgtag

SEQ ID NO: 25145 - DNA, 1584 bp, Artificial Sequence
  Description of Artificial Sequence: Synthetic coding sequence
ctgtgtatccttaacatcgtgttttctcccttcgtcctcgtaattatcgttttctctactctccttagttcccctctactgcccctgttcactctcccagtcttcctggtggggtttccacggcctatacagtcctggcctggagctgctggaacgactgcctgcgtctgcgccgacacagtctactattaccagatggtaccccgtctgactgccgttctccaaacagctatggcggccggcagtcttggcctcttattgccagggtctcactacttggggcggttccaagatcggctaatgtggatcatgatactggagtgcggttatacttattgttcgattaacattaaaggcctggaactgcaggagaccagctgtcataccgccgaagcccggcgggtcgatgaagtattcgaggacgcatttgagcaggagtatactcgagtttgtagcctaaatgaacatttcggcaatgtgcttacaccctgcactgtacttcctgtcaagttatatagcgacgcccggaacgtgttaagcgggattatcgattcccatgagaatttgaaggagttcaagggcgacctgataaaggtcctggtgtggattcttgtgcaatattgttccaaaaggcccggcatgaaagagaacgtacacaacaccgaaaacaaggggaaggcgcccctgatgctgccagccctgaataccttgcctccaccaaaatctcccgaggacatcgactcactgaacagtgagacattcaacgattggtccgacgataatatttttgatgatgagcccacaattaaaaaggtcattgaagagaagcatcagctgaaggatctgccaggtactaatctgttcattcccggatcggtagagtcccaacgcgtgggagatcatagcacaggaacggtgcccgagaatgatctgtataaggcggttctattgggctaccccgcagtcgacaagggaaagcaggaggacatgccctacatccccctcatggagtttagttgcagtcattctcacctggtgtgcctgcctgccgagtggaggacctcctgtatgccgtccagcaagatgaaagagatgtcgtccttgtttcccgaagactggtaccaattcgtgctgagacagctggagtgttatcactccgaggagaaagccagtaacgtgctggaagagatcgctaaagacaaggtgttaaaggatttctacgttcacactgtcatgacatgttacttctccctgtttggcatcgacaatatggcacctagccccggacatatactgagggtgtatggaggagtgctgccttggtcggtggctctggattggctgacagagaaacctgagctctttcagttggccctgaaggcgtttcgttacactctcaagctcatgatcgacaaggcgtcgctaggccccatcgaagacttccgggaactaattaaatatctggaggaatacgaacgggattggtatattggcctggtgagcgacgagaagtggaaggaggccattctgcaggaaaagccctacttattcagcctgggttacgattctaatatgtatctctag

SEQ ID NO: 25146 - DNA, 1866 bp, Artificial Sequence
  Description of Artificial Sequence: Synthetic coding sequence
atgcctttcacactgcacctgcggtcgaggctgccctccgccattagaagtctgattctgcagaagaaacccaacatcaggaacacgagctcaatggcaggcgagctacggccagccagcctggtagtcctgcctcgctccttggcccccgcctttgagcgcttttgccaagtgaataccggacccttgccccttcttgggcaaagcgagcctgagaaatggatgctgccaccgcagggagcaatcagcgaaactcggatgggtcatccacaattctggaaatacgaattcggagcctgcaccgggagcctggcctctttggagcagtacagcgaacagctcaaagatatggttgccttcttcctgggatgtagtttctccctcgaggaggcgctggaaaaggcgggtctgcctagacgggaccccgccggtcactcccaagcaggcgcatacaagacgacagtgccctgcgttacccatgccggattttgttgccccctggtggtcaccatgagacccattcccaaagataaactggaaggtctggtgagggcttgctgcagcttagggggcgagcagggacaaccagtgcacatgggtgaccctgaactcttgggaataaaagagctgtctaagccagcatatggagatgctatggtctgcccgccaggggaagttcctgtcttttggccatctccactgacgtccttgggtgccgtcagttcatgcgaaacacccctggcctttgcgtccatccccggatgtacagtcatgacagacctgaaggacgcaaaggcccctcctggctgcctgactcctgaacggatcccagaagtgcaccatattagtcaggacccgctacactactcaattgctagtgtgtctgctagtcagaagattcgggagctagagtctatgattgggatagacccaggaaatagagggataggtcacctattatgcaaggatgagcttctgaaggctagcctctctttgtcacacgctagatccgtgctaattaccacaggctttcctactcattttaaccacgagcccccggaggagaccgatggtcccccaggggcagttgccttggtggcgttcttacaggcgctagagaaggaggtagccattatcgtcgaccagcgggcgtggaacttgcaccagaagatcgtggaagacgcagttgaacagggtgtcctaaagacgcagattcccatactgacctatcaaggcggctctgtggaggccgctcaggcatttctgtgtaagaatggggaccctcagacaccacgcttcgaccatctggttgctattgagcgagcgggtcgggccgctgatggcaactactacaatgccaggaaaatgaatattaaacatctcgtcgatcccatagatgatctatttctggctgccaaaaagataccaggcatttcatctacaggggtaggggacggaggcaacgagctgggaatgggtaaagtgaaggaagcagttcgccgccatatccgtcacggcgacgtgatcgcatgcgatgttgaggcagatttcgccgtcatagccggagtctccaattgggggggttacgcattagcctgcgcactatacattctctattcttgcgccgtgcacagccagtatctgcgcaaagctgtgggcccttcaagagcccccggtgatcaggcttggactcaagcgctgccttccgtgatcaaggaagagaagatgctcggcattctggtgcagcacaaggtccgctccggagtctcaggcatagtggggatggaggttgatggcctgccattccacaacactcatgcagaaatgatccagaaacttgtagatgtgacaacggcccaggtgtag

SEQ ID NO: 25147 - DNA, 480 bp, Artificial Sequence
  Description of Artificial Sequence: Synthetic coding sequence
atgccgttcacactgcaccttaggtcaaggctgccatccgccattcggagtctgatccttcagaaaaaacctaatattaggaacacatcatcaatggccggcgaattacgccccgcttctttggtagtgctccccagatccttggcacccgctttcgaacgcttttgccaagtcaacaccggaccattgcctctgctcgggcagagtgaaccagagaaatggatgttgccaccccagggggcaatttctgaaacatctcttagagatcttcactcagcctggcaccgtactagtctgatgaccgtggcccaggagagggccgcacttcctactgtacttaccccatctcctatcacatggagactgtcctggctccgatcactacgttcgtggagaaaaagcagccccggggaaatccccctcgctctcccatcagtacactcaattgcacaggcgcgcaatccaccagtacaggattag

SEQ ID NO: 25148 - DNA, 1866 bp, Artificial Sequence
  Description of Artificial Sequence: Synthetic coding sequence
atgcctttcaccctacacctccgcagtcggcttcccagcgccattagaagtcttattctgcagaagaagcctaacatccgtaacactagttcaatggccggcgagctccggcccgcttctctagttgtgttacctcgaagtctggctcctgcattcgagagattctgccaggtgaatactgggcccctacccctccttggccagtccgaacccgaaaagtggatgctgcccccccaaggggcaatatccgaaaccaggatgggacatccacagttctggaagtatgaattcggtgcctgcaccggaagtctggcaagtttagagcagtatagcgaacagctcaaagatatggtcgccttttttctaggctgctctttctcactcgaggaagccttggagaaggcaggcctgcccaggcgagacccagctgggcactctcaggccggcgcctacaaaaccacggtaccgtgcgtcacgcacgccggcttttgctgcccgctcgtcgtaacaatgaggcccatcccaaaggataagcttgagggtttggttagggcctgttgcagcttgggaggtgaacagggccaacccgtgcatatgggcgacccagagctgctcgggataaaagagttgtccaagcccgcctacggcgacgcaatggtttgccccccaggggaggtacctgtgttttggccatccccactgacatcgttgggggctgtgagttcctgtgagacacccctggcattcgccagcattcccggatgtaccgttatgacagatctgaaagatgctaaggctcctccaggctgtctgacgccggagcgtataccagaggttcaccacataagccaggacccactccactattcaatcgcttcagtaagtgcttcacagaagatccgggaactggagtcaatgattggcatagaccctggaaatcggggtatcggacacctgctgtgtaaggacgagctgctgaaggcatcactcagcctcagccacgctcggagcgttctcatcactaccgggtttccgactcacttcaaccatgagccaccagaggagacagacggtcccccaggggctgtggctttagtggctttcctgcaagcccttgagaaggaggtagccattatagtggaccagagggcttggaatctgcaccaaaagatcgtagaggacgccgtggagcagggagttctgaagacccagatccccatcctgacttatcaggggggctccgtggaggccgcacaggccttcctttgcaaaaacggcgatccacagacgccccgattcgatcacctcgttgcaattgagagggcaggccgtgcagccgacggcaactattacaatgcgcgaaagatgaacatcaaacacctggtcgatcccatagacgacctattcctggccgctaagaaaattcctggtatcagcagcacaggcgtgggcgacggcggcaacgagctgggaatgggtaaagtcaaggaggccgtccggaggcacattagacacggcgacgtgatagcttgtgatgttgaggccgattttgcagtgatcgctggcgtgtctaattggggggggtatgcccttgcctgtgcactgtatattctttacagctgcgctgtgcactctcagtacctgcgcaaggcagtgggtccatctcgtgcaccaggtgatcaagcctggacccaagctctgcctagcgtgatcaaagaagagaaaatgctgggaatactcgtgcaacataaggttagatctggtgtgagtggaatcgtaggcatggaggtggacggcctgccgtttcataacacccacgcggaaatgatccaaaagctcgtggatgtgacaaccgctcaggtatag

SEQ ID NO: 25149 - DNA, 1851 bp, Artificial Sequence
  Description of Artificial Sequence: Synthetic coding sequence
atgccctttaccttacatctgaggtcgcgattgcctagtgcgatccggagcttgatcttacaaaagaagcctaacatccggaacacctctagcatggccggtgagctgcgtccagcctctctggtggtgctgccacgctccttggccccggcttttgagcgcttttgtcaagtcaacacaggacccctgccattactggggcagagcgagcctgagaagtggatgctgccgccgcagggtgcaatcagcgagacgaggatgggccacccccagttctggaagtacgaattcggcgcctgcacaggctcattggcttctctggaacagtatagtgagcagctgaaggacatggttgcctttttcctgggatgtagcttctctctggaagaggctctggagaaggccggccttccaagacgggatccagccggtcattcacaaacgaccgttccgtgtgtgacgcacgcagggttttgttgtcccctggtggtaaccatgcggcccatccccaaagacaaactggagggcctcgtgagggcctgctgcagccttggcggtgaacaaggccagcccgtgcacatgggagacccagagctgctaggaatcaaggagctgtcaaagcctgcctatggcgacgctatggtctgtcccccaggggaggtgccagtgttttggccaagccccctgacgtccctaggtgccgtgtcctcttgcgaaaccccgcttgccttcgcctcgattccaggttgtaccgtcatgacagatctaaaggacgcaaaagcgccgccaggttgcctgacgcctgaaagaatccctgaagttcaccatatctcgcaagacccattgcactattcaatcgcttcagtatcagcctcccagaagatcagagaactcgaatctatgataggcattgatcctggcaaccgggggatcggtcatttgctctgtaaagatgagctcctgaaggcatcacttagcctctcccacgccaggtcagttctgattaccactgggttcccaactcacttcaatcatgagcctccggaggagaccgacggcccacccggagcagtggcgctagttgcattccttcaagccctggaaaaagaagtggcaatcatcgtggaccagcgcgcgtggaatctgcatcaaaagattgtggaagacgctgtcgagcagggcgtcctgaaaactcagatccctatcttgacctatcagggcgggagtgtcgaagcagcccaggcgttcctttgcaagaacggagacccacagaccccacgctttgaccacctcgtcgccatcgagcgggccggaagagccgctgacgggaattactataatgcacggaagatgaatatcaagcacctcgtagatccaatcgacgacctcttcttggctgctaagaagatacctggcatttcatccaccggcgtgggagacgggggcaatgaactgggtatgggcaaagtcaaggaggctgtacgaaggcatattcgacacggggatgtgattgcgtgcgacgtagaggcagatttcgccgttatcgcaggggtgtcaaactggggcgggtatgccctggcttgcgcactgtacatactgtacagctgtgccgtgcattcacagtatttgagaaaggcagtgggcccgagtcgcgcaccaggggatcaggcttggacccaggcattgccttccgttatcaaggaggagaagatgctcggcattctcgtgcaacacaaggtgcgatcaggtgtatcagggatagtcggaatggaagtggatggcctgcccttccacaatacccacgctgaaatgatacagaagctggtggacgttaccaccgcgcaggtctag

SEQ ID NO: 25150 - DNA, 198 bp, Artificial Sequence
  Description of Artificial Sequence: Synthetic coding sequence
atgccctttaccctccacttaaggtcaagactgccctccgctatcaggtccttaattttacaaaagaaaccaaacatacgcaatacaagtagtatggcaggcgagctgcgcccggcttccctggtagtcctgccccgttctttagccccagcgtttgagaggttttgccaggtcaatacagggccattacctctatag

SEQ ID NO: 25151 - DNA, 1296 bp, Artificial Sequence
  Description of Artificial Sequence: Synthetic coding sequence
atgcctttcactctgcacttgagatccagacttccctccgctattcggtcccttatcttgcagaagaagcctaatatccggaacacttcatcgatggcaggggagcttcgtcctgccagcttggtggttttaccccggtcactagctcctgccttcgagaggttttgtcaggtaaatacaggccccctgccacttttgggccagtccgagcccgaaaagtggatgcttcccccccagggagccatttctgagacacggatgggacacccccagttctggaaatacgagtttggggcctgcactggtagcctggcatctctggagcagtactccgagcaattgaaagacatggtcgcttttttcctaggctgcagcttctccttagaagaggccttggagaaggctggcctccctaggagggatcctgcggggcacagtcaggctggggcctataagacgacagtgccctgcgtgacacacgcaggtttctgttgtcccctggtcgtgacaatgcgacccataccaaaggataaattagagggtctggtccgagcctgctgctcgctgggtggcgaacaaggccaaccagttcatatgggtgaccccgaactgctcggaatcaaagagctgagcaagcctgcgtatggagacgccatggtgtgtcccccgggtgaggttcccgttttttggccctcgccacttactagtctaggcgccgtgagctcgtgtgagacccccctggccttcgcaagtattccaggatgcaccgtgatgacggacctgaaagacgcaaaagcgcctcccggctgtctgacccccgagagaataccagaggtgcatcatataagccaggaccccctgcattattctattgcttcagtcagtgcctcacagaagattcgcgagcttgaaagcatgatcggcatagatccgggcaaccggggcattgggcacctcttgtgcaaagacgagttgctgaaagcttctctgtccttgtctcacgcccgcagtgtgctcatcaccacgggatttcccacacattttaatcatgaaccccccgaagagaccgacggacccccaggggcagtagcattggtggctttcttgcaagccctggagaaagaagtggccataattgtggatcagcgggcatggaatctgcaccagaaaattgtggaagacgcagtcgagcagggtgtgctgaagacccagattcccattttgacataccagggtggcagcgtggaggctgcacaggcttttctttgcaaaaacggagacccccagactccctag

SEQ ID NO: 25152 - DNA, 480 bp, Artificial Sequence
  Description of Artificial Sequence: Synthetic coding sequence
atgccattcaccctacaccttcgttcacgcctgccgagcgcaatcaggtctctgattctgcagaagaagcccaatattcgtaacacctcctcaatggccggagagctcaggcctgcctcgttggtggttctgccccgttcactagcaccagcttttgagagattttgccaggtcaacaccggtcccctccctttactcgggcagagcgaacctgagaaatggatgctgcccccacagggggctatcagcgaaacatctctgcgcgacctgcacagcgcctggcaccgaactagcctcatgaccgtggcccaggaacgggcagcccttccaacagtcttaacaccatctcccatcacctggagactgtcctggcttcgttccctccggagttggcgaaagagtagtccaggagaaatcccactcgccttgccttctgtccactcaatcgcccaggcacggaacccacctgtgcaagactag

SEQ ID NO: 25153 - DNA, 1866 bp, Artificial Sequence
  Description of Artificial Sequence: Synthetic coding sequence
atgcccttcacactgcatctgcgaagcaggttaccatcagcaatccgcagtttgatattgcaaaaaaaaccaaacatccgtaacacatcttcaatggcaggagaactgcggcccgcctctctcgtggttctaccacgcagtctggcaccagcatttgagcggttttgccaggtcaacactggaccactccctttacttggtcagtctgaacctgagaagtggatgctgccaccccagggtgcgatttccgagaccagaatggggcatccacagttctggaaatatgaattcggtgcttgcaccggaagcctggcatcccttgagcagtacagcgaacagttgaaagatatggttgccttctttctagggtgtagcttttcactagaagaggctcttgagaaagccgggctgcctagacgagacccagctggtcactcccaggcaggggcttacaagactactgtgccatgcgtaacccacgcaggcttctgttgcccactcgtggtgaccatgcgaccgattcctaaagataagctggaaggcctggtgcgcgcttgctgttccttgggaggtgaacagggccagccagtccatatgggtgatcctgagctgttagggattaaagagctcagcaaacctgcttacggagacgcaatggtctgcccccctggcgaagtgcctgtgttttggccttcccccctcaccagtctgggagccgtgtcatcttgcgagacacctctcgccttcgccagcatcccgggttgcaccgtgatgacagacctcaaagacgctaaagctccaccaggctgtctcacacctgaacgcatcccggaggtccatcatatctcccaggatccgctgcattacagtattgcaagtgtgtctgcctcgcagaaaatacgcgaactcgagagtatgataggtatcgatcccgggaatcgtgggattggtcatctgctgtgcaaagacgagctcctgaaggccagcttatcgctgtctcacgctcggagcgtccttattactactggcttccctacccacttcaatcatgagccccctgaggagacagacggcccacccggtgcagtcgcgcttgtcgcgttcctccaggccttggagaaggaggtggctatcattgtagaccagcgggcgtggaatttgcatcaaaaaattgtggaagatgctgtggaacagggtgtgttgaagacacagattccaattctgacataccaaggcggcagcgtggaggccgcccaggcattcctatgcaagaatggggaccctcagacaccccgctttgatcacttggtagcgatagaacgggctgggcgggccgccgatgggaactactacaatgccaggaaaatgaacattaaacaccttgttgatcccattgacgaccttttcctcgcagccaagaagatacccggtatctcatctacgggcgtgggggacggagggaacgaactgggcatgggcaaggtcaaagaggccgtacggaggcacattcgccacggcgacgtgatcgcgtgcgacgtagaggccgattttgcagtaatcgctggggtttccaattggggaggctacgcactggcttgcgcgctgtacatcttatattcatgtgcggtccattctcaatatctacgtaaagccgtgggaccttcccgggcaccaggtgaccaggcctggacccaggccttgccttccgtgatcaaagaggagaaaatgctcggaatcttggtgcagcataaagttcggtccggggtgtctggaatcgtgggcatggaggttgatgggctgcctttccacaacacccatgcagagatgattcaaaaacttgtcgacgtaaccactgcgcaggtttag

SEQ ID NO: 25154 - DNA, 330 bp, Artificial Sequence
  Description of Artificial Sequence: Synthetic coding sequence
atgccttttactttgcatctgcggagccgcctgccgtctgccatacgtagtcttattctccagaaaaagcccaatatacgcaacacctcgtcaatggctggcgagctgagaccagcatcactagttgtcttaccccggtccctggctcccgcctttgaaaggttctgtcaggtaaatacgggtccccttcctctactgggacagtccgagccggaaaaatggatgttgccaccccagggcgctatatccgagactcgcatgggtcacccacaattctggaagtatgagtttggggcttgcactgggtcactggccagcctggagcaatag

SEQ ID NO: 25155 - DNA, 606 bp, Artificial Sequence
  Description of Artificial Sequence: Synthetic coding sequence
atgcccttcacccttcatttaagaagccgcttgccgagcgccatccggtcattgatcctgcagaaaaaacccaatatccgaaacacttcatctatggcaggtgagttgagacccgcaagcctggtggtgctgccaaggtcactggcaccagcctttgagcgattttgtcaagtgaatacaggtcctcttcccctgctgggccagtccgagcccgagaaatggatgctccccccccagggcgcaatttcggaaactcgtatgggacacccccaattttggaagtacgaatttggggcatgcaccgggtccctcgcctccttagagcagtacagtgaacagctgaaggacatggtggcattttttctgggatgctcattttcccttgaagaggcgctggagaaggcaggtctgcctagacgtgacccagcgggtcatagtcaggccggggcctataaaaccacggtgccctgtgtgacccacgccgggttctgttgccccctggtggtcacaatgaggcccataccaaaagacaagctggaaggcctggtcagagcctgctgctcactcgggggcgagcagggccaaccggtccatatgggggactag

SEQ ID NO: 25156 - DNA, 1695 bp, Artificial Sequence
  Description of Artificial Sequence: Synthetic coding sequence
atgccttttacgctgcacttgcggtcccggctgccgtctgcaatccgttcacttatcctccagaagaaacctaatatcagaaacacttcctcaatggcaggcgagcttcgccccgcttcattggtcgtcctcccacgctctctcgcccctgccttcgagcggttttgtcaggtgaataccgggcctctccccctgcttggccagtcagagccagagaagtggatgttacctccacagggggccattagcgagacccgaatggggcacccccagttttggaagtacgagttcggcgcttgcaccggaagcctcgctagcctggagcagtattccgaacagttgaaggatatggttgccttttttctgggatgttcattttccctggaagaagccctggaaaaggctgggctacctagacgagaccctgccgggcacagccaaacaactgtcccctgcgttactcacgccggcttttgctgcccattggtggttacaatgcggcccatccctaaggacaagctggaaggactggttagagcctgctgttcccttggtgaactgctcggcatcaaggagctgagcaaaccggcctacggtgacgcgatggtctgtccaccaggcgaggtgccagtgttctggcccagtccccttactagtctcggtgccgtgtcaagctgcgagacgccactcgcctttgcatctatccccggttgcacggtgatgaccgatctgaaggacgccaaagcaccaccggggtgtctgacacccgagagaatcccggaggtccatcacattagtcaagatccgctccactatagtatcgcctcagtgtctgccagtcagaagattcgcgaactagaatccatgatagggatcgaccctgggaatcgcgggatcggccatttgctctgtaaggacgagttactgaaagcctccctgagtctgtctcacgcgcgatccgtcttgattactacgggtttccccacgcacttcaatcacgagcctccagaggagaccgatggaccgccaggggccgtggcgctcgtggccttcctccaggcgctcgagaaggaggtggccatcatcgtggatcaacgagcctggaacctgcatcaaaagatcgtggaagacgcagtggagcaaggcgttctgaagacccagattcccatcctgacgtatcaaggggggtccgttgaggccgcccaggcgtttctctgtaaaaatggggacccacagaccccgaggttcgatcacctagtggctatagagcgcgccggacgtgcagctgacgggaactactacaatgctcggaagatgaacataaaacacctggttgatccaattgacgatctctttctcgctgcaaaaaagatccccgggatcagctctaccggagtctccaattggggtggctatgccctggcatgtgctctgtatatactgtatagttgtgctgtgcattcccagtacttgcgaaaagctgtcgggccttcccgtgcacccggagatcaggcctggacgcaggcactgcccagtgtgatcaaagaggaaaagatgctagggatactagttcaacataaagtgcggtccggcgtaagtggaatcgtgggtatggaagtggacggcttaccctttcacaacacacacgcagaaatgatacaaaaactggtggatgtgaccacagctcaggtgtag

SEQ ID NO: 25157 - DNA, 378 bp, Artificial Sequence
  Description of Artificial Sequence: Synthetic coding sequence
atgccctttacactgcatttgcggtcccgcctcccctctgccatccgttcactgatccttcagaagaagcccaatatccggaatacgtcctcaatggccggagaactgagaccggctagtctggtggtcctcccaagatcgcttgcccctgcctttgagcgattttgtcaggttaatactggcccgctgcccctccttggccagagcgagcctgagaaatggatgcttcctccacagggcgccatttccgagaccaggatgggacacccacaattttggaaatatgaatttggcgcatgtactgggtccctcgccagcctcgaacagtatagcgaacagctgaaggacatggtagcattttttctcggctgtagttag

SEQ ID NO: 25158 - DNA, 1746 bp, Artificial Sequence
  Description of Artificial Sequence: Synthetic coding sequence
atgccttttacattgcacctgcgaagtagacttccaagcgcaattcgctcattgatattgcagaaaaaaccaaatatccgcaacacctcgtccatggccggagagttgaggcctgcaagtctagtagtcctgccacggagtctcgctcctgcctttgagaggttctgccaggtgaacacagggcctctgccactgctgggacagagcgagcccgaaaaatggatgttgccacctcagggggcaatctccgagactcgcatgggccatccacaattttggaagtatgagttcggagcttgcaccggtagccttgctagcctggagcagtactcagagcagttgaaggatatggtcgctttctttctgggctgttctttttctctcgaagaagccctcgagaaagccggtctaccccggcgagatcctgccggccattcccaggctggcgcatacaaaacaaccgtcccctgtgttacccacgctggattctgctgcccgctggtagttaccatgaggcctatcccgaaggacaaattagaaggcctagtgcgtgcgtgctgctcactcgggggcgaacaggggcaaccagtccacatgggcgaccccgaactcctaggaatcaaggagctcagcaaacctgcctacggagacgctatggtatgcccgcccggggaggttccggtgttttggccgtcccccctgacctctctgggtgctgtgtccagctgtgaaactcctttggcctttgccagtataccgggctgtaccgtgatgaccgacctgaaagatgctaaggcccctcccgggtgcttaacccccgagcgcattccggaagtgcaccacattagccaggaccccctgcactatagtatcgccagtgtcagcgcctcacagaaaattcgcgaattggaatccatgatcggaattgacccaggcaatcggggcatcggccacctattatgcaaggatgagctgttgaaagctagtttgagtctgtcccacgctcggtctgtgttgatcactacaggttttccgacacattttaatcatgagcctcctgaggagacagacggcccgcctggtgccgtggcactcgtcgcattcctgcaggccttggagaaggaggtggctattatcgtggaccagagggcctggaatctccaccagaaaatagtggaggacgcagtggagcaaggcgtcctcaagacgcagatcccaatcctcacctaccagggagggtcggtcgaagctgcccaggccttcctgtgtaaaaacggagatccgcaaaccccccggttcgaccacctagtcgcaatcgaaagagctggacgtgccgctgatgggaattactataatgccagaaagatgaacatcaagcacttggtggaccctattgacgacctgtttcttgcggctaagaagatcccaggaatcagcagcaccggggttagcaattggggcggctacgcactggcctgcgctctgtacatactctattcctgcgcagttcactcgcagtacctccgaaaggcggtcggaccctcgagagcccccggtgatcaggcttggacccaagcgttgccttcggtcatcaaagaagaaaaaatgctgggaatcttagtgcagcacaaggtgaggagcggtgtgagcggcatcgtggggatggaagtcgacggcttgccctttcataatactcatgccgagatgatccaaaaactcgtagacgtgacaactgcccaggtttag

SEQ ID NO: 25159 - DNA, 78 bp, Artificial Sequence
  Description of Artificial Sequence: Synthetic coding sequence
atgccatttacactccacttgcgttccaggctccccagcgcaatccgttccctcattctgcaaaagaaacctaattag

SEQ ID NO: 25160 - DNA, 459 bp, Artificial Sequence
  Description of Artificial Sequence: Synthetic coding sequence
atgccattcactttacatctgcgaagcagattaccgagcgccataagatctttgatcctccaaaagaagcctaatatcaggaatacatcgagcatggcgggggaactgaggccggcctccttggtggtgctccccaggagtcttgccccggcctttgagcgattctgccaggtgaacactggaccactgccccttctaggccagagcgagcctgagaagtggatgctccccccgcagggggccatttcagaaacaaggatgggacatccacagttctggaagtacgaattcggcgcgtgcaccggaagcctcgcttccctggagcagtatagcgagcagcttaaagacatggtagccttcttcctgggctgtagctttagcctcgaggaggctctggagaaggccggcttgccccggcgggatcctgctggacactctcaggcgggcgcctacaaatag

SEQ ID NO: 25161 - DNA, 609 bp, Artificial Sequence
  Description of Artificial Sequence: Synthetic coding sequence
atgccatttaccctgcatttgcgctcccgccttccctcagcgatcaggtccttgattctccaaaaaaaacctaatatacgtaataccagtagcatggctggtgaacttaggcctgctagcctggtcgtgctgccaaggtctctcgcacctgccttcgagaggttctgccaggtgaacacaggcccgctgcccctcttaggtcagtccgagccggagaaatggatgctgccgccacagggagctatatcagagacccgaatggggcatccacagttctggaaatacgaattcggagcctgcactggctccctggcatcactggaacagtacagcgagcaactgaaagacatggtcgccttcttcctaggctgcagcttcagcctggaggaggccctggagaaagctggactaccccgcagagaccccgctggtcattcacaggccggtgcctacaagactactgtcccatgcgtgacacatgccggcttttgctgtcccctggtcgtgactatgagacccatccccaaggataaactcgaaggtctagtcagggcctgctgcagcttaggaggcgagcaaggccaaccagtgcacatgggagacccatag

SEQ ID NO: 25162 - DNA, 1851 bp, Artificial Sequence
  Description of Artificial Sequence: Synthetic coding sequence
atgccattcaccctccatctccgatcccgactgcctagcgccattcgcagcttaatcctgcaaaaaaaacccaatataaggaacaccagttcgatggcaggtgaactgagacccgcgtccctcgtagttctgcccagatctttggctccagccttcgagaggttttgtcaagtaaacactggaccattgcctcttctgggtcagtctgaacctgaaaagtggatgcttccaccccagggggctatctccgaaactaggatgggtcacccacagttctggaagtacgaattcggcgcttgcaccggatcgctggcctctctggagcagtacagcgagcaactgaaagatatggttgcattttttctgggttgtagcttttccctggaggaagccttagagaaggccggactaccccggagggatccagctggacactcccagacaacagtaccttgcgttacgcacgccggcttttgctgtcctctcgtggttacgatgcgaccgatcccaaaggataaactcgaagggcttgtacgcgcttgttgttccctgggtggcgaacagggccagccagttcacatgggcgatcctgagctcctcggtatcaaggaactgtcaaagcctgcttatggggacgcaatggtgtgccccccgggtgaggtgccggtcttctggccctccccacttacatctttgggagctgtaagctcctgcgagactccgttggcatttgcatcaatcccaggctgtacagtcatgacagacctcaaagacgccaaggctccccccggctgcctaacacccgaacgtatcccagaagtacatcacatcagccaagaccccctgcactacagcatagcctctgtgtccgcatcccagaaaattcgagaattggagtccatgataggcatagaccccggtaaccggggcattggccatctgctctgtaaagatgaattgctgaaggcttctctatctctgagtcatgccagaagtgttctgattacaaccggctttcccactcatttcaaccacgagcccccagaggagaccgatggtccgcctggggcggtggccttagtcgcatttctccaggccctcgaaaaagaggtggccattatcgtcgatcagagagcatggaaccttcaccagaagatcgttgaggacgccgtcgaacagggcgtcctgaagacccagattccaatcctgacctatcaaggggggtcggtagaagccgctcaagcattcttgtgcaagaacggggacccacagactcctcggtttgaccatctggtggccattgaaagagccggccgcgctgctgatgggaactactataatgctcggaagatgaatatcaaacatcttgtggaccccatcgatgacctgttcctagctgccaagaaaatccccggcatatcctctactggagttggcgacggtggtaatgaactcggcatgggcaaggtgaaggaagccgtgcggagacacatccgacatggtgatgtcattgcttgcgacgtggaagctgactttgcggtcatcgctggcgtctcaaactggggggggtatgccctggcatgtgcactgtacattctgtatagctgtgcagtgcatagtcagtatctgcgcaaagcggttggacccagcagggctcctggagatcaggcctggacccaggccctgccttctgtgatcaaggaggaaaaaatgctggggatccttgtgcagcacaaagtgaggtcaggagtgtcgggaattgtgggtatggaggtagatggcctgccattccataatacccatgcggagatgattcagaaactggtggatgtgaccaccgcacaggtgtag

SEQ ID NO: 25163 - DNA, 258 bp, Artificial Sequence
  Description of Artificial Sequence: Synthetic coding sequence
atgccattcacactccatctgcgctcccggctgccttccgcaattcgatccctgatcttgcagaaaaagccaaacattcggaacacaagcagtatggctggcgagctcagacctgcgtccctagtggtgctcccaaggagcctcgctcccgcctttgaacgtttctgccaggtgaacaccgggcccctccccctgcttgggcagtctgagccagagaagtggatgttgcctcctcaaggggcaattagtgaaacctag

SEQ ID NO: 25164 - DNA, 1851 bp, Artificial Sequence
  Description of Artificial Sequence: Synthetic coding sequence
atgccatttaccttgcacttacgttctagattgccaagcgccatccggtcactcattttgcagaagaaacctaacatcaggaacactagttcaatggctggcgagttacggccagcaagcctggtggtacttccacggtctctggccccagctttcgaaaggttctgccaggtgaatactgggcctctgcctctactagggcagtccgaaccagaaaagtggatgttgccacctcagggtgccatatcggaaacccggatgggtcatcctcagttttggaagtatgaattcggcgcttgtacaggcagcctggccagtctagagcagtactctgagcaacttaaggatatggtcgcattttttctcgggtgttcattttccttggaggaagcgttggaaaaagcgggcttgccaagacgcgacccggctggtcacagtcaaaccacagtgccttgcgtcactcacgctggattttgttgccccctagttgtaactatgcgcccaatcccaaaagacaagttggagggcctggtgcgggcctgctgctcccttggcggtgaacaggggcagcctgtccacatgggcgaccctgagttgctgggcattaaagagctcagcaagccggcctacggagacgccatggtgtgcccacctggcgaagtcccggtgttctggccctccccattgacgtctcttggcgcggtgtcctcttgtgaaactcccctcgcattcgccagcattcccggctgcacggtgatgaccgatctaaaggatgccaaggcccctcccggctgtctcacccccgagagaatccccgaggtgcaccacatttcccaagatccactgcactattccatcgcctccgtgagcgcttcccagaaaatcagggagctagagagcatgattggcattgacccaggaaacagaggcatcggacatctgttatgcaaagatgaacttttgaaggcctccctgtctttatcacacgcacgctcagtgctcattactacaggtttccctacccattttaaccacgagcctccagaggagacggatggaccccctggcgctgtggcactggtggcctttctgcaggccctggaaaaggaagtagcaattatcgtggaccagagggcttggaacttgcaccagaaaatcgtggaagacgccgtggagcagggggtactcaagacacagatccccattttgacctaccaaggtggatcagttgaggcggctcaggcctttttatgtaaaaatggggatccccaaacaccacgctttgatcacctcgtggctatagaacgtgccggccgagccgccgacggtaattattataatgctaggaaaatgaacattaaacacctggtagatcctatcgacgacctgtttctcgccgccaagaagatacctgggatttctagcacaggcgtgggggatggcggcaatgagctcggcatgggcaaagttaaagaagccgttcgccgtcatatcagacatggtgacgtgatcgcttgcgacgtggaagcagacttcgctgtcatcgccggcgtaagtaactggggagggtatgcactagcttgcgcattgtatatactttactcatgtgctgttcattctcaatacctccggaaagcagttggcccatctagagccccaggtgatcaagcgtggactcaagccctgccatctgtgattaaggaagagaaaatgctcgggatcctcgtacagcacaaagtgcgaagcggcgtgtctggaattgtcgggatggaggttgacggtttacctttccacaacacacacgctgagatgatccagaagctggttgacgtgacgactgcacaagtgtag

SEQ ID NO: 25165 - DNA, 1851 bp, Artificial Sequence
  Description of Artificial Sequence: Synthetic coding sequence
atgccattcaccttgcacttaagatccagacttccttcggcgatacgctccctgatactgcagaagaaacccaacataaggaatacttcttctatggccggcgagctgcgcccagccagtctggtggtcttaccccgaagccttgcccccgcgttcgaaaggttctgccaggtaaacacgggacccctccctctgctgggtcagagcgaaccagaaaaatggatgctgccaccgcagggggcaattagcgagactaggatggggcacccacaattctggaagtatgagttcggtgcctgcactggctctctcgcctcattggaacagtactcggagcagcttaaggatatggtggccttcttcctggggtgctccttttcactcgaggaggctttagagaaagccggccttccaaggagagatcccgctggtcatagtcagaccactgtgccatgcgtgacacacgctggtttctgttgcccccttgtggtgaccatgcggcccatcccaaaggataaactcgaggggctggtgcgtgcctgctgttcccttggaggcgaacaggggcagccagtgcacatgggggaccccgaactgctggggatcaaggaattgtctaaaccggcgtacggtgatgctatggtgtgtccgcctggggaagtaccagtgttctggcccagccccctgacttctctaggagctgtaagttcttgcgagacacctctggctttcgccagcatccctggctgtacagtcatgacggatctgaaagatgccaaagcgccccccggctgcctgacccccgaaagaatccccgaagtccaccacatctcacaggatcccctgcactatagcatagcttcggtgtccgctagtcagaagatccgcgaactggaaagtatgattggcatcgacccggggaacaggggtattggtcacctgctgtgcaaagatgagctgctgaaagcttcccttagcctgagtcacgcacgctcagtcttgattaccacaggctttccaactcacttcaaccatgagcctcctgaggaaaccgacggcccacccggggcagttgccttggtagccttcctgcaggcactggaaaaggaagttgcaatcattgtggaccaacgggcctggaacctccaccagaagatcgtggaagacgcagttgaacagggggtgctaaaaactcaaatccccattcttacttatcagggcggatcggtggaggcggcccaggcctttctctgcaagaacggagatccccagacccccagattcgaccatctagtggctatcgagcgggcaggacgggctgccgatggtaactattacaacgcccggaagatgaacataaaacatctggtcgaccccattgacgatctatttctcgctgccaaaaagatccctggaatttcatcaacaggggtcggggatggtggaaatgagctcggcatgggaaaagtgaaggaggctgtgcgccgccatatacggcatggcgacgtaatcgcatgcgacgtcgaggccgatttcgctgtgattgccggcgtgagcaattggggtggatatgcccttgcttgtgcactctacatcctgtactcatgcgcagtgcactcccaatacctgaggaaggccgtaggcccttctcgggccccgggcgaccaggcctggacccaagccctgccgagcgttatcaaggaagagaagatgttagggatccttgtgcagcacaaggtgagaagcggggtatcgggtatagtgggtatggaggtggacggcctgccctttcacaatacgcatgccgagatgatccagaagctggtagacgtgacgacggcacaggtatag

SEQ ID NO: 25166 - DNA, 252 bp, Artificial Sequence
  Description of Artificial Sequence: Synthetic coding sequence
atgccgtttaccctgcacctcaggagccgtctgccttctgctattaggtcccttatcttgcaaaagaagcccaacatccgaaacacatctagcatggctggtgagctgagacctgcctctctggtggtgttgcctagatcactagcgcctgcatttgagagattctgtcaggtaaatactggccctctaccgttgctaggacagagcgaacctgaaaagtggatgctgcctccccaaggggcaattagctag

SEQ ID NO: 25167 - DNA, 459 bp, Artificial Sequence
  Description of Artificial Sequence: Synthetic coding sequence
atgccattcacccttcatctccgctctagactgccttccgcaatccggtccctgattctgcagaagaagccaaatatcaggaacactagcagtatggctggagaattacggccggctagtctggtcgtgctcccaaggagcctggcccccgcttttgagcggttttgccaggtaaataccggccctttgcccctgttggggcagtcagagccagagaagtggatgttgcccccccaaggcgcaattagtgaaactagaatgggtcacccgcagttctggaagtatgaattcggcgcttgcaccggctctttagcctccttggaacagtatagcgagcagctcaaggatatggtggcatttttccttggatgctccttcagtctggaagaggccttagagaaagcggggctccctagaagagacccagccgggcattctcaggcaggagcctataaatag

SEQ ID NO: 25168 - DNA, 159 bp, Artificial Sequence
  Description of Artificial Sequence: Synthetic coding sequence
atgccctttaccctccacctgcgctccaggctgccgagtgccattcgctcactgatcctccaaaagaaacccaatatccggaacacgagctctatggcgggcgagctgcggcccgcttcgctcgtggttctgcctcgtagccttgcaccagcattctag

SEQ ID NO: 25169 - DNA, 1479 bp, Artificial Sequence
  Description of Artificial Sequence: Synthetic coding sequence
atggtggcattcttcctggggtgtagcttttctttggaagaggctttggaaaaagctggagcttacaagaccactgttccctgtgttacccacgccggattctgctgcccccttgtcgtgaccatgcgtcccatccctaaggataaactggaaggtctcgtgagagcctgctgcagcttgggcggagagcagggccagcccgttcatatgggcgatccagaactgctgggcataaaggaactatccaagcctgcttacggagacgcaatggtgtgtccccctggcgaggtccccgtcttctggccaagccccctgacctccctgggagcagtttcctcatgcgaaactccccttgcctttgcctccatccccgggtgcaccgtgatgactgatcttaaggatgctaaagcgccacccggatgcctaacccccgaacgaattccagaggtccaccacatttctcaggatcccctccactatagcatagctagcgtttccgcttctcagaagatccgggaactggaatcaatgattggaatcgaccccggaaaccggggaatcggacacctgctttgtaaagatgagctgctgaaggcttcattgtctctgagccacgcccgaagcgttttgattacaaccggattccccactcacttcaatcacgaacctccagaagagaccgacggaccacctggagctgtagctctggtagctttcctccaagcattggaaaaggaagttgccattattgtcgatcagcgcgcatggaacttgcatcaaaaaattgtagaggatgctgtggagcagggcgtgctcaaaactcagatccccatcctcacttaccagggaggatccgtggaggctgcccaggctttcctgtgtaagaacggtgacccccaaactccgaggttcgatcaccttgtggcaattgaaagggccggtagggcggctgacggaaattattataatgctcgcaagatgaacatcaagcacctcgtcgacccaatcgacgacttgtttttggcagccaagaagattccagggattagttctaccggagtcggagacggcggcaacgagctgggcatgggtaaggtgaaagaagccgtgagaagacacattaggcatggggacgttatagcctgtgatgtggaggcagattttgctgtgatcgccggggtgagcaattggggaggttacgccttggcttgcgctctgtacattctctattcatgcgctgtccattcgcaatacctgcgcaaagctgttgggccaagccgcgctcccggagatcaagcttggacccaggctctaccaagtgtcataaaagaggaaaaaatgcttggcatcttggtccaacacaaagtgcgttctggtgtgtctggaattgtgggaatggaggttgacggtctcccgttccacaatacccacgccgaaatgatccagaagttggttgacgttaccactgcacaagtttag

SEQ ID NO: 25170 - DNA, 483 bp, Artificial Sequence
  Description of Artificial Sequence: Synthetic coding sequence
atgcgaactgcagcaggagctgtctcccctgattcaaggcctgaaactagacggcagacccggaagaacgaggaggcggcctggggcccaagggtgtgtagagctgagcgtgaggacaaccgcaaatgtcctccttcaatccttaaaagatcacgcccagaacaccacaggcctgaagccaagccacaaaggacctccagacgggtctggttcagagagccccccgccgtcacagtgcattatattgcagataaaaacgccaccgctacagtgagggtccctggcaggccgcgtcctcacggtggatccttgctgttgcagctgtgtgtgtgtgttctgctcgttctggccctcgggctctactgcggaagagccaagccagtcgcaaccgccctcgaagacctgagggcccggctgctgggtttggttcttcaccttcgacacgtggccctaacatgttggcgcggattactgcggctttag

SEQ ID NO: 25171 - DNA, 483 bp, Artificial Sequence
  Description of Artificial Sequence: Synthetic coding sequence
atgagaactgctgccggcgccgtctcccctgatagcagaccggaaacaagacgtcagacacgtaagaacgaggaagccgcctggggcccacgagtgtgccgggctgaacgggaagataaccgcaagtgcccccctagtattctgaaaagatccagacctgagcatcatcggcccgaggccaagccacagcgcacatcaagaagggtgtggttcagagagccacctgcagtgaccgtccactacatagcggacaaaaacgccaccgccaccgttcgagtgccggggcggccccgcccgcacggcggaagccttctgttgcaattgtgcgtctgtgtgttgctggttctggctcttggcctatattgcggcagagctaaacctgtagctactgccctcgaagatcttagagccagactgctaggtctcgtactgcacttgcggcatgttgcccttacctgttggcggggtctgctgcggctgtag

SEQ ID NO: 25172 - DNA, 2325 bp, Artificial Sequence
  Description of Artificial Sequence: Synthetic coding sequence
atgaggggtcctatcgtgttgcatatctgtttagcgttttgctctctgctgctgttcagcgttgccacgcaatgtctggcttttccaaagatcgaaaggcgtagagaaatcgctcatgtgcatgcggagaaaggccaatctgacaaaatgaacacggacgacctggagaacagctccgtgacctctaagcaaaccccacagctcgtagtcagtgaggatccaatgatgatgtccgcagtgccaagcgccacctcgctaaacaaggcattctctataaataaggagacccagcctgggcaggcaggattgatgcagactgagaggccgggggtctccacaccaaccgaatccggggtgcctagcgcagaggaagtgtttggttcctcacagccagagaggatctcccccgagtccggcctggctaaagccatgctcacgattgctattaccgcaacacccagtctgacggttgatgaaaaagaggagctcctgacttccacaaacttccagcccattgtcgaggagattaccgagactactaaaggcttcctgaaatacatggataaccaatcgttcgccaccgagtcccaggagggagtgggactgggccacagcccctcctcatacgttaacaccaaggaaatgctgaccacaaacccaaaaaccgagaaattcgaagccgataccgaccaccgcactaccagtttccccggagccgagagtacggcaggatcagagccaggatccctcacacccgataaggaaaagccctcgcagatgactgctgataacacacaggccgctgcaacaaaacaaccacttgagacaagcgagtatacactgtccgtcgaaccagaaactgatagcctcctcggggcacccgaggttacagttagtgtgagtaccgcggtccccgccgcctctgcacttagcgacgaatgggatgacacaaagcttgaatccgtatctcgtattcgcacgcccaaactcggcgataacgaagagacacaggtaagaacagagatgtcacagactgctcaggtgtcacacgaagggatggagggaggacagccttggaccgaagccgcccaagtcgcactcggcctgcccgaaggcgagactcacacagggacagcacttctgatcgcacatggcaacgagagatcacctgctttcactgaccaatcatcattcacacccacatccctgatggaggatatgaaggtgtctatcgttaatctcctgcagtcgactggcgacttcactgagagtaccaaggaaaatgacgcgctatttttcctggagaccaccgtgagtgtatccgtgtacgagtctgaagcggatcagttgctgggaaacacgatgaaagacattattactcaggagatgaccacagctgtccaagaaccagatgctaccttgagtatggtgacccaggagcaggtggcaaccctagagctgatcagggattcgggaaagacagaagaggaaaaagaagacccatcgcccgttagcgacgtgccaggggtcacacagttgagtagaaggtgggaaccgctagccactactatatctaccaccgtagtgcccctgagttttgaagtgacccccactgtggaggagcagatggataccgtgacgggacccaatgaggagtttaccccagttctgggaagccccgtgacacctcctgggataatggtaggggagcccagcattagccccgccctccctgccctggaggcctcttcggaaagacggaccgtagtgccgagtatcacacgcgtcaacacagctgccagctatggccttgatcagttagagagcgaagagggacaggaggacgaggacgaagaagatgaagaagatgaggacgaggaggaggaggacgaggaggaagacgaggaggacaaagacgctgattcactagatgagggcctcgatggagacacggagcttccaggcttcacccttcctggcatcacgagtcaggagccagggcttgaggaggggaatatggatctgctggaaggcgctacttaccaggtgcctgacgctctggaatgggaacaacagaatcaggggctcgtgcgctcatggatggagaaactaaaagacaaggctggatatatgtccggaatgttggtccccgtgggagtagggatcgcaggcgccctctttatcttgggtgccttatactcgattaaagtgatgaatcgaaggcgacgaaatgggtttaaaaggcataagcggaagcagcgggagttcaactccatgcaggacagagtgatgctcctcgccgacagttccgaagatgagttttag

SEQ ID NO: 25173 - DNA, 729 bp, Artificial Sequence
  Description of Artificial Sequence: Synthetic coding sequence
atggctgccgccctctggggctttttcccagtgcttcttctcctactcctgagcggggacgtccagagcagtgaggttccgggagctgcggctgagggaagcggagggagcggcgtggggattggtgatcggtttaaaatcgaggggcgcgctgtggtcccaggtgtaaaacctcaagactggatctccgcagcgagggtacttgtcgatggagaagagcacgtgggtttcctcaaaactgacggatcgttcgtagttcatgacatccccagtggatcatacgttgtggaagtggtgagccccgcctacaggtttgatcccgtgcgggttgacatcacatcaaaaggtaaaatgagggcacgatatgtaaattacatcaagacaagcgaggtagttcggctgccgtatccacttcagatgaagtccagcgggcctccaagctactttattaagcgagagtcttggggatggacggacttccttatgaacccaatggttatgatgatggtcctgccgttgttgatttttgtcctgttgcccaaggtggtgaatacttccgaccctgacatgaggcgggagatggagcagtctatgaatatgctgaactctaatcacgaactgcccgacgtgagcgagtttatgactagactcttcagctctaaatccagcgggaagagttcctctggcagcagcaaaacaggaaaatcaggggccggtaagagacggtag

SEQ ID NO: 25174 - DNA, 1596 bp, Artificial Sequence
  Description of Artificial Sequence: Synthetic coding sequence
atggcagtcgctccgtcatttaatatgacaaacccccagccggccatcgaaggcggaattagcgaggtggaaataatttcacagcaggttgacgaggagaccaagtctatcgccccagtccagctagtgaacttcgcctaccgggacctgccactcgctgcagtcgatttaagcacagccggctcgcagttgctgtctaatctggatgaagactaccaaagggaggggtccaattggctgaagccatgctgcggaaagagggcagcagtttggcaggtctttctcctgagcgcttcgctgaattcctttctcgtcgcttgtgtaatcctggtggtgattctcctgaccctagagctgttgatcgacatcaagctgctgcagtttagtagcgcttttcagttcgctggagtcattcactggatctccctggtgattctgagtgtgttcttcagcgaaactgtcctgagaatagtagtgttgggtatctgggactacattgaaaataagattgaggtgtttgatggcgccgtgattatcttatccctggccccgatggtagctagcacagtggcaaacggaccgagatctccttgggacgcaatttccctgatcataatgcttagaatttggagggttaagagagttatcgatgcatatgtgctccctgtaaagcttgagatggaaatggtaatccaacagtatgaaaaggccaaggtgattcaggacgagcagcttgagaggctgacgcagatatgtcaggagcagggctttgagattcgtcaactgcgtgctcatctggctcaacaagacttggacctcgcggcagagcgagaggccgccctccaagccccccacgttctgtcccagcctagatccagatttaaggtgctggaagcgggtacctgggacgaagagacagcggctgaatccgttgtggaggagttacaaccaagccaggaggccacaatgaaagatgatatgaacagttacatttcccagtattataacgggccaagcagcgactctggtgtgcccgagcctgctgtttgtatggtcaccacagcggcgattgacattcatcagcccaacatatcttctgatttattctctctggatatgcccctgaagctgggtggtaatggaactagcgccacgtcagagagcgccagtcgctccagtgtcacaagagcacaatctgatagtagccagaccctaggatccagtatggactgttccactgctcgggaggagccaagcagcgaaccaggaccatcccctcctcctctacccagccagcagcaggtggaggaggccaccgtgcaggatcttcttagctctctgtctgaagatccctgcccttcgcaaaaggcgttggatccagctcctctcgcacgtcccagtcccgctggcagtgcccagacgagtccagaactggaacatcgcgtgtctctcttcaatcagaagaatcaggaagggttcacggttttccagattagacctgtaatccacttccagcccactgttccaatgctggaagacaagtttcggtccctggagtcgaaagaacaaaaattacaccgggtcccagaagcatag

SEQ ID NO: 25175 - DNA, 252 bp, Artificial Sequence
  Description of Artificial Sequence: Synthetic coding sequence
atgtcattcttccagcttttgatgaagcgaaaagagctgattccactcgttgtcttcatgacagtcgctgcaggcggagcatcctcgtttgctgtctactcattgtggaaaaccgacgttatcctggacaggaagaagaatccggaaccatgggagaccgttgaccccacagtgccccaaaaactcatcacaataaatcagcagtggaaacccattgaagaactgcagaatgtgcagcgggtgacgaaatag

SEQ ID NO: 25176 - DNA, 252 bp, Artificial Sequence
  Description of Artificial Sequence: Synthetic coding sequence
atgtcctttttccagctgctgatgaaaagaaaggaattgatacccctcgtagtgtttatgacggtggccgctggtggtgccagttcgttcgctgtttattccctgtggaagaccgacgttattctggaccggaaaaagaatccagagccctgggagaccgttgaccccactgtgccccagaaactgatcactattaatcaacaatggaaaccgattgaggaactgcagaatgtccagagagtgaccaaatag

SEQ ID NO: 25177 - DNA, 528 bp, Artificial Sequence
  Description of Artificial Sequence: Synthetic coding sequence
atggagacttggcgtaaaggcagcttccgaaacgcctccttcttcaaacagctcagcctgggtcgcccccgccgtctccgcaggcaatcctccgttctgtcccaggcatccacagcagggggggatcacgaggaatattctaatcgagaggtgatacgggagctgcagggtcgccctgatggacgtcgattgccactgtggggagatgaacagccaagagcaactcttctggccccacctaagccacctcgcctgtatcgggagagcagttcttgtccaaacattctcgaacctccacccgcctacactgctgcgtactccgctaccctgccaagcgccctcagcttatcttcggctcttcatcaacacagcgaaaagggattggtggacacaccatgctttcagagaaccccaactccagatttgagtgatccatttctgagcttcaaagtagacctgggaatcagtttgctcgaggaggtgctccagatgctgcgcgagcaatttcccagtgaaccgtccttctag

SEQ ID NO: 25178 - DNA, 528 bp, Artificial Sequence
  Description of Artificial Sequence: Synthetic coding sequence
atggagacatggaggaaaggcagtttcaggaatgcgtcctttttcaagcagctttctctcggtcgcccccggcgcctgaggcgacagagctcagtgttgtcccaggcttctacagcaggtggagatcacgaagaatattctaatagggaggtgatacgcgagctgcagggccgtccagacgggcgacgcctgcctctgtggggcgatgaacagccccgcgcgactttgctagcgccaccaaaacccccgcggctttacagggaatcttcttcgtgtcccaacatactggagccacctccagcatatacggcagcctactctgctactctcccgtccgcgctctctcttagctctgccttgcatcaacattcagaaaaggggcttgtggatacgccatgctttcagagaacgcctacacccgatttgagcgatcccttccttagcttcaaagttgatctcggcatttctcttctggaagaggttctgcaaatgctgcgcgagcagtttccaagcgagcccagtttttag

SEQ ID NO: 25179 - DNA, 675 bp, Artificial Sequence
  Description of Artificial Sequence: Synthetic coding sequence
atgcccctcacacccgaacctccttccggtagagtcgagggaccacccgcgtgggaagcggctccctggccctcattgccgtgtgggccatgtattcccataatgctggtcctggcaacgttagcagccctcttcatcctgacaaccgctgtgctcgctgagcggttattccgtagagctctacgcccggatcccagccatcgggctccgactttggtgtggagacccggcggcgagctttggattgaaccaatggggaccgctcgcgagcggagtgaggattggtatggtagcgctgtaccattgttgacggatcgggctccagagcccccaacacaggtgggtactctggaagctagggccacggcaccacccgcccctagcgccccaaactccgcacccagtaatttgggtcctcaaacggtcctagaagtgcctgcaagaagcaccttctgggggccccagccgtgggaaggacgtcctcctgcaaccggcctggtctcttgggccgagcccgagcagagacctgaagcatctgtccagtttggtagtcctcaagcccgtcgacagcgtcctggatccccggacccagaatggggattacagccccgggtcaccctggagcagatctccgctttctggaagcgggaaggccggacctcagtgggtttctag

SEQ ID NO: 25180 - DNA, 1407 bp, Artificial Sequence
  Description of Artificial Sequence: Synthetic coding sequence
atggccgacgacgctggcctggagacacccctgtgctcagagcagtttggaagtggggaggcacggggctgccgtgctgctgcagatggcagcttacagtgggaggtaggcggatggcgctggtggggcctgtctagagcctttactgtgaagccagaaggacgggatgctggagaagtgggggcgagcggtgcaccgtctcctcctcttagcggcctgcaagccgtctttcttccccaagggttccccgacagcgtgagcccggactatctcccctaccagctgtgggattccgtgcaggccttcgcttcttctctgtcgggttccttggccacacaggcagtgcttcttggcatcggtgtgggcaatgctaaggcaacagtgtcagccgccaccgctacgtggctggtgaaggattccaccggtatgttaggaagaatcgtcttcgcatggtggaaaggctcaaagctggattgcaacgctaaacagtggcgactctttgctgacatcctcaatgatgtcgccatgttcctcgagattatggctcccgtctaccccatctgctttaccatgaccgtcagcacatctaacctagcgaaatgtattgtgtccgtggccggtggcgccacaagggcggcactgacagtccaccaggccaggaggaataatatggctgatgtgtctgccaaggattcatctcaagagactctagttaacctggccggcctgctcgtgagcctgctcatgctgcctctggttagtggatgtcctggtttctcgcttggatgctttttcttcctaacagcactgcacatctacgctaactatcgggctgtcagggctctagtgatggagacacttaacgagggaaggttgagactggtccttaagcactacctgcagagaggcgaagtgttggaccccaccgcagcgaaccggatggaacctctttggacaggcttttggcccgccccctcgctcagcctaggggtcccactgcaccgcctcgtttcctcggttttcgaactccagcagttggtcgaggggcatcaggagtcatatctgctttgctgggatcagtcacagaatcaggttcaggtggttttaaaccagaaggcggggcccaagactattctgcgggccgcaactcacgggttgatgttgggcgcattgcagggcgatgggccgttgcctgctgaactcgaagaactccgaaatcgcgtgagggccggtccaaaaaaggaaagttgggtcgtcgtcaaagagacccacgaggttcttgacatgctctttcctaagtttctcaagggactgcaggatgccggatggaaaactgaaaagcaccagctcgaagtcgacgagtggagggccacgtggctgctgtcacccgaaaagaaggtcctgtag

SEQ ID NO: 25181 - DNA, 585 bp, Artificial Sequence
  Description of Artificial Sequence: Synthetic coding sequence
atgctcggtcgcatcgtgttcgcttggtggaaagggtccaaacttgactgtaacgcaaaacagtggagacttttcgcagacatcctcaatgatgtcgccatgttcctagagataatggcccccgtttacccaatatgttttactatgaccgttagcacctctaatctggccaagtgtatcgtgtctgtcgccggcggagctacacgggcagccctgaccgtgcaccaggccagacggaataacatggccgatgtaagcgcgaaagattcaagtcaggagacacttgtgaatctggccggcctgctcgtgagtctgcttatgctaccattagtgtctggatgcccgggattttcgctaggctgcttcttcttcctgaccgcgctacacatctatgccaactacagagctgtcagagctctggtcatggaaactctgaatgagggtcgactacgactcgtgctgaagcattacctgcagcgcggcgaagtgctggatcctacagctgccaacaggatggaacctttatggaccggagacccagctccaggcttgggctcatgtgtatccactagtcctaccgcttag

SEQ ID NO: 25182 - DNA, 1269 bp, Artificial Sequence
  Description of Artificial Sequence: Synthetic coding sequence
atggccgacgatgctggactggagacaccgctatgttctgaacagttcggcagcggcgaagccaggggatgtcgagccgccgcagatggcagtctaccacaggggttcccggacagcgtgtcacctgattacctcccttatcagttatgggactcagtccaggcttttgccagtagtttaagtggaagtcttgcgactcaggctgtgctcctaggcatcggggtgggcaacgccaaagctacagtgtccgcagccactgccacttggcttgtcaaggatagcaccggtatgctagggcgtatcgtgttcgcctggtggaaggggtcaaagctggactgcaacgctaaacaatggcggctcttcgcagatattctgaacgatgtcgcaatgtttttagagattatggccccagtatatcccatttgctttactatgactgtttccacgtccaacctggccaagtgcatagtttccgttgccggcggcgcaactcgagccgcacttaccgttcatcaagctagacggaataatatggccgacgtctccgccaaagattcctcccaagagacactcgttaacctggcgggacttctcgtgagcctgctaatgttgcccctggtatcaggatgccccgggttttcactgggatgtttcttttttttgaccgcccttcatatttacgcaaactaccgcgccgtgagggctctggtgatggagaccctgaatgagggaaggctgcggcttgtcttgaagcattatttgcagcggggagaggttctcgatcccaccgccgccaatagaatggaacccctctggacaggattttggcccgctccgtctttgagtctcggggtacccctgcaccgcctagtaagctctgtcttcgaactgcagcagctggtcgaaggacaccaggagtcttatctgctctgttgggatcagagtcaaaaccaagtccaggtggtgttgaaccagaaagcaggtcccaagacaatcctgcgggccgcaacacacggccttatgctcggtgcactccagggggatggccctctccctgcagaattagaggaattgagaaacagagtaagagcaggcccaaagaaggagagttgggtggtggtgaaagaaactcacgaagtgctggacatgcttttccctaagttcctgaaaggactgcaggatgcagggtggaaaacagaaaaacaccagcttgaggtggacgaatggagagcaacctggttactgtcccccgaaaagaaggtgctgtag

SEQ ID NO: 25183 - DNA, 471 bp, Artificial Sequence
  Description of Artificial Sequence: Synthetic coding sequence
atggctgacgatgcgggcctcgagacacctttgtgctccgagcaattcggttccggcgaggcccgcgggtgccgagccgcagccgatggctcgctgcagtgggaagttggcgggtggagatggtgggggttatcgagagctttcaccgtaaagcccgaaggacgagacgcaggagaggtgggagccagcggcgcgccatcgccccccctatccggtctgcaggcggtcttcttaccacagggatttccagattccgtgtcacccgactatctgccatatcagctctgggactcagttcaggcctttgcttcatccctttcaggctcgttggcaactcaggccgtgttactagggataggagtgggaaatgccaaagccacggtttccgccgctacagccacttggctagtcaaggattcgacaggaatgcttgggcggattgtgttcgcatggtggaaaggagcttcctag

SEQ ID NO: 25184 - DNA, 2892 bp, Artificial Sequence
  Description of Artificial Sequence: Synthetic coding sequence
atggctgtattcccttggcacagccggaataggaactacaaagccgagttcgccagctgcagactcgaggctgttcccctagaatttggggactaccaccccctgaagccaattactgtaacggaaagtaaaacgaagaaagtgaacagaaaaggaagcacctcatctaccagttccagttcatccagttcagttgtcgatcctttatcatcagtgctagatggcaccgatcctctgagcatgttcgccgctacagccgaccccgccgcgttggcagccgccatggactcttcaaggagaaaacgggacagagatgataattcggtggtgggcagcgacttcgagccgtggactaacaagcgcggggagattctcgcgaggtatacaacgacagaaaaactttccatcaatttgtttatgggatccgaaaagggaaaagcggggacggcaacgctggctatgtcagaaaaagtacgaacgaggctggaagagctggatgacttcgaagaaggctcgcagaaagaactgctcaatttgacgcagcaggactatgtcaacagaattgaggaacttaaccagtcactcaaggatgcttgggccagtgaccagaaagttaaggccctcaagattgtaattcagtgctctaagctcctttcagacacctctgtaattcagttctatccatccaagttcgtattgattactgatatcctggacacttttggcaagctggtttacgagcgcatcttctcaatgtgtgtggacagcaggtcagtgctgccagatcacttctcccctgagaatgccaatgacacagcgaaggagacctgcctgaattggtttttcaaaattgcctccattagagaacttatccccaggttctatgtggaggcctccatcctgaagtgcaataagttcctgagcaaaacaggtatcagcgaatgcctgcctcggttgacatgcatgattagaggcatcggggaccctctggtcagtgtgtatgcaagggcctatctgtgtcgcgtgggcatggaagttgccccccacctgaaggagacccttaataagaactttttcgacttcctcctgacgtttaaacagattcatggagacacagtgcagaatcaacttgtggtgcaaggtgtcgaacttccatcctaccttccattatatcccccagcaatggactggatattccaatgtattagctatcacgcgccagaagctctgctcacagaaatgatggaaaggtgtaagaagttggggaacaatgccctgttgctgaactctgtgatgtccgctttccgggccgaatttatagccacccgttccatggattttatcggaatgatcaaagagtgtgatgaaagtggatttccaaagcatctgttgtttaggtccctggggctgaaccttgcgctggccgaccctccggaaagtgatcgactgcagattctaaatgaggcttggaaagtgatcacaaagttaaaaaatccacaagattacatcaactgtgcagaggtctgggtggagtacacgtgtaaacatttcacaaaaagagaggtgaacacggtccttgctgacgtgatcaagcacatgacacccgaccgggcttttgaggattcatacccacagttacagctgatcataaagaaagtgatcgcccatttccacgatttttctgtgttattttccgttgagaagttccttccatttcttgatatgttccagaaggagtcagtcagagtcgaggtgtgcaagtgcattatggacgcctttatcaaacatcagcaagagcctaccaaagacccagttattttgaatgctctactacacgtgtgtaagaccatgcacgactcagttaacgccctgactctcgaggacgagaaacgaatgctgtcctatttgatcaacgggttcattaagatggtgtctttcggaagggacttcgaacagcagctgtctttttacgtggagtctaggagcatgttctgtaacctcgagccagtgttggtccagctgattcactcagtcaaccggctggcgatggaaactcgcaaggttatgaaggggaaccactcccggaaaacagctgctttcgtgcgggcatgtgtagcctattgctttatcaccatccctagcttggctggaattttcactaggctgaatttatatcttcattccgggcaggtggctctggcgaaccaatgcttaagtcaggcagacgcattttttaaggctgcaatttcgctggtgccagaggtcccgaaaatgatcaacatcgacgggaaaatgcgcccatctgagtctttcttgctggagttcctctgcaacttctttagcaccctgctaatagtgcctgaccaccctgaacacggggttctctttctagtccgcgaactcctcaatgtaatccaggactatacctgggaggacaactccgacgaaaagatcagaatatacacatgtgtattacatctcctgtctgctatgtcacaggaaacgtacctctatcacattgataaggtcgatagcaatgattccctgtatggcggcgacagcaaattcctggcagaaaataataagctctgtgagaccgtcatggctcagatccttgagcacctgaaaaccttggcaaaggatgaagccctgaagcgccagtcttcacttggcctgtctttctttaactccattctggcccatggcgaccttcgcaataacaagttgaaccaactatcggtaaacctatggcacctcgcacaaaggcacggctgcgccgacacacgaacaatggttaagacactggagtatatcaaaaagcaaagtaagcagcctgacatgactcacctgactgagctggcactccgcctcccgctgcagacccggacttag

SEQ ID NO: 25185 - DNA, 2613 bp, Artificial Sequence
  Description of Artificial Sequence: Synthetic coding sequence
atggcggtgttcccttggcacagccgcaatagaaattacaaggccgagttcgcttcatgtcgtctcgaggcggtgcccttagaattcggcgattaccaccctctgaaacccattactgtcactgaaagcaagaccaagaaagttaataggaagggaagcacttcttccacatcatcgtcaagcagttcttcggttgtagatcctttatcttctgtgctcgatggtacagatccattgagtatgtttgccgccaccgctgatccagccgctctggccgctgcgatggattcaagtaggcgcaagcgggatcgcgacgataactccgttgttggaagcgatttcgagccctggactaataagcgaggtgagatcctggcgaggtacaccaccaccgaaaagctgtctattaacttatttatgggcagcgagaaagggaaggccggaactgccaccctggctatgtcggaaaaggtgcgcacgcgcctcgaggaactggatgacttcgaggagggtagtcaaaaagagctgttgaacctgacacagcaggactatgtgaaccgcatagaagagctcaatcagtccctcaaagacgcatgggcaagtgaccagaaggtcaaagccctgaaaatagtgatccagtgctccaagcttctcagcgacacaagcgtcatccagttctacccgagtaagttcgtcctcataacagacatccttgatacatttggcaaattggtgtacgagcgtatcttttctatgtgtgtggactcccggagcgtgctgccagaccacttcagccctgagaacgccaatgataccgccaaagagacctgtttgaactggtttttcaagatcgctagcatcagagaattaataccacggttctacgttgaggcctcaattctgaaatgcaacaagtttttgtccaaaaccgggataagcgagtgtctcccgcgcctgacatgtatgatccgaggcatcggagaccctctggtgagcgtctatgccagggcctacctctgccgagccctgcttactgaaatgatggagcgatgcaagaagctgggcaacaacgccttgctcctgaattccgttatgtcagctttccgcgccgagtttattgccactaggtcgatggattttattggcatgatcaaggagtgtgacgaatccggtttccctaaacacctgctctttcggagtttagggctgaacctagcattggctgatccacccgagagcgaccgtctacagatcctgaacgaggcatggaaggtgattaccaaattgaagaacccacaggattacatcaactgcgccgaagtgtgggtggagtacacctgcaaacactttacaaagcgcgaggtcaatacggtgcttgcggacgtgatcaaacatatgacccccgatcgggcctttgaagactcttacccacagctccagctgatcattaaaaaagtgatcgcccattttcatgactttagcgtgctgttctctgtcgagaagttcctcccttttttggatatgtttcagaaggagagcgtacgtgtggaggtgtgtaagtgtatcatggatgccttcatcaagcatcagcaggaaccaaccaaggatcctgtgattctgaacgccctgctgcacgtttgcaaaaccatgcacgacagcgtaaatgcactgaccttagaggatgagaaacggatgctctcctaccttatcaatgggtttattaagatggtgtctttcggacgcgacttcgagcagcagttgagcttttatgtagagtcgcgaagcatgttctgcaaccttgagcctgtactggtccagcttattcatgcttgtgttgcatactgtttcatcaccatcccttccttagccggcatttttacccgccttaacttgtacctacactctgggcaggtggctctggccaatcagtgcctgagccaggccgacgcctttttcaaggcagcaatctccctggttccagaggtgccgaaaatgatcaatatcgacggcaagatgaggccttcggaaagctttcttctggagttcctgtgtaatttctttagcacccttctcattgtgccggaccatcctgaacatggcgtgctctttctggtgagggaacttctgaatgtaatacaggattatacatgggaagacaactccgacgagaagattcgcatctacacttgcgtgctacacctccttagcgctatgtcccaggaaacttatctgtatcatatcgataaggtagattcaaacgattcactgtacggcggagactcaaaattccttgcagaaaataataaactgtgcgaaactgtcatggctcaaattctcgagcatttaaaaacattggccaaagacgaggctctgaagcgccagtcaagcttaggcctttctttctttaacagcatactggcccatggcgatctccggaataacaagttgaaccaacttagcgtgaatctatggcacctggcacagaggcatgggtgcgcggatacacggactatggtgaagaccctggagtatatcaagaagcagtcaaaacaaccagacatgactcacctcacagaattggcattgcgtctcccactccagacacgcacatag

SEQ ID NO: 25186 - DNA, 3159 bp, Artificial Sequence
  Description of Artificial Sequence: Synthetic coding sequence
atggcccccgccggggttgtgacccgagccgtacggtccggtgagcttcccctgacctcaatggctagcgccgagaacgaagcatgtgctgtaaggtcagttgcctgcccatcccaggcctggcggctgcagaaagtactgtgcggcagatgtggagccgcttcgtgcccctcacagacctggaggccaagaggagctggcagtggaggagtgcggatgggttctcgcgctgacggccctagaacttccggacatgtgaccggaaaaatggctgtgtttccatggcacagtcgcaatcggaattataaggcagaattcgcctcctgccggctggaggcggtgcctctggagtttggcgattaccaccctctgaagcccatcacggtgaccgagtctaagactaaaaaggtgaaccgcaaagggtcgaccagcagcactagcagctcctcctcatcctctgttgtggatccgctcagctcagtgctggacggaacagaccccctgtccatgttcgcagcaaccgcagatcccgccgcgctggcagccgctatggacagctcaaggcgtaagcgcgacagggacgataatagtgtcgtaggtagcgacttcgagccttggaccaacaagaggggtgagatcctcgcacggtacacaacaacggagaagctgtcaattaacttatttatgggttcggagaaaggtaaggccggcaccgcgaccctagctatgagcgagaaggtgcgaacccgcctggaggaactagacgattttgaagagggaagtcagaaagaactgctcaatctgacgcagcaagactacgtcaatcgaatcgaggagctgaaccagtccctgaaagacgcctgggccagcgaccaaaaggtgaaggctcttaagattgtgatacaatgctctaaattattgagtgatacctccgtgatccagttctacccctcaaaattcgttcttatcacagatatactcgatacattcggaaaactggtttacgagaggatattctccatgtgcgtagactctagatccgtactgcccgaccatttctcacctgagaacgccaacgacaccgctaaggagacatgtctgaactggttctttaagattgcctcaatacgtgagctaatccccaggttctacgtggaagctagcatcctgaagtgtaataagtttttatcaaagaccgggatttcagaatgcctccccaggctgacctgtatgatcagaggaataggcgacccgctggtgagcgtgtatgctagggcctatttgtgtcgagttggtatggaggtcgcccctcacttgaaggaaacactcaataagaactttttcgacttcctacttaccttcaaacagatccacggagacaccgtgcagaatcagctagtggtccaaggcgtggagctgccgtcgtaccttccgctttatccacctgcaatggattggatatttcaatgtatatcttatcacgcacctgaggcactgttgacggagatgatggaacggtgtaagaaactgggcaataatgctctgttactcaatagcgtgatgtcagcttttagagccgagtttattgccacgcgtagcatggactttattggcatgatcaaggagtgtgatgaatctggattcccaaagcacctgctgttccgaagcttggggctgaacctggctcttgctgaccctcctgagtctgacaggctgcaaatccttaatgaggcctggaaagtgataacaaagctgaaaaacccccaggactacatcaactgtgcagaggtgtgggttgaatacacttgcaagcactttacaaaacgggaggtcaacaccgtgctggctgacgttattaagcacatgactccggatcgcgcttttgaggactcctaccctcaactgcaactaataatcaaaaaggtaattgcacacttccatgatttctccgttctcttctcagtcgagaagttccttccgttcttggatatgtttcagaaggagtccgtgcgggtggaagtctgtaagtgcattatggatgcgttcatcaagcaccaacaggagcccaccaaagatccagtaatactcaacgcacttctccatgtttgcaagacgatgcacgacagtgttaacgccttaactctggaggatgagaagcgaatgttaagctacctaataaatggatttatcaaaatggttagctttgggagagacttcgaacaacaactgagcttctacgttgagagtcggtctatgttttgtaatttggagcccgtgctggtgcagcttattcactccgttaatagacttgccatggagacgcgcaaggtgatgaagggtaatcactctcgaaagaccgccgctttcgtccgcgcctgcgtcgcttattgttttattactatcccttccctagctgggatcttcacacggttaaacctgtacctccactccgggcaggttgctctcgccaaccagtgtctgagccaggccgatgcgttcttcaaagccgcaattagccttgtccctgaagtgccaaagatgattaacatcgatgggaaaatgcggccatcagaatcttttctgcttgaattcctgtgcaatttttttagcacactcctcatagtgccggatcaccccgagcacggagttctgtttcttgtacgcgagctactgaacgtcatccaagactatacatgggaggataacagtgatgagaaaatccgcatttacacctgtgttctccatcttctctccgccatgtctcaagagacttacctgtaccacattgacaaggttgattcgaacgatagtctgtacgggggtgacagtaagttcttggcggagaataataagttgtgcgagaccgtgatggcacagattctggagcacttaaagaccctggccaaggatgaggctcttaaacgccaatcttccctggggctcagcttctttaattctatcctcgctcacggggacctccggaacaacaagctgaaccagctgagtgtaaacctttggcatctcgcccaacgtcatggatgcgctgacactaggacaatggttaaaaccctggagtacatcaagaagcaatctaagcagcctgatatgacccatctgacggaactagccctgcggctcccactgcagacgcgaacgtag

SEQ ID NO: 25187 - DNA, 2442 bp, Artificial Sequence
  Description of Artificial Sequence: Synthetic coding sequence
atgcccccacttggcgtgttagtccacgaaaaatcccacctttgcgacgtgaactctttctgccttggaaaagcagggaccgcaactctggccatgagcgagaaggtgcgtacaaggcttgaggaattagatgacttcgaagaaggctctcaaaaggaactactgaatctgacccagcaggattatgttaaccgaatcgaagagctgaaccagagtctaaaggatgcctgggccagtgaccagaaagtaaaagcactcaagatcgtcatacaggccgagctggtgtatgaacggatattttccatgtgtgtggatagtcgatccgtgctgcctgatcacttttccccggaaaatgccaatgataccgcaaaggaaacctgcctgaattggttctttaaaatcgcaagcattcgcgagctcatcccaaggttctacgttgaggcttccattcttaagtgcaacaagttcctttctaagactggtatctctgagtgcctaccaagactcacatgcatgatacgcggaattggtgaccctcttgtgtccgtatacgcacgagcgtatttatgccgggtggggatggaagttgccccacacctgaaagagaccctgaataagaacttctttgatttcttgctgacattcaagcagatccacggggacacggtacagaatcagttggtggtgcagggcgtagaacttccctcttatctgcctttgtacccccctgcgatggactggattttccagtgcatatcttaccacgccccagaagccttgttaacagaaatgatggagcggtgtaagaagctcggtaacaatgcccttcttcttaacagcgtcatgagcgctttcagagctgaattcatcgcaacccgctcaatggacttcatcgggatgataaaagagtgcgacgaatccggatttcccaagcatctactcttccggtcattgggcctgaacttggcacttgctgacccccccgaatcagatagattgcagatactcaatgaagcgtggaaggtgatcaccaaactgaagaatccacaagactacattaactgtgccgaagtctgggtggaatacacctgcaagcatttcaccaaacgcgaagtgaacacagtgcttgccgacgtgataaaacacatgactccagaccgggcatttgaagattcctacccacagttgcagcttataataaagaaggtgattgcccatttccacgactttagcgtcctgttctctgtagaaaagtttctgcccttccttgatatgtttcagaaggaaagcgtgagagtcgaggtgtgcaaatgcatcatggacgcgttcatcaagcaccaacaggaacccacgaaagaccctgtgattttgaatgccctgcttcacgtctgtaaaacgatgcatgactccgtaaatgcattgacattggaggatgagaagaggatgttgtcgtaccttatcaacgggttcattaagatggtgagctttggcagagattttgagcagcagctcagcttctatgtcgaaagtagaagcatgttttgcaatctcgaacctgtgctagtgcagctcattcattctgttaataggcttgccatggagacgcgaaaagtgatgaagggcaaccactcaagaaaaaccgctgccttcgttagggcctgtgtggcctattgttttattacaattccgagcctagccggcattttcacgcggttaaacctgtatctgcattccggccaagtcgccctggccaaccagtgcctcagccaggccgacgcctttttcaaagccgccatctcattagttccggaggtccccaagatgatcaatatcgatggcaagatgcggccctctgagtctttcctcctagaatttctgtgtaacttcttcagcaccctgttgatcgtgcccgaccaccccgagcatggggtgttatttcttgtgagggaacttctgaatgtaatccaggactatacctgggaggacaattcggatgagaaaattcgcatctatacctgtgtgttgcatctgctttcggccatgtcccaggagacttacctttatcatatagataaagtggacagtaacgattccttgtacggtggtgatagcaaattccttgcagagaacaataagctctgcgaaactgtgatggctcaaatcttggagcacctcaagacattagctaaagacgaagctcttaagcgacagagttccctgggattgtctttctttaactctatcctggctcacggcgatctcagaaataacaaacttaaccagctgagcgtcaacctgtggcaccttgcacaacgtcacggctgtgccgatacacggacgatggtgaagacgctcgagtatattaaaaagcaatcaaagcaacctgatatgacccatcttaccgaattagctttgcgtctccccttacagactagaacatag

SEQ ID NO: 25188 - DNA, 822 bp, Artificial Sequence
  Description of Artificial Sequence: Synthetic coding sequence
atggcccccgccggtgtcgtcactcgggctgttcgatccggcgagcttcctctgaccagtatggcgtccgcagagaatgaggcctgtgcagtaaggtctgtggcatgtcccagtcaggcttggagacttcagaaagtgctctgcgggaggtgtggcgctgcgagttgtcctagtcagacctggcgccctcgaggtgcaggctcgggcggcgtgagaatgggcagtcgtgccgatgggccgagaacaagtggacacgtgacaggtaaaatggccgtgtttccgtggcatagtcggaaccgcaattataaggcggaattcgccagctgcagactagaggccgtgccattggagtttggcgattaccaccctctcaagcctattacagtgacagagagcaaaactaagaaagtgaacagaaaaggaagcacgagttctacaagcagctcgagttcctcatcggtggtcgatcctctgagcagtgtgctggacggcaccgatccattatcaatgttcgcggcgaccgcggaccccgccgcccttgccgccgctatggattcctccagacgcaagcgggacagggacgataactcagttgtcgggtccgattttgagccttggacaaacaagcgcggagagatactggcccgctacactactaccgaaaaattatcaatcaacctctttatgggtagtgaaaaagacggtgggtacagtgaaccccgctctcggcatcggacaccagcctggaccactgagcagagttgggattgtcatattggcaacgtacgtgagggggccgaccccgctggtggtgctggctag

SEQ ID NO: 25189 - DNA, 2880 bp, Artificial Sequence
  Description of Artificial Sequence: Synthetic coding sequence
atggcacccgcaggagtggtgacccgggctgtccgaagcggcgagttgcccctgacttctatggccagcgctgagaacgaagcatgtgccgtgagatccgtcgcctgtcctagtcaggcgtggagactccagaaagtcctctgtgggcgctgcggcgccgcttcctgtccctcgcaaacctggcgaccaagaggggccggctctggcggtgtgaggatgggctccagggctgacggacctaggacatctggccatgttactggcaaaatggctgtttttccatggcatagtcgcaataggaattacaaagcagaattcgcttcctgccgactggaggcagtgcccctggaatttggtgattaccatcctctgaaacccattaccgtgacagagtcgaagacgaaaaaagtgaatcgtaaaggtagtacatcttctaccagctcaagcagcagcagctctgtagtcgacccactgagcagcgtactggatggtaccgaccctctgagtatgtttgccgccaccgcagatcctgcagccctggcagccgccatggactcctctcgccggaagcgggatcgagacgataactctgttgtggggtctgacttcgagccatggacaaacaaaagaggcgagattttagcacgatataccacaacagaaaaacttagtatcaatctgttcatgggctcagaaaagggcaaggccggtacggctactctggccatgtctgaaaaggtgaggactcggctggaagagctggacgatttcgaagagggaagtcaaaaagaactcctgaacttgactcaacaggattatgtgaacaggattgaggagctgaatcaatccctgaaagacgcctgggcttcagatcagaaggttaaagccttaaaaattgtgatccagtgctctaagctactgagcgataccagcgtcattcagttctacccatccaagtttgttctaattacagacatacttgatacctttggtaagctcgtgtatgagcgaatatttagcatgtgcgttgacagccggagcgtgctgccagatcatttctctcctgagaacgcgaatgacaccgcaaaagagacatgcctgaactggttttttaagattgcctccatacgggagctcatccctagattttatgttgaggcctccattctaaaatgcaataaattcctctctaagaccggcattagtgaatgcttgccacgcctcacctgcatgatcaggggtatcggcgaccccctggtctctgtttacgcaagagcctacctttgccgagctctgctcactgagatgatggagagatgcaaaaagctggggaataacgcactactgttgaattccgtgatgagtgcattccgcgccgaatttatcgcgacccgcagtatggactttatcgggatgattaaggaatgtgacgagtcaggcttccctaaacacttgctgtttcggagccttggactgaatctggccctggctgatccacccgagtctgatcgactgcagatcctgaatgaagcatggaaggttataaccaaattgaaaaatccacaggattatattaattgtgcagaggtgtgggtcgagtatacctgtaagcatttcactaaaagagaagtgaatacagtgttagcggacgtcataaaacacatgaccccagatcgggcatttgaagatagttacccccaactgcagctgatcattaagaaagtgatcgctcattttcatgactttagtgtgttattctccgtagaaaaatttctcccttttttagacatgtttcaaaaagagtctgtgcgcgtagaggtgtgtaaatgcattatggatgcatttataaaacaccaacaggaacccacgaaggatcccgtgattctgaatgccctgctccatgtctgtaagactatgcatgattccgtcaacgctctcactctggaggacgaaaagaggatgctgtcctaccttatcaacggatttataaagatggtgtccttcggtcgggactttgaacagcagctatctttctacgtcgaatccagatctatgttttgcaacttggaacccgtattagtgcagctcatccacgcctgtgtagcatactgctttattacaattcctagtttagctggcatttttaccaggctcaacctgtacctgcactccggtcaggtagctttggccaaccagtgcttaagtcaagcagacgcattttttaaggctgcgatatccctggtgcctgaggtgcccaaaatgataaacatagacggaaaaatgagaccttccgagagtttccttcttgagttcttgtgtaatttctttagcactctgctgatagtgcccgaccacccagagcatggtgtcctttttttggttcgcgaactgctcaatgtgattcaggactacacatgggaggataactcggatgagaaaatccgcatatacacatgtgtactccacttgttgtcagccatgtcccaggaaacatacctctaccacatcgataaggtagacagcaacgactctctatacgggggcgatagtaagtttctcgcagaaaataataaactgtgtgagactgtaatggctcagattctggaacacctgaagacactagccaaggacgaagccctgaagagacagtcttcacttgggctgtcctttttcaacagcatcttggctcacggcgacctccgcaacaataagctcaaccagctctctgtaaacttgtggcacctcgcccagaggcatggatgtgctgatacacgtactatggtaaagacactcgagtacatcaaaaaacaatctaaacagcctgatatgacacatcttaccgagttggctctgagactccccctccagaccagaacctag

SEQ ID NO: 25190 - DNA, 759 bp, Artificial Sequence
  Description of Artificial Sequence: Synthetic coding sequence
atgggcagcgagctgatcggtcgcttagctccacgcctaggcctcgctgaacccgatatgctgcgcaaggccgaagagtatctcaggctatccagagtgaaatgtgttggtctgagtgcccggactacagaaacctcatcagctgtgatgtgcttggacttggccgcgtcttggatgaaatgtcctctggaccgtgcctacttgatcaagctgagtggattaaataaagagacctaccagtcctgtctcaagtccttcgagtgcctcctggggctgaactctaacatcgggatacgtgacctggcagtgcagttttcttgtatcgaggcagtgaatatggcttccaagatactcaagtcctacgagtcctctctgccccagacccagcaggttgatctcgatttgtcccggccattgttcacctctgccgcgctgctttccgcctgtaaaattcttaagctcaaggtggataagaataaaatggtagccactagcggcgttaaaaaagccatcttcgaccgactttgtaagcagctggagaaaattgggcagcaggtggatcgggaacccggcgacgtcgcaacacctcctaggaagaggaagaagattgtggtcgaggcccctgctaaggagatggaaaaagttgaggagatgcctcataaaccccagaaagacgaggacctgacacaggattatgaagaatggaagcgcaagattctcgagaatgcagcttctgctcagaaggccactgccgagtag

SEQ ID NO: 25191 - DNA, 1071 bp, Artificial Sequence
  Description of Artificial Sequence: Synthetic coding sequence
atgggcctaatggtgagaggaggggttacctgtaggtcccaggagaggctgttaggagtgggcactggcactgctagcgcacagcctcccgtgaccgctagcccatactgttcttttaccggacgctcccgggccgacgccccagctagggcggcaggcaacgggcagcccagattgcgggcacaggtggacctgagctccgcctcctctgtgcttgtgaccgtgctcgacgccaaggcgctgcccctcaccctcctctcttggggaagtctgtgtgccacagcccaaaaccacaacaaccaggagggagcaccagctcagcctaagggttccatggctaaccagcgcgctctgcgctttcctcctccaagcggaagccctccagggctccacacacgaatgagacttacctctccaccacagcctcatttcgagccacctcctcctaccacagtgggcgcacccagatccctgcagggcgactggttcgggtccgactcgcgtgctgtcagagctctgcggcttataggctgggccagccgcagcctccacccactgcctggctcaagagaccgcgcccatcctgccgccgaagaagaagatgatcccgaccgccctatcgagttcagctccagtaaagccaatccgcatagatggagcgtagggcacaccatgggaaagggccaccagcggccctggtggaaggtgctacctctcagctgtttccttgtggcgcttatcatctggtgctacttgagggaggagtccgaggccgatcagtggctgagacaagaaggctctcggcaaccaccttttggcttcgacgtgacttttgctagagactgccctgggtacgcctgtgtccttagcacagaaggacttggatggtggatggggcacctagccatgctcatccgggtgaaggctgaacagaatttgtcacgcagtgaaaccgccccccggctggcactggacgtgcaggggtttcaccggcaggactttagcgatccctggggcaggttccagctccattgcatgctgctcgacctgccaagtctgtgtattacatag

SEQ ID NO: 25192 - DNA, 399 bp, Artificial Sequence
  Description of Artificial Sequence: Synthetic coding sequence
atgaaccgcgtcttatgcgcgccagctgccggggcagtgagggcgttacgactgataggttgggctagccgctctcttcaccccttgcctggaagcagagacagagcgcatcccgctgccgaagaggaggacgaccctgaccgtccgattgagttttcctcatcaaaagccaatcctcacaggtggagcgtcggccacacaatgggcaagggccaccaacgcccttggtggaaggtgctgccgctgagttgttttcttgtggccttaattatctggtgctatctgagggaagaaagtgaggcagaccagtggttgcgacaggtgtggggagaggttccagagcccagcgacagatctgaggaaccagagacccctgccgcctacagggcccgtacgtag

SEQ ID NO: 25193 - DNA, 399 bp, Artificial Sequence
  Description of Artificial Sequence: Synthetic coding sequence
atgggcgcaggagttggagttgcagggtgcaccagaggccaccgtaactgggtaccatctcaattgccaccgcgcgagatcaaggccggagtctcccttgccgtagttaccgaatttgcctgggtgctagctccacggcctaaaagagcaactgcttcagcattaggaacggaatccccacgattcctcgaccgccccgattttttcgactaccccgacagtgatcaagctcggttgctggcggttgctcagttcatcggtgagaaacccattgttttcatcaatagcggcagttccccaggcttgttccaccacattctcgtgggacttctcgttgtcgcattttttttcctgttgttccagttctgtacccacataaacttccaaaaaggcgcttag

SEQ ID NO: 25194 - DNA, 960 bp, Artificial Sequence
  Description of Artificial Sequence: Synthetic coding sequence
atggctcctcaacgaagggctgccactaaggcacctgagggtaacggggccgccgaacgcagaaaccgatcctctacaaagaaggatcgagcacctcgagaggtgcagaggctgtggcagcgcccctggcttcgcaccgctggtctgggagccggattcgtgttgaccgctttgcttctgtggtccagtctcggagccgatgacggtgtggctgaagtattagccaggcggggagaagttgtcgcgggaaggttcattgaggtgccatgcagtgaagattacgactctcaccgccggttcgagggctgtactccacgtaaatgcggacggggagtgactgacgtcgtaattaccagagaagaggctgagcggatacgctctgtcgccgagaagggcctgtctctgggagggagcgacggtggggcatccatacttgatctccattccggagccctatctgttggcaagcacttcgttaatctgtatcgttattttggggacaaaattcagaatattttttctgaggaggattttaggctttaccgggaagtccgccagaaggtgcagttgacgattgcagaagcctttgggattagcgccagctccctccaccttaccaaaccaacctttttttctcggatcaacagtaccgaggcgcgtacggcacatgacgaatactggcacgcccacgtggacaaggtgacctatgggtctttcgattatacctctctcttgtacctgagcaattacctggaggactttggcggaggacgatttatgttcatggaagagggtgcgaacaagaccgtggagccaagagccgggagagttagcttttttactagcggcagcgaaaatctgcacagggtagagaaggttcactgggggacccgttacgccatcacaatcgcattcagctgcaaccctgatcatggaatagaagacccagcttttccttag

SEQ ID NO: 25195 - DNA, 996 bp, Artificial Sequence
  Description of Artificial Sequence: Synthetic coding sequence
atggcgccacaacgaagagcagcgaccaaggcaccagagggtaacggagctgccgagcggcggaatcgatcaagcaccaaaaaggatcgcgctcccagggaggtacagcggttatggcagagaccctggttgagaaccgccgggctgggggccggcttcgtgttgaccgccctgctgctgtggtctagcctgggcgcagatgatggtgtagcggaggtcctcgctcgacgcggagaagtagtggcgggtaggtttatcgaggtcccttgtagtgaagactacgactcgcacagaagattcgagggatgcacaccgaggaaatgtgggcggggcgtgactgatgtggtaatcacaagggaggaagccgagagaatccgcagtgtggcagagaaaggcctttccctcgggggaagtgacggaggggcttcaatactggacctgcacagcggagccctgtctgttggaaagcatttcgtcaacctatatcggtactttggggacaagatccaaaatatattttcagaagaggattttcggttgtaccgtgaggtcaggcaaaaggttcaattgaccattgcagaagcctttgggatctcagcgagcagtctgcatcttaccaaaccgacctttttcagccggatcaattctaccgaggctcgaaccgctcatgatgagtattggcatgcacacgtggataaagtgacctacggaagcttcgactacacatccctgctttatttgtcaaactacctcgaggacttcggcggaggcaggttcatgttcatggaggaaggtgccaataaaaccgtggagccaagggccggctgcttttgcttccgcatgatgtcatgcggctttcaggaagtcaatgggccccgggccagtgaagcagcaggggctaaagccggggtccgatgccctcctgggacccatcatccaccagagcgtggtgagactcacgcaatattggaggctgaatcaatcgcctattgttag

SEQ ID NO: 25196 - DNA, 234 bp, Artificial Sequence
  Description of Artificial Sequence: Synthetic coding sequence
atggctgcgacagactttgttcaggaaatgcgtgctgtgggcgaacggctgctgcttaagcttcagaggctgccgcaggcggagcccgtcgagattgttgccttttcagttattatcctgttcaccgctaccgtactcctcttactacttattgcttgttcatgctgctgtacccactgttgctgccctgagcgtagaggtcgcaaggtacaggtgcaacccactcccccttag

SEQ ID NO: 25197 - DNA, 1578 bp, Artificial Sequence
  Description of Artificial Sequence: Synthetic coding sequence
atggcagctgccccacccctaagagatcgtttgtccttcctccacagactcccaatcctcttgaagggaacctcggacgatgatgtgccatgtcctggctacttgttcgaggagatcgccaaaatcagtcatgagagtccgggttcctcgcagtgcttgctggagtaccttttgtcccgcctccatagtagctctggacacgggaaactaaaagtcttaaaaattttgctttacctgtgtagtcacggtagctcattcttcctcctgattctgaagcgaaattccgcctttattcaggaagcggcggcctttgctggccctccagacccactgcacggaaattcactgtaccagaaagtccgagccgccgcccaggatcttggcagtactctcttcagcgacacagtgctgcctctggcaccaagccagccactggggacaccacccgctacaggcatgggttcacaggcccgaccccactccacgctccagggctttggctattccaaagagcacggtaggacagcagtccgtcaccaaccaggccaagctggcggtggatgggatgagctggatagcggcccatcctcacagaatagtagccagaattccgatctgagccgggtcagcgactccggttcgcattcaggatcggactctcactccggggcctcacgtgagccaggagacttagccgagcgcgtagaggtcgtggcattgtcagactgtcagcaggaattatctctggtgcggactgtcacgcgcgggccacgagcttttttatccagagaagaggcacaacacttcattaaggcctgtggtctcctcaattgcgaggctgtgctccaactgcttacttgccacctgcgagggacctccgagtgtacccagttacgcgccctatgcgccatagccagcctcggatcctctgatcttctgcctcaggaacacattttgctcagaacaagaccctggttgcaggaactgtctatggggtctcctggaccggtcactaacaaggctaccaaaattcttagacattttgaagcgtcctgcggccaactctcaccagcccgggggacgtctgccgaacccggacccaccgccgcgctgccagggccatcagatttgcttactgatgctgtccctctgcccggatctcaggtttttttgcagccattgtcctctactccggtgagtagccgttcaccagccccctccagcggtatgcccagcagtccggtgcctacacctccccctgacgcctcccccatccccgcaccaggcgatccatctgaggcggaagcaagactggccgaaagcaggcgctggagacctgaacgcatcccgggaggaactgacagtccaaagcgcggcccatccagctgtgcttggtctcgggactctctgtttgccggaatggagctggtggcatgccctcgtctcgttggagcgggcgccgctgccggagaatcatgcccagatgccccccgggccccccaaaccagcagtcagcggactgctgccaaagagccaccgggaagcgagccttcagccttcgcattcctcaacgcttag

SEQ ID NO: 25198 - DNA, 1326 bp, Artificial Sequence
  Description of Artificial Sequence: Synthetic coding sequence
atgggttcgcaggctcgtccccactctacacttcagggtttcgggtactccaaggagcatgggcggacaggtagtgccggggaggccttcctttctactatccagaaggccgccgaggtggtggcaagcgcgatgcggccagggccggagagccctagtactcgtcgcttgctcccccgcggcgacacctaccagcccgccatgatgccgtccgcgtcacatggtcccccgaccctcggcaatctgctgccaggcgccatacccggcccccgagctgttcggcatcagcctgggcaggccggaggcggatgggacgagctggattccggcccctcgtctcagaacagttcccaaaactctgacctgtctcgtgtctcagactcaggctcacatagtggctcggactcgcacagcggtgcctcccgggaaccaggagacctggccgagcgggtcgaagtagtggcgctgtcagactgccagcaggagctgtccctggtgaggacagtgacacggggacccagggccttcctgagccgcgaagaggcacaacactttatcaaggcctgtggtctcttaaactgtgaagctgtgcttcagctccttacctgtcacctgagaggaacttcagagtgtacccaactgcgggccttgtgcgcgatcgcgtccctggggagcagcgatctactgccacaggagcacatcttgttaagaaccagaccctggctacaagagttgtctatggggagtcctggcccggtgacaaataaggctaccaagattctgaggcacttcgaggcttcctgtggccagctcagcccggcccggggtacgtccgctgagccaggtccaacagccgcactgcccggcccttccgacctgcttacagacgcggttcccctgccaggctcccaggtcttcttgcagcccttaagttccactcctgtgagctcaagatcgcctgccccctcttccggaatgcccagtagccctgtacccaccccccccccggatgcttcgccgataccagcccctggggacccaagcgaggctgaagccagattggcagagtcacgtcgttggcgaccggagcgcatccctggcggcaccgatagcccaaagcgcggcccgtcctcttgtgcctggtccagggattccctgttcgctggaatggagctggtggcgtgtcctagactggttggggccggtgcagccgcaggcgaaagttgtcctgacgcgcccagagctccgcagactagctctcagaggacggccgccaaagagccaccaggcagcgagcctagtgctttcgcatttcttaacgcatag

SEQ ID NO: 25199 - DNA, 1074 bp, Artificial Sequence
  Description of Artificial Sequence: Synthetic coding sequence
atggagtcatctcggggcaggccgggcccagagacagacttactggccgtggcagagcatcaggccctagtgtttggagggggacccggccgaaccagcagcgagccccccgcgggactccgcgtctccggggaggaagagactgagaatgtggggggtgccaaccgtcaccctagaaccagccctaagacatcaagctgcggcgtcgtgcaccgcccagaacgtgaggcccttgaaaacgagcccggtcctcaagggactctgagcggcgcagggagccgccgcggtgcccccggcgccgagcatgaaccatccttgagctccagacacaagaatcctgcaccacctgagggcaagcccagcagtggtcgggattgtaggagaggagggcccggcgggggaatggacgttgaacagcaggaagaagaggataacgatgaagaggccgctgcaggatcacgcgctggccgttctttcagtagtaggctgcaggactcccgctcccttgacgggttatctgaagcctgtgggggcgccggctcctcaggctcagcggagagcggagccggcgggggacgccgcgcaaccatctcgagccccctggaactggagggaacagtgtcgaggcacggggacctaacacattttgtggccaataacctccagttgaaaatcaggctttccggtgcacccccaccgcccccgtccgcaccagctagaccttgccccgcccccgcacctacccctacgcccgcgatccccccaattgacccggaagtactgcgggacttggagcgactgagtcgagaattgggaggccgtgtggatagactgctccgcggcctgggaggagccgtgcaggagctgactgccctctctgtcggctgcatccagacatatcgcgatgccgtcgactcgctgggcgaggccgtggacatgagtattaagggcatgtatacactcttggctcgatgcgaagaactagaaagagcgctgcagcccgtgcaggggctggctcggcaggtcagggacattaggaggactctcgaggtgctggaggcgctgtgtaaatag

SEQ ID NO: 25200 - DNA, 342 bp, Artificial Sequence
  Description of Artificial Sequence: Synthetic coding sequence
atggccggtcccgcagctgcattccgccgcctgggtgcgctgtccggcgctgcggcccttggttttgccagttacggggctcatggagcacagttccccgacgcatatggtaaagagctgtttgataaagcaaacaagcatcactttttacacagtctagctctgctaggagtgccccactgtagaaaacctttgtgggccggacttttgctagcatcgggaacaacattgttctgcacctctttctactatcaggcgctgtccggtgaccccagcattcagaccttagctcctgctggcggaaccctgttactgttgggctggcttgcactggccctgtag

SEQ ID NO: 25201 - DNA, 564 bp, Artificial Sequence
  Description of Artificial Sequence: Synthetic coding sequence
atgtatctgcaggttgaaacccggacatcgagcaggctgcacctgaaaagggctcccggaattaggtcttggtccttgttggtaggcattctcagtatcgggctagctgcagcctactatagcggcgattctctggggtggaagttgttctacgtcaccggatgcctgttcgtggcagtgcagaacctggaggactgggaggaggccattttcgataagtccactggaaaagtggtgctcaaaacattttccctgtacaagaagctcttgacactgttccgggctggccacgatcaggtcgttgtccttctccatgacgtcagagacgtgtccgtcgaagaggaaaaggttaggtacttcggaaaaggctacatggtggtactccggcttgcaacgggctttagccaccccctgactcaatccgccgtgatgggccacaggtctgatgtggaggctattgctaaactgattacttctttcctggagctgcactgcttagaatctcccactgagctgtcacaaagtagcgatagtgaggccggcgacccagccagccagagttag

SEQ ID NO: 25202 - DNA, 672 bp, Artificial Sequence
  Description of Artificial Sequence: Synthetic coding sequence
atgtggaagccttcaccaagttcctcgcccgcttcctggagctgtactgcactacgcgctccacagtcctgcctccgcgcggccaccgttaggccagtaacccttcaggcccgggctgatagccctacagtaccagagcctgtacaccggccccaggatccatggcatataccaggcgtgcccgaacccgtgcacaggccccaggatccttggcatatccctggcgttccagaacccgttcatcgacctcaggacccctggcacatccccggcgtccctgagcctgtgcatcgccctcaagatccatggcatatcccaggagtgccagaacccgtccacagacctcaagacccatggccctggttacaactcgtgccccctgccgagctagcatactgcttgcttatgctgctgctggctcattgcatgaagcagcaggcacgacccgggcacccagacttcctccatagggaagcttgggcatgtttgagtgccgcaggtgggctggctagtcccgggctgctgctgtgggcgacagctaggccacgcgcatccggggaggccggaccgggccgagcacttgttggcgccgatgcagcttgctgtcctaggcactccgtactttctttggtggacattccctctggccaagtgcttccacaggggcagtag

SEQ ID NO: 25203 - DNA, 786 bp, Artificial Sequence
  Description of Artificial Sequence: Synthetic coding sequence
gcttggagaaggcgaagatccggaaccagcggaaaggccacatggtggtgctctgggcttaggagggcgagtccaacaccctcgcggagagtgcagagctgggcaacggccgtcatgtggaaaccctccccctcatcctccccggcctcttggagctgcacggcattgcgggctccacagtcttgcctcagggctgctacagtgagacccgtcacactgcaggcccgcgccgattccccgaccgtcccagagccagtgcatcggcctcaggatccatggcatattccaggcgtccccgaacccgtccaccgtcctcaggacccatggcacattcccggagtccccgagccagtgcaccgcccacaggacccctggcacatcccaggagtccccgagcccgtgcatagaccacaggacccatggcacattcctggagtccctgagccggttcatagacctcaggacccctggccatggctgcaactcgttccaccagccgaactcgcctattgtctcctcatgctgctcctagcccattgcatgaaacagcaggctcgacccgggcaccccgatttcttgcaccgcgaagcctgggcttgtctgtcagcagccgggggcctggcaagcccgggccttctgttgtgggctacagcaaggcctcgtgcctcaggggaagcagggccaggaagggctctggtgggagcagatgccgcatgttgtccacggcattctgtgttatctctggtcgacataccttctgggcaagtgctgccacaagggcaatag

SEQ ID NO: 25204 - DNA, 522 bp, Artificial Sequence
  Description of Artificial Sequence: Synthetic coding sequence
atgtaccttcaggtagagaccaggacgtcgtcacgcctacaccttaaaagggcacctggaatccgctcctggtccctcctggtcgatagtctcgggtggaagcttttctatgtgacaggatgtctgttcgttgcggtgcagaacctggaagattgggaagaggcgatcttcgacaagagtactggcaaggttgtcttaaagacatttagtctgtacaagaaattgctgactttgttcagagccggccacgaccaggttgtggtgctcctgcatgatgtgcgggacgtgagcgttgaagaggagaaggttagatacttcgggaagggttatatggtcgtacttcggctcgccaccggctttagccatcccctgacccagagtgcagttatgggccacagaagcgatgtggaagccatcgctaagctgatcaccagtttcctcgagttgcattgtctggaatcccccaccgaactgtcgcagtcctctgattctgaagcaggagaccctgctagtcagtcatag

SEQ ID NO: 25205 - DNA, 564 bp, Artificial Sequence
  Description of Artificial Sequence: Synthetic coding sequence
atgtacctgcaggtggagacccggaccagtagtcgactgcacttgaaacgggccccgggcatcagatcctggtcattgctcgtcggtattctttcgattgggctcgctgcggcctactactccggagactctctcggctggaagcttttctatgtcacgggctgtctattcgtagcagtacagaatcttgaggattgggaagaggctattttcgacaaaagtacagggaaagtggtgctgaaaacattcagcctttacaagaagctgttgactctgtttagggcgggtcacgatcaagttgtcgtgctcctccatgacgtccgagacgtctccgtggaagaagagaaggtcaggtactttggaaagggttatatggttgttctcaggctcgcgacaggtttttcccatccactgacacagtctgccgtaatgggccatcggagtgacgtggaagctatcgcaaagcttatcacaagctttctggagcttcattgcttagaatctcccacagagttgtcccagagctctgacagcgaagcgggagaccccgcctcccaatcctag

SEQ ID NO: 25206 - DNA, 684 bp, Artificial Sequence
  Description of Artificial Sequence: Synthetic coding sequence
atgggccaccgatcagatgtggaagccatcgcatcatccagcccagccagttggtcttgcaccgccctgcgtgctccacagtcctgtctgagggctgctaccgttcgaccagtgaccctccaagcccgagccgactcacccaccgttccagaacccgttcaccgacctcaggatccctggcacatccccggggtccctgagcctgtgcacaggccccaggatccttggcacatcccaggtgtgcctgagcccgtgcacaggcctcaggatccctggcacatccccggcgtgcccgagcctgtacacagacctcaggacccctggcacatccctggggtcccggaacccgtacacaggcctcaggatccatggccgtggcttcagctcgttccacccgccgagctcgcctattgtctgctgatgctcctcttggcgcattgcatgaagcaacaagctagacccggccaccctgatttccttcatcgcgaggcttgggcctgcttgtcagccgcaggggtgagcccagccctagactcctgctttggcccgcagcaggacctcggtcgagttgaacgcagagcaaggcctgctctcgtgggcgcagacgcagcctgttgcccacggcactcagtcttgtctctggttgatatcccatctgggcaagtgctgcctcagggccaatag

SEQ ID NO: 25207 - DNA, 828 bp, Artificial Sequence
  Description of Artificial Sequence: Synthetic coding sequence
atggatactatcctcgtgttctctctgataatcgcctcctacgacgcgaataaaaaggatcttagagattccagctgcaggcttgaacaactacccggaatctttcccaaagatgttaggtctatccgagaactgcagatgcaggagacacataccgagactaagcgcaccacctttatccagaataggactatcgctacattgcagtgcttgggatcagattccaaggtgaaggtcaacctggtgtacctggagcggcggcccaaggtcaagcatatactcaagaatcttcgaattattgccgcgcctcgcagaaactcaagcgcctcttccagctgtcacctgatccctacatcaaagtttcaaaccgggtcgctgctgaagggaaaggcattcttgcctggcataagtcagtgtaaggtccttggagccagctctgagaccttcccaaccaccgcgcctagcatcactcccggcaataaagaaggagaaaagaccacatcaacagacaccgacgagaatctcgaaaagaggcagaaatggagcatcgtcgtcaagatactgattgctgtgacactcctgttatccggtgttgccattattgtgtttgtgatctttgaggtgccttgcccgtatcagtgtctcggcgccaggaaattgtgtcagtgccagtggctttggcggtggcagaagaagggaggtcagccccctggcaccgccgaaagcaaacctgacagccaaccccagaaagttggccaagatgccgcaaattctagtaacccaaagaaggcagctgaaattacggtgatccaccagacttacttctag

SEQ ID NO: 25208 - DNA, 480 bp, Artificial Sequence
  Description of Artificial Sequence: Synthetic coding sequence
atggatacgatcctagtattcagcctgataatcgcatcttacgacgcaaataagaaggaccttagagactcctcatgccgactggagcagttacccgggattttcccaaaagatgtaagatctatccgggagttgcagatgcaggagacccacacagagactaagaggacgaccttcatccagaaccgcacgatcgcaaccctgcagtgcttgggatcagatagcaaggtgaaggttaacctggtttacctggagaggaggcccaaggtcaagcatattctcaaaaacctgaggatcatagccgccccaaggcgtaacagcagcgccagttcctcctgccatttgatacccactagtaaatttcaaacaggatcactgttgaagggtaaagtcagtatgccgcgcagccaggaagctgtacccatgccagttgtggttgaaatggctaaggaaggcaggcctgctacctgggactcctag

SEQ ID NO: 25209 - DNA, 1644 bp, Artificial Sequence
  Description of Artificial Sequence: Synthetic coding sequence
atgtcggacaacccaccaagaatggaagtttgcccatattgtaagaaaccatttaaacggctgaagtcacacctgccttattgcaaaatgatcgggcctaccatccctactgaccagaaggtgtaccagtccaagcccgccactctgccgcgcgccaagaagatgaaggggccaattaaagaccttatcaaggctaagggcaaagagttggagactgaaaacgaagaacgcaattctaagttagtggtcgataagcccgaacagacggtaaagacttttccacttccagctgtgggcctggagcgggcagcaactactaaggcagataaagatattaagaatcccatccaaccttcatttaagatgctaaaaaacaccaagcctatgaccacgtttcaagaagaaacgaaggcccaattttacgcatcggaaaagacgtcaccaaaacgcgaactggcaaaggacctccctaaaagtggtgagtcacgctgcaatccgtctgaagccggcgcaagcctgctcgtgggaagcatagagccatccttatcaaaccaagaccgtaaatactccagcactttacccaacgatgttcagactacgtctggggatcttaaactggacaagatcgacccacagcgccaggaactcctcgtgaaattgctcgatgtccccacaggggattgccacatttcacctaagaacgtcagcgacggcgtaaaaagggtcagaaccttgctcagtaatgaacgagactctaaaggcagagatcacctgtccggtgttcccaccgatgtgacagtaacggaaactcccgaaaaaaatacggaatcactaatcctaagtcttaagatgtcctccctgggcaaaatccaggtcatggaaaagcaagagaagggactgaccctcggagtcgaaacctgcgggtctaaggggaatgcagaaaagtcaatgagcgccaccgagaagcaggagagaaccgtcatgagccatggatgtgagaattttaatacgagggactccgtgactggaaaggagagccagggagagcgccctcacctgagtctgttcattccccgggagacaacttaccagttccacagtgtcagccaaagctctagccagagcctggccagcctcgccacaactttcctgcaggaaaaaaaggcagaggcacagaaccaccactgtgtgcccgatgtcaaagccctgatggaatctccagagggccagctgtcgctagagcccaaatccgatagtcagttccaagccagtcacacgggttgccagtcccccctgtgttccgcccagagacatacacctcaatctcccttcactaaccatgctgctgctgctgggcggaaaacactccgctcttgcatgggcctcgagtggttccccgaactgtaccccgggtatctgggcctgggggtcttacccggaaaaccgcagtgctggaatgccatgactcagaaacctcagctgatcagccctcagggcgagcgactgagtcaggggtggatacgatgcaacacaactatacgtaagtccggctttggcgggattaccatgcttttcactggctattttgtgctgtgttgttcctggagctttcgacgtctcaagttgcagcggtggcgcaaatag

SEQ ID NO: 25210 - DNA, 1722 bp, Artificial Sequence
  Description of Artificial Sequence: Synthetic coding sequence
atgtcagataacccaccacgcatggaagtctgtccatactgcaagaagccatttaagcgtttgaaatcccatcttccttactgcaagatgatcggccctaccatacctactgatcagaaggtgtatcagtctaaacccgctacattgcctagagccaagaagatgaaaggtcccatcaaggatcttataaaggctaaagggaaagagctggaaaccgagaatgaagaaaggaactcaaaactagtggttgataagccagaacagactgtaaaaacctttcccctgccagctgtgggactcgagcgcgctgctaccaccaaggctgataaggacataaagaaccctatccagccctcctttaaaatgctgaagaataccaaacccatgacgacctttcaagaagaaacaaaggctcagttctatgcctctgagaaaacctccccgaagcgagagctggccaaagatcttcctaaaagcggggagagtcggtgcaatccttcagaagctggagcctctctcctcgtgggcagtatagagcccagcctgtctaatcaggataggaagtattcctccaccctgcccaacgatgtgcagactacaagcggcgacctaaaattggacaagatcgatccacagagacaggagctgctggtcaaactgctggatgtgccaactggggactgccatatatccccaaaaaacgtctcagatggggtgaagcgcgttaggacgttgctgagcaatgaacgcgactccaagggccgggatcatctctctggggtccccactgatgtgaccgtaacagaaacccccgagaagaacaccgaaagcctgatactgagcctgaagatgagttctctcggaaagatccaggtaatggagaagcaagagaagggtttgactcttggagtcgaaacctgtggatcgaagggcaacgccgaaaagtccatgtcagccacagagaaacaggaacgcaccgtcatgagtcatggctgcgagaactttaatacaagggacagcgtgactggtaaagagtctcagggggaacggccacacctgagcctctttataccacgggagacaacataccagtttcattcagttagtcagagtagttctcagtccctggcaagtctggccacaacctttctgcaagaaaagaaagccgaggctcagaaccatcactgcgtgccagatgtgaaagcgctaatggaatcacctgagggtcaactgagcctggagcctaagtcagattctcaattccaagcttctcacacaggctgccagtcgcctctgtgtagcgcccagaggcatactccccagtccccgtttaccaaccacgcagccgccgccgggcgaaagactctccgctcgtgcatgggactggaatggtttcctgagctgtaccctgggtatctgggacttggcgtgctgcctggtaaaccgcaatgctggaacgctatgacgcagaaaccacagctgatttccccgcagggagaaaggctctcgcaagggtggataagatgcaacaccactattcgaaaaagcggattcggaggaataacaatgctcttcactggctacttcgtgctgtgttgttcttggagcttccgccgactaaagaagctttgccggcctttgccctggaagagcaccgtacctccatgcatcggggtggcgaaaaccacaggtgattgtcgaagtaagacgtgtctggactag

SEQ ID NO: 25211 - DNA, 1830 bp, Artificial Sequence
  Description of Artificial Sequence: Synthetic coding sequence
atgagcgacaatccccctagaatggaagtgtgtccgtactgcaagaagccatttaaaagacttaagtcacatttaccttattgtaaaatgattggccccactatccccaccgaccagaaggtgtatcagtcaaagcccgctacactgccccgcgctaagaaaatgaagggcccaattaaagacctgatcaaggccaagggcaaagagttggagaccgaaaatgaggaacgtaattcaaagttggtggtggacaagccggagcagacagtgaaaacctttcctctacctgccgtggggctggaaagagcagccactacaaaggctgataaagacattaagaacccgatccagccgtcattcaagatgctaaagaacactaagcctatgaccactttccaagaagagaccaaggcacaattctacgccagcgagaaaacaagccccaagcgggagctcgctaaagatctgccaaagtccggggaaagtcgatgcaacccaagtgaagcaggggcctccctgctagtcggctcaattgagccgagcttatccaaccaagatagaaaatatagcagtactctcccaaacgacgtgcaaactacaagcggggatctgaagttagataagattgacccgcagcggcaggaattgttggttaagctgcttgacgtgcctactggggattgccatatatctcccaaaaacgtttccgacggggtgaagcgcgtgaggacattactaagtaatgagagggatagcaagggccgggaccacctgagcggagtccccacagacgttacagttaccgagacccccgagaaaaacacagagtctctgatactctccctcaagatgtccagtctcgggaaaattcaggtaatggaaaagcaggagaagggactcaccctcggtgtagaaacttgtggctcgaaaggcaacgctgagaaatctatgtcggcaacagagaaacaggaaaggaccgtgatgtctcacgggtgtgagaactttaatacccgcgactcggtgaccggaaaggagagtcagggagagaggccccacttatctctgtttatcccgcgagaaaccacttatcagttccattccgtgtcgcagtcttccagccaaagcttggcatctctcgctaccaccttcctacaagaaaagaaggcagaggctcagaatcaccattgcgtgcccgacgtgaaagccctgatggagtctcccgaagggcaattaagcctggagccaaagtccgactcccagttccaggcttcccatacaggttgtcagagccctctatgttcagctcaacggcatacacctcagagccctttcacaaaccatgccgcagccgccggcagaaaaacactccggtcatgcatggggctggaatggtttcccgagctgtacccagggtatcttggactgggcgtgctaccaggcaaaccccagtgttggaatgccatgacccagaagccccagctgataagcccacagggggagcgcttatcccaggtgagcctgctggagcgatcctccactcacatcaggtcactagagcctcctgccggattgacgacctcgaacttttccttgatgagactgctgggggcagtccaaaagggatggatccggtgcaacacaacgattcgcaagagtgggtttgggggcataacaatgctcttcaccggttacttcgtactgtgctgctcctggagtttcaggagactcaagaaattgtgcaggcctttgccctggaaaagcacagttcccccatgtataggcgtggccaaaacaacaggcgattgtcggtctaagacctgtctcgattag

SEQ ID NO: 25212 - DNA, 1752 bp, Artificial Sequence
  Description of Artificial Sequence: Synthetic coding sequence
atgtcagacaatccaccacgcatggaagtgtgcccttactgtaagaaaccttttaagcgccttaaatctcatctgccttattgtaagatgattgggcccaccattcccacggaccagaaagtgtatcaatccaaacctgctaccctgccccgcgccaaaaagatgaaggggcccatcaaagacctgatcaaggctaaagggaaggagctggaaacagaaaatgaggagagaaatagcaagctcgttgtcgataagcccgaacagacagtaaagacgttccccctcccagctgtaggccttgagagagcggctaccacaaaagctgacaaagacatcaagaaccccatacaaccttcatttaaaatgttgaaaaatacaaaacctatgacaactttccaggaggaaactaaggcccagttctacgcttctgagaaaacatctccaaaacgtgaactcgccaaggacttaccgaagtctggggagagcaggtgcaacccctcagaggccggcgctagcctcctggtaggctctatcgagccctctctaagtaatcaagaccgtaagtactcttctaccctccccaatgacgtgcagaccactagcggagacctgaaactggataagatcgaccctcagagacaagagttgcttgtgaagttgctggacgtgccaaccggcgattgtcacataagccccaaaaatgtctctgacggcgtaaagagggtgaggacactgctaagtaatgagcgcgactcaaaagggcgggatcaccttagcggagttcctactgacgtgacggtgacagagacacccgagaagaacacagagtccttgatactgtcactgaaaatgagcagtttggggaaaattcaagtcatggagaaacaggagaaaggcctcacccttggggtggagacctgcggctctaaagggaatgccgagaagtccatgagtgccaccgaaaagcaggaacgcacagtgatgtctcacggctgtgagaactttaatactcgagacagcgtcaccgggaaggaatcccaaggtgagcggcctcatctgtccctgtttattcccagagagactacttaccaatttcatagtgttagccaatcttcttcccagagtctggcaagcctggccactaccttcttgcaagaaaagaaggccgaagcacagaaccatcactgcgtcccagatgtgaaggcactaatggagagtccagaaggacagctctccctagagccaaaaagcgactcacagttccaagctagccacaccggctgtcagtctcccctgtgctctgcccagcggcataccccacagtccccctttacgaatcacgctgctgctgccggacgcaaaacccttagatcgtgcatggggttagaatggtttccagagttgtacccaggatacctgggactgggagtattgccgggaaaaccgcagtgttggaatgccatgacgcagaagccccaactcatttccccccagggagaaagactttcccaggtgagtctgctggaacgcagtagcacacacattaggagcctagaaccaccggcaggattgactacatccaacttttcactgatgcggttactgggggctgtgcagaagggatggatcagatgtaacactaccatcagaaaatcaggcttcgggggcatcacaatgctgttcaccggatattttgtactctgttgctcatggagcttccgaaggctcaaactgcaaaggtggcgaaagtag

SEQ ID NO: 25213 - DNA, 1740 bp, Artificial Sequence
  Description of Artificial Sequence: Synthetic coding sequence
atgagcgataaccccccccgcatggaggtatgcccgtactgcaaaaagcccttcaagcgcctgaaaagccacttaccgtactgcaagatgattggaccaactatacctacagaccagaaggtgtaccagtctaagcctgcaactctgcccagagccaagaagatgaaagggcccatcaaggatcttatcaaggcaaaaggaaaagaacttgagactgaaaacgaggaaagaaattctaagctggtcgtggacaagccagagcagacagtcaaaaccttccccctgccggctgtgggtctagagagggccgctactactaaggccgacaaggacatcaaaaaccccattcagcctagctttaagatgcttaagaacacaaaaccaatgaccacattccaggaagaaacgaaagcccagttctatgcctctgagaagaccagcccaaaacgtgaactggcaaaggacctaccaaagagcggagaatctagatgcaatccctctgaggcaggcgccagcctactcgtgggctcgattgaaccaagtctctccaaccaagacagaaaatactctagtacacttcctaacgatgtgcaaacaacctccggagatctgaagctggataagattgatccacagcgccaggagctccttgtaaaattacttgatgtgccaacgggagattgccacatcagtcccaagaatgtctcggatggcgtcaaaagggtacggactcttctgtctaatgagagagactcaaagggccgggaccatcttagtggagtccccacagacgtcactgtgactgagacccccgagaagaataccgagtctttaattctttcgctgaagatgtccagtcttggcaaaatccaggtgatggagaaacaggaaaagggcttgacattgggcgtggaaacttgcgggagtaaggggaatgctgagaaaagtatgtctgcaaccgaaaaacaggagagaactgtcatgagccacggatgcgagaattttaatacgcgggacagtgtcaccggaaaggagtcccagggagaacgaccacatctgagcctcttcatcccacgcgaaaccacgtaccaatttcacagcgtttcccagagttcctcacagtccctggcatccctggccaccacatttttgcaggagaaaaaggccgaagcacagaaccaccactgcgtaccagacgtgaaagctcttatggaaagcccagaggggcagttaagtctcgagccaaagtcagatagccagttccaggcctcccatactgggtgtcagtctcctctgtgctcagcacagaggcataccccacagtccccctttaccaaccacgcggccgctgcaggaaggaaaacactacgatcctgtatgggccttgaatggttcccagagctctatcccgggtatcttggccttggggtgctgccagggaagccccagtgctggaacgccatgacccagaaaccacagctcatttctcctcagggtgaaaggttgagccaggtgagtctgctcgaacggtcttctacacacatcaggtctctggagccaccagcaggactgaccactagtaacttttcccttatgagattgttaggggctgttcaaaagggatggattcgatgtaatactaccatacgtaaaagcggatttggcggcatcacaatgctgttcactggatactttgtcttatgctgcagctggtcctttcgccgcctcaccctccaatag

SEQ ID NO: 25214 - DNA, 225 bp, Artificial Sequence
  Description of Artificial Sequence: Synthetic coding sequence
atgtcggcaaacggagccgtgtggggtagagttcggagtaggctgagagcatttcctgagaggcttgccgcatgcggcgccgaggccgccgcctatgggagatgcgtgcaggcatccaccgcaccaggcggacggctgtcaaaggacttctgcgcaagggagtttgaggcgcttagaagctgcttcgccgccgctgcgaagaagaccctggaaggtggttgttag

SEQ ID NO: 25215 - DNA, 444 bp, Artificial Sequence
  Description of Artificial Sequence: Synthetic coding sequence
atgttgctgcgccgagtagtggaaggcgggagagcggtggccgctgcagtgaggggctcaggggcgcgtcggtttagtagccccgattgctgccagcggctacccggtggtggatcttttctgcagcggcatcaccccggagcgcaggcaccagacggtcggaggaaattcggaacggatcacgtcgaggtgggttctcaagccggagctgacgggacgcggcccccaaaagcatccctgcctccagagttgcagccccccacaaactgttgtatgtcgggatgtccaaattgtgtgtgggtggaatacgcagataggcttcttcagcattttcaggatggtggtgagcgggccctcgcagctctcgaagagcacgtagctgacgagaacttaaaagcttttctccgtatggagattcgcctgcacacaaggtgcggcggttag

SEQ ID NO: 25216 - DNA, 633 bp, Artificial Sequence
  Description of Artificial Sequence: Synthetic coding sequence
atggtggctgacatcaagggaaatgaacaaatcgaaaagtactcctggagggaagcctgcgataccgggagctcccgaatggaccggaaacacggaaaatacatcctcaatgtggagcacagcgagaaccagccgcctataacacatccaaatgatcaggaggcgcatagctcaatttgttggtgtcttccttcaaatgacatcacttcggacgtctcccccaatctgaccggggtgtgtgttaatcctggcatcctcgcgcattctaggtgcttgcaatcagaatcttgcaatacccaggttaaggaatattgcagaaacgattggtccatgtggaaagttttcttggcctgcctcctggcatgtgtcattatgaccgccatcggtgtgctaatcatttgcttggtgaacaacaaaggttcagcgaactcgtctatagtgatccagctgtccacaaacgacggcgagtgcgtgaccgtgaaacccggcacgcccagtcccgcatgcccccccaccatgaccaccacaagtacggttcctgcaagcacagccacagagagtactaccagtaccgccacggctgccacaacctcgactgaacccatcactgtggcacccacagaccacctgtag

SEQ ID NO: 25217 - DNA, 306 bp, Artificial Sequence
  Description of Artificial Sequence: Synthetic coding sequence
atggatcagtatgtcagtacagcccctccgcggtttccaatcgcacagttgggcacttttaagcaggacagcgccggaatgggtagaatttttaagggtaacctacttcagaaaaaagcactgactacctttgagaatgagcatcacatccggttcttcacattactggtactttttcacgtgatggtgctgttgcgaaatcactcccgcattcaaggggtctctgaagactggaagcgcgctaactccatttttcggaacttcctgcgtcttaaatcttctcgcaatacagccgaagccgagtag

SEQ ID NO: 25218 - DNA, 306 bp, Artificial Sequence
  Description of Artificial Sequence: Synthetic coding sequence
atggaccagtacgtctccactgcaccccctaggttcccaattgcacagttagggacatttaaacaggacagcgccggaatgggcagaatctttaagggcaatctgctacagaagaaagccctcaccaccttcgagaacgagcaccatatcagattcttcaccctgctcgtcctgttccacgttatggtgctcctcaggaatcattcacgaatccagggcgtgagcgaagactggaagcgtgcaaatagtatattcaggaattttctgcgcctcaagtctagccgaaacacggctgaggccgagtag

SEQ ID NO: 25219 - DNA, 648 bp, Artificial Sequence
  Description of Artificial Sequence: Synthetic coding sequence
atggataaagtgcaatccggattcttaatcctgttcctttttctgatggagtgtcaactacacttgtgtctcccatatgccgacggcctccacccaacaggtaatatcacaggcctccctggaagcaagcgctctcaaccgcctcggaacattaccaaggagccaaaggtgttttttcacaagacacagcttcctggtatccagggtgcagctagcaggtccactgctgcgagccctaccaatcctatgaaattcctcaggaataaggcaatcattagacaccgaccagctctcgtgaaagtaattctgatcagttcagtcgcgttctcaatcgcattaatttgtgggatggcaatttcatacatgatctaccgtttggcccaggccgaagagcgccagcagttggaaagtctgtacaaaaacctccgaattcccctgctaggcgacgaagaggagggttccgaagatgagggagagtctacacatctccttcccgagaacgagaacgagttggaaaagtttattcacagtgtgatcattagcaaaagatcaaaaaacatcaagaaaaagctcaaagaggaacagaattccgtcacagaaaacaaaacaaaaaacgcttctcacaacggcaaaatggaggacctctag

SEQ ID NO: 25220 - DNA, 2178 bp, Artificial Sequence
  Description of Artificial Sequence: Synthetic coding sequence
atggccactgccgctacaacaactactacaactacagctactgtggcgctcaccacatcctgggataacgctaccgggaggcctacagcagaacccgatcctattcttgataattatgtcttgctggtagtcgttatgtcccttttcgtcggcggcaccctggtggtgctgagcggagtcttgctactctgcaagaggtgctgggatgtgcatcagcggcttaatcgagcgatggaggaagccgagaagacaactacaacctacctggacaacgggacgcatcccgcccaggaccctgactttcggggtgaagacccagagtgccaagatgcggaaactgagcgctttttatctacctcctcgaccgggcggcgggttagcttcaacgaggccgctctattcgaacagtcacgcaaaacccaggacaagggccggcaggggggttggcaatctaccgctgccggtgcctcaggcatgggtggaggacgcgctcttatggcacggtgttgcagacgctatacactgaccgagggcgattttcaccacctcaaaaatgctaggctgacccatctccacctgcctcctctcaagatcgtaaccatccatgagtgcgacagcggcgaggcatcctccgcaacaacaccacatccagctaccagtccgaaggccacgctggccattttccagccacccggcaaggctctgactgggagatcagttgggccctcttcagctctgcctggcgacccctataatagcgctgcaggagctacagattttgcagaaatttctccttcagctagttccgatagcggggaaggaacgagtttagacgccgggacgcggagcacaaaagccgggggtcccggagccgctgcaggaccaggggaagcaggtcctggatccggtgccggtaccgtgctccagttcctgacgaggctccggcggcacgcaagcctggatggtgcatctccatacttcaaagtcaaaaaatggaaacttgagccaagccagcgagctgcatccctggacacccgggggtccccaaagaggcaccactttcagcggcagcgggccgcttccgagtctaccgaacaggaagaaggagacgctcctcaggaggatttcatacagtacatagcacgcgccggagacgccgtggcctttccgcacccacgtccgttcctcgccagcccaccaccagctctgggccgccttgaggcagctgaggccgccggtggcgcatcacccgatagccctccagaacggggagccggatctgcaggtcccgaacaacaacagccgcctctcgaaccagacgccgagagggacgccggaccagagcaggcgcagacttcatacagagacctctggtctctgagggcatcactggagctccacgctgctgcgtcggaccatagcagttccgggaacgatcgggactctgtaaggagcggggactcatccggaagtgggagtggcggagcagcgcccgcattcccgcctccatcaccccccgccccacggcccaaggacggcgaggctcggcgcctgttacagatggattccggctacgccagcattgaagggaggggggcgggagacgatactgagcctccggcagcccctgccagacctagatcccctcgagcctggcccaggagacctaggcgagattactcgattgatgagaagactgatgcactttttcacgaattccttaggcacgacccccacttcgacgatactcctgctgcagcccgacatcgggccagagcacatcctcacgcgaggaaacagtggcagaggggtaggcagcacagtgaccctggcgcgcgggccgcccccgctcttgccggcactcccgccccacccgcaggcgcagctcgaccagcaagggcacccctgcgacgcggggacagcgtggatggccctccagatgggcggactttgggcggagccggtgacgaccctgctattcccgtaattgaggaagagccgggcggcggaggatgcccaggctctgggctgtgcgtactgccgtctggttcagttctggacaaactcgcagccggtctggacgagagattgtttcctccccgtctggccgagccagtggttgccactccagccctggtcgccgccgcccctacttcaccagaccacagccctgcatag

SEQ ID NO: 25221 - DNA, 693 bp, Artificial Sequence
  Description of Artificial Sequence: Synthetic coding sequence
atgccttggaccattttgctctttgctgcagggtccctggctatcccagcgccctctattcggctcgttccgccgtatccatcctctcaggaggaccctatacacatcgcttgtatggcacctggcaattttccaggcgcgaacttcaccctctaccgcgggggtcaggtggtgcagctactgcaggctcccacagaccagaggggcgtcacttttaacctctcgggtggatcatctaaagcccctggaggtccatttcactgccagtacggagtactgggcgagctgaatcagtctcagctgagcgatttgtccgagcccgtgaacgtctcctttcccgtgcccacatggatactcgtcttgtcactttccctggccggcgcactgttcctgctcgccggactggttgcagttgcgttggttgtgagaaaggtcaagcttcgaaaccttcagaagaagcgcgatcgagagtcctgttgggcccagattaatttcgatagcacagacatgtcatttgataacagcctgttcacagtatccgccaagaccatgcctgaggaggatccggcgacactcgatgaccactcgggaaccactgccacaccctccaatagccgcacaagaaagcggccaacctcaaccagttcatcccccgaaacaccggaattcagcacgttccgggcatgccagtag

SEQ ID NO: 25222 - DNA, 1215 bp, Artificial Sequence
  Description of Artificial Sequence: Synthetic coding sequence
atggccctgtcgctgcctcttgggcccaggctcggtagtgagccacttaaccatccgcctggggcccctagggaagccgacatagtggggtgcaccgtatgccctgcctcaggcgaagaatctaccagtccggaacaagctcagaccctaggtcaggattctctgggaccccccgagcacttccagggggggccccggggaaatgaaccggctgctcacccacctaggtggtccactccaagctcttacgaggacccggcggggggtaagcattgcgaacaccctatctccgggctggaggttctcgaggcagaacagaacagtctgcatttgtgtttacttgggctaggcagacggttgcaggatcttgaacaggggctaggccactgggcattagcacagtccggcatggtccaattacaggctcttcaggttgacctccgtggcgcagccgagcgcgttgaagccttgctagcttttggcgaggggttggctcaaaggtccgagcctcgtgcgtgggccgccctcgagcaaatcctgagggctctcggagcataccgggactctatatttcgacgactgtggcaacttcaagcgcagttggtcagctatagtttggtgttcgaagaggcaaacacattggatcaggacctggaagtagagggggacagtgactggcccgggccagggggagtgtgggggccatgggccccttccagtctgcccacatctacagagttagagtgggaccctgccggagacattggagggttgggcccgctgggacagaagacagctcgaacacttggtgtaccctgcgagctttgtgggcagcggggcccacaggggaggggtcagggcttggaagaggcagatacctcccactcaagacaagatatgttggaatccggcctcggtcaccagaagagactggctaggcatcagagacactcgctgttacggaaacctcaggataagaaacggcaggcttcacctcacctgcaggatgtgagactcgaaggaaacccaggagctccagatcccgcaagccggcaacccctcactttcctgctgattctgtttctgttatttctcctgctcgtgggagccatgtttctcctaccggcgtccgggggtccatgttgcagccacgcacgtataccaagaactccttatctggtgctgagttatgttaatggtctgccccctgtgtag

SEQ ID NO: 25223 - DNA, 876 bp, Artificial Sequence
  Description of Artificial Sequence: Synthetic coding sequence
atggccttgagccttccactggggcctcgattgggatcagagcctctaaaccaccccccaggcgctcccagggaggcagatatagtaggatgcactgtgtgccctgcctcgggggaagaatccacaagcccagagcaggcccagacccttgggcaagatagtctgggtcccccagagcatttccaaggaggccctagaggaaatgaaccagctgctcatccgcctcggtggagcacccccagttcttacgaggaccccgccgggggcaagcactgtgaagtgtttgaggaggctaatacattggatcaagaccttgaggtcgaaggggacagcgactggcctggcccaggcggcgtctgggggccatgggctcctagcagtctgccaacatcgactgaactggagtgggacccagctggcgatatcggggggctggggcccttgggccagaagaccgctcgaaccctgggagtgccatgcgaattgtgtggacaaaggggtccacagggcaggggacaaggcctggaagaggcggacacatctcactcccgccaagacatgctggaatctgggctgggccaccagaagaggctcgcccggcaccaaagacactccctgctgcgtaaaccacaggataaaaagagacaggcatccccccacttgcaagatgtcaggctagagggcaatcctggcgcacccgaccccgcaagtcggcagcctctcaccttcctcctaatccttttcctgctctttttgttgctcgtcggagccatgttcctgctcccagcgagtggcgggccgtgctgttctcatgccagaatccctcgcacgccatacctggtactcagctatgttaatgggctgcctcccgtctag

SEQ ID NO: 25224 - DNA, 564 bp, Artificial Sequence
  Description of Artificial Sequence: Synthetic coding sequence
atggaggtggaggagatttataagcatcaagaggtcaaaatgcaggccccggctttcagagacaagaagcagggggtgagcgccaagaaccaaggggcgcatgatcccgattacgagaatataaccctggcctttaaaaaccaagatcacgccaaggggggtcactccagaccaaccagtcaggtaccagctcagtgtcgaccacctagcgactctacccaggtgccatgctggctgtatcgagccattctgagcctatatatcctcctcgcgctggccttcgtgctgtgcatcattctgagcgctttcatcatggtcaagaatgctgagatgtctaaagagcttttaggattcaaacgggagctgtggaacgtgtctaattccgtgcaggcctgtgaggagaggcagaagcgagggtgggactctgtgcagcagagcataaccatggtcagaagcaaaatagaccgtttggaaaccacattagctgggattaaaaatattgatactaaagttcagaagatactcgaggtgctccagaaaatgccccaaagttctccacagtag

SEQ ID NO: 25225 - DNA, 357 bp, Artificial Sequence
  Description of Artificial Sequence: Synthetic coding sequence
atggtagctcgcgtatggtccctaatgagatttctcattaaagggtctgtggcgggcggggcggtgtacctagtgtacgatcaggagctgctcgggccctccgacaaaagccaagctgcactgcaaaaagccggcgaggtggttccgcctgctatgtatcagttctcccaatacgtgtgccagcagactggcttgcagatcccccaactgcccgctcctccaaaaatatacttcccgattagggactcttggaacgccggaatcatgactgtgatgtccgcactgtcagtcgcccctagcaaagcccgagagtacagcaaagaaggatgggaatacgtgaaggcccgaaccaaatag

SEQ ID NO: 25226 - DNA, 594 bp, Artificial Sequence
  Description of Artificial Sequence: Synthetic coding sequence
atgctccccttacttcagctcgtgccagccaagctacttaattctagctgtagccttgaaaaaacactccaatgctcatgtagtttccacggtatccctaccccatccgtccagtggtggatgggtggcgtccccgttggggttgatggcatggacggttccctgcaagttacctctacaatgttgggaccctgggcaaacagcactatctccctgacagaagagccagagatgggaatgcgactgctttgtgaaggcaagaatcagaacggaacccacgctctgagcatcctcctgatgtcaagaaagagttctctcgccgcgcaggccttcgtcaagggcctcattcaaggggccatttatgcaggaattgtgatcgcactgctgtttctatgcctgctgcctttgattgtgaagcacataaggaaaaaacaggcgaagaaagccgcagcaatccgggccaaaaagtcttccaaggtccgggcatctcaagagttagaaatgtcccttaagccggaggaacccggtaagccagtagtcgcgactttcagcgagtccaggatccttgaaaaacaggataaaagagccagttag

SEQ ID NO: 25227 - DNA, 513 bp, Artificial Sequence
  Description of Artificial Sequence: Synthetic coding sequence
atgagaagacgcctatggttgggcctggcgtggctccttcttgcaagggcgcccgatgctgccgggacaccatcagcgtcccgcgggccaagaagctacccccatctcgaaggagacgtccgatggaggcggttgttctcaagtacgcattttttcctccgagtcgaccctggaggtagagtccaggggacacgatggcgacacggccaggatagcatcctagaaataagatctgtgcacgttggagtggtcgtaatcaaagctgtatcatccgggttctacgtggctatgaatagaaggggaagattgtatggatctcggctgtacaccgtcgactgtcggtttcgagagcgcatcgaagaaaacgggcacaatacttacgcctctcaaaggtggagacgtcgtggtcagccgatgtttttggcacttgatagacggggaggcccaaggccgggaggtcgcacccgccgttaccacctgtccgcgcacttccttccagtactcgttagctag

SEQ ID NO: 25228 - DNA, 1116 bp, Artificial Sequence
  Description of Artificial Sequence: Synthetic coding sequence
atggcgtggactaagtaccaacttttcttggccgggctcatgctggtcacaggttccataaatactctgtcagcgaaatgggctgataatttcatggcagaaggatgcggtgggagcaaagagcactctttccaacacccgtttctgcaggctgtcggtatgttcttaggcgaatttagttgtctggccgcattctacctgctgaggtgtcgagctgctggacaatccgactctagtgtagatcctcaacagccattcaacccactgctgtttttgccacccgctctgtgcgacatgacaggcacatcccttatgtatgtagcactcaacatgacttcagcctcttcgttccagatgctgcggggggctgtgattatatttaccggattgttcagtgtggccttcctcggccggagactggtgctgagtcagtggctgggtattctcgccaccattgccggtttagttgtagtcggcctggcagaccttctgtcgaagcacgacagccagcataagttaagcgaggtgatcacaggcgatttgctcattatcatggcccagatcattgtggccatacagatggttttggaagaaaagtttgtttacaaacataacgtccaccccttgcgggcggtagggacagaagggctgtttgggttcgtaatcctgtcactactcctggtccctatgtattacatccctgctggaagtttttctggaaatccacgcggaacccttgaagacgctcttgacgcattttgccaagtcgggcagcaaccactgatcgccgtggcgctgctcggcaacatctcaagcatagcctttttcaattttgctggcatcagcgtcaccaaggaactcagcgctaccactaggatggtgctggacagtctcagaaccgtggtcatttgggcgctatctttggcattgggttgggaggcttttcacgcccttcagatattggggtttttgatactactcatcggaaccgccctgtataacgggctccatagaccactgcttggacggctgtcccgcggtcggccgctcgctgaggaaagcgaacaggagcgtctcctcggcgggacacgcaccccgataaacgatgcaagctag

SEQ ID NO: 25229 - DNA, 867 bp, Artificial Sequence
  Description of Artificial Sequence: Synthetic coding sequence
atgggggggcagttccatggccgtgggctatggcgcgaacagggggctcagctgcctgcctcactgccccctgccttgaacatgacctcagctagttcatttcagatgctcaggggagccgtgatcatcttcaccggcctctttagtgttgcattcctggggcgaaggctggtcctgtcacagtggctcggcattctcgccaccattgcaggactggtcgtggttggtctggctgacctccttagcaaacatgattctcaacataaactttccgaggttatcacaggagatctgctgattattatggcccagatcattgttgcgattcagatggttctggaggagaagtttgtgtataagcacaacgttcatccacttagggctgtgggcacagagggactctttgggtttgtgattctgagcctacttttggtgccgatgtattacattcctgctggatcattctccgggaaccctaggggcaccctcgaggatgcgctggacgctttttgccaggtgggccagcagccgcttattgccgtggcattactcggcaacattagtagcattgctttttttaattttgcaggcatcagcgtgaccaaggagttgagcgctaccactcgcatggtattggattctctacgaacggtcgtcatctgggcccttagtcttgccttagggtgggaggccttccacgccttgcaaatcctaggattccttattctccttattgggacagcattgtataacggccttcaccgccctttgctcgggcgcctctccaggggccgcccactggcagaagagtccgaacaggagcggctgctggggggtacgaggacacctattaatgatgcatcatag

SEQ ID NO: 25230 - DNA, 855 bp, Artificial Sequence
  Description of Artificial Sequence: Synthetic coding sequence
atgaagacttccgcagagctgcacgaacaggagaagcccccatcctcaccaagagctaccggacccgggcggctggggcacgctagagggagagggcccgacgccttgcgcggcggtgccgccggccctggtcgggcttctagcggtgccccacgggaacggaagatggccccacatgatcccggttctctaacaacgcttgtgccgtgggcggcagctttactgctggccctgggcgtcgaacgcgcgttggctctgccagagatttgcacacaatgccccggcagcgtgcaaaatttatctaaagtggccttctattgcaagacaacccgggaactcatgcttcacgctagatgctgcctcaaccagaaaggcaccatcctgggacttgatctgcagaactgtagtctggaggatcccggaccgaatttccatcaggcgcacactacggtcattattgacctgcaggctaatccccttaaaggcgatctcgcaaatacattccggggcttcacccagctgcagactctgatcctaccacaacatgtgaattgccctggggggatcaatgcttggaatacaattacaagttatatcgataatcagatttgtcaaggccaaaagaacctctgtaacaatacgggagatcctgagatgtgccccgagaacgggagctgtgtgcccgacgggcccgggctgctccagtgtgtttgcgctgacggctttcacgggtataagtgcatgcgccagggctcattctccttgctgatgttttttgggatccttggtgcaaccacattgtctgtaagcattctgctctgggctactcaacggcgaaaggctaaaacaagttag

SEQ ID NO: 25231 - DNA, 516 bp, Artificial Sequence
  Description of Artificial Sequence: Synthetic coding sequence
atgctgcacgcccgctgttgcctaaaccaaaagggcacaatcttggggctggatctgcagaattgctcactggaggatcctggccccaactttcaccaggctcatactaccgtcatcatcgatctgcaggccaacccgttaaagggcgatctcgcaaacacattccgagggtttacacagctccagactttaatactgccacaacacgttaattgccctggagggatcaacgcctggaacactatcacctcatatatagacaatcaaatttgccagggtcagaagaatctgtgtaacaatacaggagatccagaaatgtgcccagaaaatgggtcatgcgtccccgatgggcctggacttcttcagtgcgtctgtgctgacggttttcatggctataagtgcatgagacagggttcattcagtctactgatgttcttcggcatcctcggcgcaactaccctgagcgtgagtatcctcctatgggccacacaacgtcggaaagctaaaacgagctag

SEQ ID NO: 25232 - DNA, 228 bp, Artificial Sequence
  Description of Artificial Sequence: Synthetic coding sequence
atgctccacgcccgctgctgtctcaaccagaagggcaccattctggggctggatctccagaactgcagtctcgaggatcccgggcccaatttccatcaagctcacacaacggtaattatcgacctccaggctaaccctcttaaaggcgatctggctaatacgttcagaggatttacacagttgcagacccttatcctaccgcagcatgttaactgtcctggaggctag

SEQ ID NO: 25233 - DNA, 876 bp, Artificial Sequence
  Description of Artificial Sequence: Synthetic coding sequence
atggcactcgccgcgcggctacttccccaatttttacactcgagatccctgccttgcggcgcagtccgcctgcggactcccgccgtggccgaggtgcgcctcccctcagcgaccctctgttacttttgtcgctgtcggctaggactgggcgccgcgctgttccctcgttcagcgcgggcactggccgcatccgcgctgcccgcacagggctcacgctggccagtgctgtctagtcctggcctacccgctgctttcgcctcattccccgcctgtcctcagagaagctatagtactgaggaaaagcctcagcagcatcagaaaaccaagatgatagtgctgggtttcagcaaccccattaattgggtcaggactcggattaaggccttcctgatatgggcgtactttgataaggaattctctatcacagaattctcagaaggcgcaaagcaagcctttgcccatgtgtcaaaactcctctcccagtgcaaattcgatctcctggaggagctcgtggcaaaggaggtgctacatgcactgaaagagaaggtgactagcttgcctgataatcacaagaacgccctggccgcaaacatagacgagatcgtgttcacaagcacaggtgatatctctatctactacgatgagaaggggcgcaaatttgtgaacatactgatgtgcttttggtacttgacatccgccaacataccttctgagaccctgagaggggcatccgtgttccaggtgaagctgggaaaccagaacgtggaaaccaagcaactcctttcagcgtcttatgagtttcagcgcgagtttacccagggggtgaagcctgattggaccatcgctaggatcgaacactccaagctgttggagtag

SEQ ID NO: 25234 - DNA, 876 bp, Artificial Sequence
  Description of Artificial Sequence: Synthetic coding sequence
atggcactcgcagcacggctgctccctcaatttttgcactctcgctcattaccctgtggagccgtcagactccggactccagctgtcgccgaggtacgcctgccttccgcaaccctgtgctatttctgtagatgcagactggggctgggcgccgctctgtttccccgcagtgcccgcgccttggctgcttccgcactgccagcccagggttccaggtggcctgtgctgagcagccccggtctgcccgcggctttcgcatcgttccccgcgtgtccgcagcggtcttatagtaccgaagaaaaaccccaacagcatcagaagaccaagatgatagtgctgggattttcgaatccaattaactgggtgcgcactcgcattaaggcttttctgatctgggcgtatttcgataaggagttttccataacggagtttagcgaaggcgctaaacaggccttcgctcacgtatccaaactgctttcacagtgtaagttcgaccttctggaggagctggtagctaaagaagtattgcacgctctaaaggagaaggttacttctctccctgacaaccacaagaatgctctggccgcaaatatcgacgagattgtttttacgagcaccggtgacatctccatctactatgacgagaaggggcgcaagtttgtgaacattttgatgtgcttttggtacctgaccagcgcaaatattccctccgagactctgaggggcgctagcgtgttccaggtgaagctgggtaatcagaacgtggagaccaaacagctcttgtcagcctcttacgaattccagagagaattcacccagggggtcaaacctgactggactattgccagaatcgaacactccaagttgcttgaatag

SEQ ID NO: 25235 - DNA, 1326 bp, Artificial Sequence
  Description of Artificial Sequence: Synthetic coding sequence
atgtctgtgctgctgcgcagcggcctgggcccattatgcgctgtggcacgggctgctattccattcatctggagaggaaagtacttttccagcgggaatgagccggctgagaatcctgtgactccgatgctgaggcatctgatgtacaaaattaaatccaccgggcctattactgtagctgaatacatgaaggaagtgctgaccaacccggcaaaaggctactatgtttaccgagacatgctaggggaaaagggtgactttatcactagtccagaaatctcgcagatctttggagaactcctcggcatctggttcatctcagagtggatggcaactggtaagagtacagcttttcagctcgtggaactgggaccagggagaggtactctggtgggtgatatactgcgcgtgtttactcaactaggcagcgtcctcaagaattgtgatatttccgtgcaccttgttgaagtgtctcagaagcttagcgaaatccaagctctgacactcacaaaggagaaagtgcctctggagaggaacgcaggctcccccgtctatatgaaaggcgttacaaagtcggggatccccatatcctggtaccgcgatctgcacgacgttccaaaaggatattctttttacctggcccacgagttctttgatgtcctacctgttcacaaatttcaaaagactcctcagggctggcgcgaagtgtttgtcgatatagacccccaggtctcagataagctgcggtttgtgttagctccttcagctacaccagccgaggcatttatccagcacgacgagactcgcgaccacgtagaggtatgccctgacgctggagtgattattgaagagttgagccagcggatcgccttgactgggggcgccgccttggtcgctgactatggccacgatgggaccaagactgacacatttcgtggcttttgtgaccacaagctgcacgacgtcttgattgccccaggaacggcagacttgacagcagacgtcgattttagctatctccgccgtatggcccagggaaaggtggccagcttaggaccaattaaacaacacacattcttgaaaaatatgggcatcgatgtaagactaaaggtgctgctagacaaatccaacgaacctagtgtccggcagcagctgttacaagggtatgatatgctgatgaaccccaaaaaaatgggagagcggttcaattttttcgcactgttgcctcatcagcggctgcagggggggcgctatcaacgaaacgccaggcagtctaagcccttcgcttccgtggtggcaggtttcagtgagcttgcctggcagtag

SEQ ID NO: 25236 - DNA, 1593 bp, Artificial Sequence
  Description of Artificial Sequence: Synthetic coding sequence
atgcaccctggtcggaccacaggtaaagggccttccacccatacccagattgaccagcagcccccccgcttgctcatcgtccatatcgccctaccaagctgggcagatatctgcaccaatctgtgcgaggccctgcagaattttttttctctggcttgctctctcatgggcccctcgaggatgagccttttctccttgtatatggtgcaggaccagcacgagtgcatcctgcccttcgtgcaagtgaaaggaaactttgccaggctgcagacatgcattagcgaactgaggatgctgcagagagaagggtgcttcagatcacagggggcaagcctccgcctggcggtcgaggatggtctgcaacaattcaaacagtactctcgtcacgtgacaacccgcgccgccctgacctatacttccctcgagataacgattctgacaagccagcccggtaaagaggtggtcaaacagctggaggagggactcaaagacactgatctcgcccgggtgcgacgattccaggtggttgaggtgaccaaaggcatcctcgagcatgtggattccgcctctccggtggaggatactagcaacgatgagtcctcgatcctggggacagacatcgatctccaaacaattgataacgacattgtgtctatggaaattttcttcaaagcttggctgcataacagcggtaccgaccaggaacagatccacctgctgctgagctcccagtgtttttccaacatatctagacctcgggataatccaatgtgtcttaaatgtgatcttcaggagcgactattgtgtccaagccttctggccggaacagcagacgggagtctcaggatggatgatccaaagggggacttcattacactgtaccaaatggccagtcaaagctcagcctctcattataaactgcaagtcatcaaggcccttaaatcaagcgggctttgtgagagcctaacctacggcctgcctttcatcttgaggcccacttcatgctggcagttagactgggacgagttggagaccaatcagcagcactttcacgctctctgccactctctcttgaagagagagtggctattgctcgccaaaggcgagccgcctggcccgggccactctcagcgcatccctgccagtaccttctatgtgatcatgccttcccacagtctgaccttgctagtgaaggctgtggctacgcgtgagttgatgctgcctagtacatttccacttctgcccgaagatccccatgacgactcccttaagaatgttgagtctatgttagactctctagagctggaacctacttacaaccctctgcatgtgcagagccatctttatagtcacctgtcatcgatttatgctaagcctcaaggtcggttgcaccctcattgggagagcagggcccccaggaagcacccttgcaagaccggtcaactgcaaaccaatagagcacgggccaccgtcgcaccacttccaatgacgcccgtcccgggcagggcctccaagatgccagcagcgtccaagagctcctctgatgcgttcttcctgcccagcgaatgggagaaagaccccagcagaccttag

SEQ ID NO: 25237 - DNA, 540 bp, Artificial Sequence
  Description of Artificial Sequence: Synthetic coding sequence
atggatgatcccaagggggatttcatcactctctatcagatggcttcacagtcttccgcatcacattacaagctgcaggtcatcaaggctctcaagagcagtggattgtgcgagtctttgacgtatgggcttccatttatactgcgccccacaagctgttggcaacttgactgggatgagctggagacaaaccaacagcatttccatgccctgtgtcattcccttctctccatgctagactccttggaactggagcccacttataaccctttgcacgtgcagagccacttgtatagtcaccttagcagcatatacgccaaacctcagggccggctacatccacactgggaaagccgggcccccaggaagcatccatgcaaaacagggcagttgcagacaaacagggcccgcgctactgtcgcaccacttcctatgaccccggtgcccggacgtgcgagtaagatgcccgctgccagtaagagctcttctgatgcgttttttctgcccagtgagtgggaaaaagacccatccagaccttag

SEQ ID NO: 25238 - DNA, 429 bp, Artificial Sequence
  Description of Artificial Sequence: Synthetic coding sequence
atgcaccctgggcgcaccaccggcaaggggccatctacccacacccagatagaccaacagcccccaagactactgatcgtacacatcgctctaccttcctgggccgacatttgtaccaacctgtgtgaggcgctgcaaaatttcttctcgttagcctgttcactgatgggccctagtaggatgtcactgttctccctgtacatggtgcaggaccagcacgaatgcattctaccgttcgtgcaagtcaaaggaaacttcgcccgcctgcaaacctgcatttcagagctaagaatgctgcagagagaaggctgcttcagaagccaaggagcctcactccgcctggcagtggaggacgggcttcagcagttcaagcagtactctcgacacgtgaccacccgcgccgctctgacatatacctcattagagtag

SEQ ID NO: 25239 - DNA, 1581 bp, Artificial Sequence
  Description of Artificial Sequence: Synthetic coding sequence
atgcatcccggccgaactacaggcaaaggacctagcacacacacgcagatcgatcaacagccacctaggctgctgatagtgcatattgcactcccaagttgggccgatatttgcacgaatctgtgcgaagccctacagaattttttctctctcgcatgctcactgatgggaccatcccgcatgtcccttttctctctgtatatggtgcaggatcagcacgagtgcattttgccattcgtgcaggttaaaggcaatttcgctaggttgcaaacgtgtattagtgagctgaggatgcttcaacgggaaggttgtttcagaagtcagggcgccagcctacgactggccgtggaggatgggctgcagcagttcaaacaatatagccgtcacgtgaccaccagggcggccttaacatatacctctctcgaaattaccattttgaccagtcagccgggtaaggaagtggtcaagcagctcgaggagggactgaaggacaccgacttggctcgcgtccgacgctttcaggtcgtagaagtcacaaaaggcatcctggaacacgtcgacagcgccagcccagtggaagacacatcaaatgacgagtcttccattctgggaaccgatatcgaccttcaaaccatcgacaacgacatcgtcagcatggaaatcttttttaaggcctggctccacaactccgggactgaccaggagcaaatccatctgctcctcagctctcagtgcttcagtaatatctccaggccccgcgataatcccatgtgcctgaagtgtgatctgcaggagaggctgctctgcccttcactcctggccgggacagcagacggctctctgcgaatggacgatcctaaaggcgattttattactctgtaccagatggcctcccagtcaagcgccagtcactacaaactccaggtaattaaggcactgaagagcagcggattatgcgagagcctcacttatgggttgcctttcattctgaggcccacgtcctgctggcagctcgattgggacgaactggaaactaaccagcaacacttccacgcgctatgtcattctctcctgaagcgtgagtggttgctgctggccaagggcgagccccccggcccgggacattctcaacggatccccgcctcaactttctacgtaataatgcccagccatagcctgaccttgctagtgaaagccgtggctactcgagagctgatgcttccttccactttcccccttcttcctgaagaccctcacgatgattccctcaagaatgtggaatcaatgctcgattctctggagctagagcctacctataaccctcttcacgtgcagtctcacctatatagccacctttcctctatctatgccaagccacaggggcgcctgcaccctcattgggagtcacgtgccccacggaaaacagggcagctacagactaatcgcgcacgcgcgactgtcgcacccctgcctatgacgcccgtccctggacgcgcttctaagatgcccgcagcttcgaagagttcttctgatgcgttttttttacccagcgagtgggaaaaagatccttcgcgaccctag

SEQ ID NO: 25240 - DNA, 864 bp, Artificial Sequence
  Description of Artificial Sequence: Synthetic coding sequence
atggaggagaaggaagataaacatcagcaacataagatcgaagacgccgccataacatatgtgtccgaaaacgaagagatcaagcatgaggaaaagcccggaaagtcaatccaccatagcaagagccatgtgggaagaggccgcatctattacgcgaaattcattaatacaaatgcaagaacctataatgaaccatttccctatattgacccgaagaaaggccctgagattcagggagattggtggtctcatggcaaagctctggagcccgtgtttctccctccctatgattctaaatccacacagcggtccgacttccagaaaccatcgtgccccctcgtactgcctgttaagcattcgaagatgcagaagccaagctgtggaatagtgcccctggcctcacctgggacctcagcagagctccagaacaattttatcgagtatatctcgtttatccaccaatatgacgctcgcaaaactcctaatgagccgctacaggggaagcgtcacggtgcattcgtgcagagggaaatcaagcccggatcccgccccacagtgcctaagggagcggaagtgctcctgaacaccccaggttcccggagctctgagcagtcaaagaaaacggaaaagggaaactccgccgaatcacggatgatctcccctggtctgtgtcaacagaacagtcaggagctgctggagcccaaaacacatctctcagaaaccgatgtgcgccaagcagccaaagcctgtccatcaacacctgagagcagagaaaaaacaagcggcgctacacaaacaaccgtaggcgatgcactgtttactcgccataagccattaaacccacctataaaaaaatcagaatag

SEQ ID NO: 25241 - DNA, 366 bp, Artificial Sequence
  Description of Artificial Sequence: Synthetic coding sequence
atggcctcctgccttgctctgcggatggctctgctcctggtatcgggggtactggctccagccgttctcaccgacgacgtgccgcaggagcctgttccgacactgtggaatgagcctgcggaactcccctctggggaagggccagtggagagcacgtctccagggagggaaccagtggacaccggtccccctgccccaactgtggcccctggtccagaagacagcaccgcccaggagcgcttagatcagggaggaggaagccttggaccgggcgcgatcgctgctatcgtaatcgcagccctcctggcaacttgcgtggtgctcgccttggttgtcgtcgctctccgcaaattctctgcgagttag

SEQ ID NO: 25242 - DNA, 366 bp, Artificial Sequence
  Description of Artificial Sequence: Synthetic coding sequence
atggcctcatgcctggcacttcgcatggccctactcctggtctcaggagtgctggcccccgccgttctgacagatgacgttccacaggagcctgtgccaacgctgtggaatgagccggcagagctgccaagcggagagggaccagttgaatccacatcccccggtcgtgagcctgtggacaccgggcccccagcaccaacagtggcacctggcccggaggactcgacagctcaggagcgtttagaccagggagggggtagtcttggcccaggggctatcgccgcgattgtgatcgctgctctcctcgccacctgtgtggttctggctcttgtagtggtagcattgcgaaaattctcagcctcatag

SEQ ID NO: 25243 - DNA, 366 bp, Artificial Sequence
  Description of Artificial Sequence: Synthetic coding sequence
atggcctcctgcctcgcactacggatggcactgttgttggtatccggcgtgctcgcgcctgccgttttaacagacgacgtgccacaagagcctgtgcctacattgtggaacgagcctgccgaattgccttccggggagggtcctgtggagtccacatcaccaggaagagaacccgttgacaccggcccacctgcgcctaccgtcgccccagggccggaagattccactgcccaggagcggcttgaccagggtggcggtagtctgggaccaggcgccatagcagctattgtaatcgctgcgctgctcgcgacttgtgtggtcctggccttggttgtggtagcccttcggaaattctcagctagctag

SEQ ID NO: 25244 - DNA, 1371 bp, Artificial Sequence
  Description of Artificial Sequence: Synthetic coding sequence
atgtctccctggtcctggttcctcttgcagacattgtgtttactgcccacaggcgcagctagccgtaggggagcccccggaacggccaactgcgagttgaagccccagcaaagcgaactaaactcattcctgtggacgatcaagcgggatcccccctcctattttttcggcaccatccatgtgccctatacgcgtgtgtgggactttatccccgataattcaaaagaagccttcctgcagtcttccatagtctacttcgagctggacttgacagacccgtacacgattagtgcactgacctcctgccagatgcttccacaaggcgagaacctgcaggatgttcttccacgggacatttattgtagacttaaacgccatctcgaatatgtgaagttgatgatgcctctgtggatgacacccgatcaacgtggaaaagggctgtatgccgactatctgtttaacgccatagccgggaactgggagcggaaacggcccgtatgggtgatgctgatggtgaactccctaacagaagtcgacattaaaagccggggggttccagtgttagatctatttctcgcccaggaggcagaacgtttgcggaagcaaacaggtgccgtggagaaggtggaagagcagtgccatccacttaacggtctcaacttttcccaggtgcctaattttatcaacgccaccctgcccccacaagagcgcattactgcccaagaaattgactcctacctacgcagagaactaatctataagaggaacgagagaatagggaagagggtgaaagccctgcttgaggagttccctgataaaggtttcttttttgcgtttggcgccggccatttcatggggaacaacacggtcttagacgtccttcgccgggagggttacgaagtggagcatgctcctgccggcagaccaattcacaagggaaagtccaagaaaaccagcacacgtccaacactctccacaatattcgcaccaaaggtacctaccctggaggtccctgccccagaggctgtgtctagtggacacagtacgctgcccccactggtgtccaggcctggcagcgcagacactccaagcgaggccgagcagcgcttccgcaaaaaacgtcgaaggtcccagcggagaccacgcctgaggcaattctccgatttgtgggtaagactggaagagagcgacattgtaccgcagttacaagtgcctgtgctggacaggcacatctctactgaactccgcctgcccagacggggacactctcatcactcacagatggtcgcgtcttccgcctgcctcagcttgtggacacctgtgttctgggtgttggtccttgccttccaaactgagacgcctttactgtag

SEQ ID NO: 25245 - DNA, 1518 bp, Artificial Sequence
  Description of Artificial Sequence: Synthetic coding sequence
atgtcgccgtggtcatggtttctattacaaactttgtgcctgctgcccaccggagccgcgtccagacgaggagctcccggcacagccaactgcgagcttaagcctcaacaaagcgaactcaactcttttttgtggaccattaaaagagacccccccagctatttcttcgggaccatccatgtcccctatacgcgggtttgggacttcatcccggataacagtaaagaggccttcttacagtctagtatagtgtactttgagctcgacctgacagatccctatactatatccgccctgacgtcctgccaaatgctgccccagggcgagaacctccaggacgtccttccacgggatatttactgccgattgaagcggcatctcgaatacgtgaagctaatgatgcccctttggatgacccccgaccagcgtggcaagggactgtacgcggattatctgtttaacgcaattgcagggaattgggagaggaagaggcccgtctgggtgatgctgatggtaaacagtctcacagaggtcgacatcaaatcgcgcggagtcccagtcctggatctgttcctagcacaagaggccgagaggctgcggaagcagacaggggctgtggagaaagtagaggagcagtgccacccattaaacggcctcaacttctctcaggtcatatttgccctcaatcagacactgctgcaacaggagagcctgcgtgcaggatctcttcaaataccatacaccactgaggacctaattaagcattacaactgcggcgacctttcatcagttattctgtcacatgacagttctcaggtcccaaacttcatcaacgcaacactgccaccacaggaacgcattaccgcccaagaaatcgattcctaccttcgcagagagttgatatacaagagaaacgaacgaattggcaagcgcgtgaaggccttactcgaagaattcccagacaagggctttttcttcgccttcggcgccggccacttcatgggaaacaataccgtgcttgacgtgctgcggcgcgaaggatatgaggtggagcatgccccagccggacggcctattcacaaagggaagtcaaaaaaaacttccacaagacctactctgtccacaattttcgctcccaaagtaccaacattggaggtcccggcccctgaggcagtctccagcggccattcaactttaccacccttagtgtctcggcctggttcagccgatactccaagtgaggcagaacagaggttcagaaagaagcgtaggaggtcccaacgccggccaaggcttcgacagttctcagacttgtgggtaaggctggaagaaagtgatatcgttccgcagctgcaagtgccagtcttagaccgtcacatttcgaccgaattaagactgcctagaaggggacactcacaccattcccaaatggttgccagctctgcatgcttgtccctctggactcctgttttctgggtgctagtcttagcttttcagacagaaacaccactactctag

SEQ ID NO: 25246 - DNA, 1878 bp, Artificial Sequence
  Description of Artificial Sequence: Synthetic coding sequence
atgtgtgagacctcagctttctacgtgcccggcgttgcccccataaactttcatcagaacgaccccgttgagatcaaggcagtaaagcttactagcagccgcacgcaactgccctacgagtactactccctgcccttttgccagccttcaaaaatcacctacaaagctgagaacctgggagaggtgctccgaggcgatagaattgtcaacacgcctttccaagtcctcatgaacagcgagaaaaagtgtgaagtgctctgcagccagtctaataaacccgtgacccttacagtggaacagagccgattagttgctgaacgcatcactgaggactactacgttcatcttatcgcagacaatctgcccgtggcaaccagactggaactgtacagcaatcgggactccgacgataagaaaaaggagaaagacgtccagttcgagcacggctatagactgggattcactgacgttaataaaatttacttacacaaccatctctccttcatcctgtattaccacagagaagacatggaagaggatcaggagcacacataccgcgtcgtgcggtttgaggttattccccagtcaattaggctggaggaccttaaagctgatgaaaagtcttcctgtaccctgccggaaggcacgaactcttcccctcaggaaattgaccccacgaaagaaaatcagctgtacttcacttattcagttcactgggaggaatccgacattaagtgggcaagcaggtgggacacttatctgactatgtccgatgtccaaatccactggttcagtatcattaactctgtggtcgtggtcttttttctatcaggaattctttccatgattatcattcgtacactgagaaaggatatagccaattataacaaagaggacgacattgaagatacaatggaagaatcaggatggaagctggtgcacggtgacgtgtttcgacccccccaataccctatgattctttcctcattgctgggtagcggaatacagctgttttgcatgatcctgattgtgatatttgtggccatgctgggaatgctgtccccatcctcacgcggcgctttaatgacaaccgcctgctttcttttcatgtttatgggcgtgttcggggggtttagcgccggaaggttataccggaccttaaagggacacaggtggaaaaaaggagcgttctgtaccgcaactctttatcccggagtggtcttcgggatatgttttgtgctgaattgttttatttggggcaagcactcaagtggagcagtgccattcccaaccatggtcgcattgctgtgcatgtggttcggaatctctctaccactggtataccttggttattactttgggttccgcaagcaaccctacgataatccagtcaggaccaatcaaatcccaagacagatacctgagcaacgttggtacatgaacagatttgtgggtattttgatggccggaattctaccgtttggggcaatgtttattgaactttttttcatatttagcgcaatctgggaaaatcagttctattatttgtttggcttcctgttcctcgtttttattattctggtggtgtcttgttcccagatctctattgtcatggtttactttcagttatgtgccgaagattatagatggtggtggaggaattttctagtctcagggggatccgcattttatgttcttgtctacgccattttttatttcgtgaacaaactcgatattgtggaatttattccctctctcttgtactttggctatacagctcttatggttttgagtttttggctcctgaccggcaccataggattctatgctgcctacatgttcgtgaggaaaatttacgcagccgttaaaattgactag

SEQ ID NO: 25247 - DNA, 1701 bp, Artificial Sequence
  Description of Artificial Sequence: Synthetic coding sequence
atgcctggtcatcccggggccgctgagcaactagtgaaaaccggatggaggtcttggcaccttggtttttggaaggcacttgcaccgctgcaggccgcttgggacgccttctcgcagcctgtgcccgctagttgcggccagttactgactcagcttcttctgtgcgccagtctcgctgctgcagcagcaggtttagtgtatcactggctcgcctctctcctgctctatcccccgggcccatctgccatggttgcgaccgtgtgcggccttctggttttcctgtctctggggcttgttcccccagtcagatgcttgtttgcgcttagcgtgcctacccttggcatggagcaaggacggaggctgcttctgagctatagtaccgccaccctggcaatagctgttgtcccaaatgtcctcgctaacgtcggagccgctggacaggtgctgcgatgcgtgactgaaggatctttggagtccctcctcaacaccacccaccagctgcacgcagccagccgcgctttgggcccgaccggacaagcgggtagcaggggactcaccttcgaagcccaagataatggcagtgccttctacctccacatgctccgggttacacagcaggtcttggaggacttttcagggttggaatccctcgcccgagcggcagccctaggcacacagagggtggtgaccggcctcttcatgctaggcttgttggtggaatctgcatggtatttgcattgctacctgaccgacctcagatttgacaacatttacgctacccagcagttgacacagcgcctggcacaggcccaggcaacacaccttctggcccctccacccacttggctgcttcaagccgctcagcttagactctcccaggaagagctgctttcatgtctgctaaggctcggactgctggctctgctgctcgtggctactgcagtagccgtcgccaccgaccacgtagccttcctgctcgcccaggctacagtggattgggctcagaaactgcccaccgtgcccatcacattgacagttaaatacgacgtcgcctatacagttctggggtttatcccatttctgttcaaccagcttgccccggagagtccctttctctccgtgcattctagttaccagtgggagctgcgactcacctctgctcgttgccctctgcttcccgccaggcggcccagggcagccgcccctctggcagctggggctctgcagcttcttgcaggctctacggtgctgttggaggcatacgctcgccgcctcagacacgctattgctgcatccttctttacagcccaggaagctcgacgggtgcgtcacttgcacgctcgactgcagcgccgccacgacaggcatcagggtcagcagttgcctctaggggatccgtcctgtgtacctaccccacggcccgcgtgcaagccaccagcttggatcgattatcggctcgacgcactgcggactgagagtagcgaaggcgaaggcaaagagctgtggagctgcagggacctctcatgtaaccttgggcctgtcccaccaccctgtgtgacgctagggaagtcattacacctatcagaaccaaggttcttgcatttgcacaacgacagcatatttacaattgacgtgacatacttccccagaagagacgttgtgaggatggaagggaacaccgggcatgacagaccaggctag

SEQ ID NO: 25248 - DNA, 432 bp, Artificial Sequence
  Description of Artificial Sequence: Synthetic coding sequence
atgagcgggggccgtcgcaaagaagagccgcctcagccgcagctggcaaatggcgctctgaaagtgtctgtatggtccaaagtactgcgcagtgacgctgcctgggaggacaaggacgagtttctcgatgtgatctattggtttaggcagattattgctgtggtgttaggggtgatctggggagtgctgcctttgagaggttttttagggattgctggatccttcgggtcaagtttcacactccccagtatcatgactgatggtgttcagcttccaagcgccccttacccggttcagcggacccttctcatcactgctcaggaactcgacagatggggaacccccgcaccctggaacctggaggacccatgcttcctcgatagggagtcagtctgctgggcttctgtgttcagcgctcgggtggtgacgtag

SEQ ID NO: 25249 - DNA, 390 bp, Artificial Sequence
  Description of Artificial Sequence: Synthetic coding sequence
atgtccggcggcaggaggaaagaggagccgccacagccacaacttgctaatggagctctgaaggtttctgtttggtctaaggtgcttcgttccgacgccgcctgggaggacaaagatgagttcttagacgtgatctactggtttaggcagatcatagcggtggtcctgggagtgatttggggagtcttgcccctgaggggtttcctcgggatagcaggattctgtttgatcaatgcaggggttctgtacctgtactttagcaattatttgcagattgacgaggaggaatacggaggcacctgggagttgaccaaggaaggatttatgaccagcttcgccttattcatggtcatctggattatcttctacactgctatacattacgattag

SEQ ID NO: 25250 - DNA, 414 bp, Artificial Sequence
  Description of Artificial Sequence: Synthetic coding sequence
atgtctggaggaagaaggaaggaggaacccccccagccacagttggccaacggggctttgaaggtgtcggtctggagcaaggtcttacggagtgacgccgcctgggaggacaaagacgagtttttggatgtgatctactggtttcggcaaataatagctgtggtccttggggtcatctggggggtgcttccactccggggcttcttgggtatcgcaggtttttgcctgataaacgctggggtactctatctatactttagcaattatcttcaaatcgacgaggaggaatatggcggcacctgggaactgaccaaggaaggattcatgacgagtttcgccttgtttatggtgtgtgtcgccgactctttcacgacaggtcaccttgaccacctcctgcattgtcacccactctag

SEQ ID NO: 25251 - DNA, 960 bp, Artificial Sequence
  Description of Artificial Sequence: Synthetic coding sequence
atgtcaagcccccaggcaccagaagatggacaggggtgcggcgatagaggggaccccccaggcgacctgagatcggtcctggtgacgacagtgttgaatttggaaccattagatgaggatctatttagaggcaggcattactgggtccccgcaaagcgtctgtttggaggacagatagtggggcaagccttagtggcagcagcgaagtcagtgagcgaagacgtccatgtccattctctgcactgctactttgtgagagccggagaccccaagctccctgtgctgtaccaggtagagagaactcgcactggctcctcattttccgtgcggagtgttaaagccgtgcagcacggcaaaccaatttttatctgtcaagcttccttccagcaggcccagccaagccccatgcagcatcaattttctatgcccacagtcccgccaccagaagaacttctagattgtgagactctgattgaccagtacctaagagatccgaacctgcagaaacgctatcccctggctctgaacagaatcgccgcccaggaagtgcctatcgagatcaagccagtcaacccctccccactgtcacagctgcagcgcatggagccaaaacagatgttttgggtccgggccaggggatacatcggcgagggtgatatgaaaatgcactgctgtgtggccgcttacattagtgattacgcttttctggggacggctcttctcccccatcagtggcaacataaggtccatttcatggtcagcctagaccacagcatgtggttccatgcacccttcagggcagaccattggatgctgtacgagtgcgaatcaccctgggctgggggctccagaggattggtccacggcaggctctggcgacaagatggagttctggctgtgacttgtgctcaggagggcgtgatccgcgtgaaaccccaagtgagcgagtccaaactctag

SEQ ID NO: 25252 - DNA, 870 bp, Artificial Sequence
  Description of Artificial Sequence: Synthetic coding sequence
atgtccgaagccgatggtctcaggcagaggagacccctgcggccgcaggtggtaactgacgatgatgggcaggctcccgaagcgaaggacggttcctctttttccgggcgagtattcagagttacattcctgatgctcgctgtgagcttgaccgttccactgctgggagcaatgatgctgctagaatcccccatagacccccagccattgtcttttaaagagccgcctctgctactgggtgtgctccatcccaacactaaactcaggcaggccgagcgcctctttgagaatcagctcgtgggtcctgagagcatagctcacatcggtgacgtcatgtttaccgggaccgccgacggccgggtggtgaaactcgagaatggcgagatcgagaccattgctaggttcggctctgggccctgcaagaccagggatgacgagcccgtttgcgggagacctctgggaataagggcagggcctaacggcacactgttcgtggctgacgcctataagggccttttcgaggtgaatccttggaaacgggaggtgaagctgctattatccagcgaaactccgatagaaggaaagaatatgtcattcgttaacgatttgactgtcacgcaggacggccgcaagatctactttacagatagcagcagcaagtggcagagacgtgactacctactcctcgttatggaagggacggacgacggacgactgctggaatatgacacggtaacccgcgaagtgaaagtcttgctggaccagttgcgcttccctaatggcgtgcagttgagtcctgcagaggattttgtgcttgtggctgaaaccactatggctcgtattaggagctctctcgttaagcgacgttag

SEQ ID NO: 25253 - DNA, 1230 bp, Artificial Sequence
  Description of Artificial Sequence: Synthetic coding sequence
tgagtagtaactgacgacgacggccaggcccctgaagcgaaggacggatcctcgtttagtggacgcgtgttccgagtgacgttcctgatgttggctgtgtctcttacagtcccccttcttggcgccatgatgttgttggaatccccaatagatccccagcccctcagtttcaaggagcctcctctgttgctcggcgtactgcaccctaacacaaagttgcgacaagccgaaagactttttgaaaaccagcttgtgggtcccgaaagtatcgctcacatcggtgatgtaatgttcaccggcaccgccgatggacgagtggtcaaactggagaacggcgagatcgaaactatcgcacgcttcgggtccggcccttgcaagacgagggacgatgaaccagtgtgtgggcggccgctgggcatccgcgcaggacccaacggcaccctattcgtagcggacgcctataaaggactcttcgaggtcaacccttggaaaagggaggtcaaacttcttctgtcttctgaaacaccgattgaaggtaagaacatgtctttcgttaacgacctgaccgtcactcaggatgggcggaaaatttattttacagatagcagctcaaagtggcagcgcagagactatcttctgctggttatggaggggacagacgacgggcgattactagaatacgatacagttactcgcgaagtaaaggtcctcctcgatcagctcaggtttccaaatggtgtccagctatcacctgcagaagatttcgtgctggttgctgagaccacaatggcacggattaggcgggtatacgtctcaggcctcatgaaagggggcgccgatctgttcgttgaaaatatgccagggtttcctgacaacattaggccctctagcagcggtggatactgggttggtatgtcgaccattcgccccaatcccggtttctccatgctagactttctgagtgagcgaccatggatcaagagaatgatcttcaagggctcatgtgcggggtgcgatttgcttttctcccaggagacggtcatgaagttcgttcctcggtattctcttgtgctcgagttatctgacagcggagctttcaggcgcagcctccatgatccagacggactggtcgctacatacatctctgaagtgcacgagcacgatggccacctgtatctgggctctttcagatccccgttcctgtgccgcctgtccttgcaggctgtctag

SEQ ID NO: 25254 - DNA, 363 bp, Artificial Sequence
  Description of Artificial Sequence: Synthetic coding sequence
atgatgccctcacgaactaacttggccacagggatcccttccagtaaagttaaatacagtcgtttaagttccacggacgacggatatattgatctccagttcaaaaaaactccccccaagattccctataaggctatagcccttgctactgttctttttctgattggagcgtttttaatcattatcggatccctcctgttgtccggctacatatcgaaagggggagccgacagagctgtccctgtgttaatcataggcatactggtatttctgcctggattctaccacctaagaatcgcctactacgcctccaaggggtaccgtgggtactcttacgatgacatccctgattttgatgactag

SEQ ID NO: 25255 - DNA, 552 bp, Artificial Sequence
  Description of Artificial Sequence: Synthetic coding sequence
atgcaaccttgggcgctgccaacagtgggcgaactgtgggtctgtgggcgcccaggagccgccttacgctggagtcttgttctgtcccctaggcttgaaccttcaggcgttatttcagctcactgtaacttacatttgcttgcgagttctgattccagcgccagcgcgagcaggctttgccaacgtgtaatgatgccttcgcgaaccaacctcgcgacagggatcccttcctctaaagttaaatacagtcgattgtcatctacagacgacggttacatcgatctccaatttaagaagaccccacccaagataccatataaagcgatcgccctggcgactgtactatttctcattggcgcttttctcataatcataggaagcctcctgctctcaggctacatttcaaaaggcggcgcagacagggcagtgcctgtcctgatcatcggtattctggtgtttctgcccggtttctatcaccttaggatcgcctattatgctagcaaaggctacaggggctacagctacgatgacatcccagactttgacgactag

SEQ ID NO: 25256 - DNA, 225 bp, Artificial Sequence
  Description of Artificial Sequence: Synthetic coding sequence
atgatgccttcacggacaaatttagcaacggggatcccatcttcgaaggtaaagtattcacgattgagctctacggacgatggctacatcgacctgcagttcaaaaagactccccctaaaataccatataaagcaatagcccttgcaactgtactgtttttgattggggcatttctgattatcataggatctctcctcttgtcagggtacatctcaaagggctag

SEQ ID NO: 25257 - DNA, 363 bp, Artificial Sequence
  Description of Artificial Sequence: Synthetic coding sequence
atgatgccatcaaggaccaatttggctacaggcatccccagctctaaggtgaagtactcacggctcagtagtactgatgatggatacatagacttgcagttcaagaagacaccacccaagataccgtacaaggcaatcgccctcgctacagtgctcttcctgatcggagctttcctgataatcattggatccttgctcctgagtggatatatttccaagggcggggcagaccgagccgtgcccgtgttaatcatcgggattcttgtattccttcccggcttttaccacctgagaattgcatactatgcctccaagggctatagagggtatagctatgacgacattcccgattttgatgattag

SEQ ID NO: 25258 - DNA, 363 bp, Artificial Sequence
  Description of Artificial Sequence: Synthetic coding sequence
atgatgcccagcaggacaaacttagccacagggatccccagctccaaggttaagtactcacggctgtcttctacggatgatggctatattgatctgcagttcaaaaaaacacccccaaagatcccctacaaggcgattgccttggcaacagtactcttcctgattggcgcgttcctcataattataggaagcctattgctaagcggatacataagtaagggcggggccgaccgcgcagtacctgtgctgatcataggcattctggtttttctgcccgggttttatcatttgcgaatcgcttattacgcctctaaggggtaccgagggtactcttatgacgatataccagacttcgatgattag

SEQ ID NO: 25259 - DNA, 363 bp, Artificial Sequence
  Description of Artificial Sequence: Synthetic coding sequence
atgatgccaagccgtactaatttagccactggtataccctccagcaaagtgaaatacagtagacttagcagcaccgatgatgggtacatcgatctgcagttcaaaaaaacaccaccaaaaataccatataaggccattgcactggcgacggtgctgttcctgataggggcttttctcatcatcatcggaagtctgttgctttcaggctatatatctaaaggcggagccgatcgcgctgttcccgtcttaataataggcatcttagtgtttttgcccggcttttatcacctccgtattgcctactacgcttccaagggctatcggggctatagctatgacgacatccctgactttgatgactag

SEQ ID NO: 25260 - DNA, 363 bp, Artificial Sequence
  Description of Artificial Sequence: Synthetic coding sequence
atgatgcccagccgcacaaacttggccacgggtatcccctcttccaaagtgaagtattcccggctgagctctacagacgatggctacatcgacctgcagttcaagaagaccccgcccaagattccttataaggccatcgctttagccaccgtgctattcttgattggtgcctttcttatcattatcggcagtctgttgctgtcaggatacatatctaaggggggtgcagatcgcgctgtaccggtgctcattatcggcatcctagtgttccttcctggattctaccacctaagaatagcatactatgctagcaaaggataccgaggctactcttacgatgacattccagattttgacgactag

SEQ ID NO: 25261 - DNA, 363 bp, Artificial Sequence
  Description of Artificial Sequence: Synthetic coding sequence
atgatgccatcgagaacaaaccttgctacgggcataccctcaagcaaagtgaagtatagccgacttagttccaccgatgacggttacatagatctgcagttcaaaaagacacctcctaagatcccatataaggcaatcgccctcgcaaccgtcctttttcttatcggggcgttcttaatcatcatcgggtccctcctgttatctggttatatttcaaagggaggcgctgatcgggcagtcccagtcctcattataggaatccttgttttcctccctggattctatcaccttcgcatcgcctactacgcaagcaaagggtatagaggttatagttatgatgacatcccagacttcgacgattag

SEQ ID NO: 25262 - DNA, 759 bp, Artificial Sequence
  Description of Artificial Sequence: Synthetic coding sequence
atgaaaatgaagctttttcagaccatatgcaggcagctgcgctcgtccaagttttccgtcgagtccgccgctctggtggccttcagcacttcctcatactcatgcggcaggaagaaaaaggttaacccctacgaggaggtagaccaggaaaagtactccaacttggttcagagcgttctctcttctcgcggtgtcgcacagacgccaggatccgtggaggaagacgccctgttatgcgggcccgtaagcaaacacaaattacctaaccagggagaggatcgccgtgttccacagaattggttcccaatctttaaccccgagcgtagcgataaaccgaacgcaagtgaccccagtgtgcctctgaagattcctctgcagagaaacgtgatccctagcgtgactagagtattgcagcaaacaatgaccaagcagcaggtgtttctgctggaaaggtggaaacagaggatgattctggagctgggggaggatggttttaaagagtatacgagcagctctatgtggttgaattgcggtggcctgcagaggtggattacgtgtcctccaacctttcacggctgtagggcccttttcccagtgcttgaccaggtggcctccagtactcgacggatctacggcaaggaaaaggaacccgagtacagcgagacaaggatcttccggatcgggagcaaattattgttcggtaacattcagcatctgctgactgtgtgggagcatatcttgctgtttacccctgtctag

SEQ ID NO: 25263 - DNA, 795 bp, Artificial Sequence
  Description of Artificial Sequence: Synthetic coding sequence
atgaagatgaagctgttccagacgatctgtcggcaactgaggtcttcaaagttctctgtggaaagtgctgccctggttgccttcagtaccagcagctactcatgcggacggaaaaagaaggtgaacccctacgaggaagtggaccaggagaaatactcaaatctcgtacaatcagttctgtccagccggggagtcgcacaaactcccggctctgtggaagaagacgccctgctgtgcggaccagtgagcaagcataagctacctaatcaggacgtgtttcttcagggcaagagatttcacgaagcgctcgaaagcatcctttccccccaagagacactcaaagagcgcgatgagaatctcctgaaaagcggctatatcgagtcagtgcaacatatcttgaaggacgtgtccggcgtgcgcgccttagagtcagccgtgcaacacgaaacactgaactacatcggtctcctcgactgcgtggcggaatatcagggtaagctgtgtgtgatcgactggaagacctctgaaaagcccaaaccctttatccagtcaactttcgataatcctttgcaagtcgtcgcatatatgggggctatgaaccacgacaccaactactctttccaagtacagtgtggtctgattgtggtcgcatacaaggacgggtcaccggcacaccctcactttatggatgccgagttgtgcagtcaatattggactaagtggctactgaggctggaggagtataccgagaagaagaagaatcagaatattcagaagcccgaatattcagagtag

SEQ ID NO: 25264 - DNA, 1035 bp, Artificial Sequence
  Description of Artificial Sequence: Synthetic coding sequence
atgaaaatgaagctgtttcagaccatttgtcggcagctcagatcgtcaaaattctccgtggaatccgccgccctagtggctttcagtacatctagttattcctgtggacgtaagaagaaagtcaacccgtatgaggaagtggatcaggaaaaatactctaatctggttcagtctgttctgtcttctcgcggagtcgcacagacacccggcagtgtcgaggaagatgcgctgctgtgcgggccggtgtcaaagcataagcttcctaaccagggtgaagacagacgcgtgccacagaattggtttcccatttttaatccagaacgaagtgacaaaccgaacgcctcagatccaagcgtaccactcaaaataccacttcagaggaatgtcattccaagtgtcacaagagtcctgcaacagaccatgacgaagcagcaggtctttctgctcgagaggtggaaacaaagaatgatcctggagctgggcgaagacgggttcaaagagtacacttcaaacgtttttctccagggaaagaggtttcacgaggctttggagagtatattatctcctcaagaaacactgaaagagagagatgagaacctgctaaaatcagggtacatcgaatccgtccaacacattctgaaggatgtgtctggggtccgggcactggaaagcgcagttcagcacgagacccttaactatattggcctgttagattgcgtggccgagtatcagggcaaactttgcgttattgactggaagacctccgaaaagccaaagccttttatccaatcaaccttcgataaccccctgcaggtcgtagcgtacatgggcgccatgaaccacgatacaaattattcttttcaggttcaatgcggcctaattgtggtggcctataaggatggctctccagctcatccacacttcatggacgcagaactgtgctctcaatattggaccaagtggctgctccgcttggaggagtatacagagaaaaagaaaaatcagaatattcagaaacccgaatactcggagtag

SEQ ID NO: 25265 - DNA, 1326 bp, Artificial Sequence
  Description of Artificial Sequence: Synthetic coding sequence
atgctcctgccggggagagccagacagccgcctaccccacagcctgtgcagcacccaggccttcgccggcaggtagagcccccaggccaactcctgcgactgttctactgcacagttctggtgtgctccaaagagatatcggctctcaccgattttagtggttatctcaccaaacttctccaaaatcacaccacatacgcctgtgatggagactaccttaacttgcagtgtccgagacacagcacaatttcagtgcagtctgccttctacgggcaggactaccagatgtgttctagccagaagcctgcgtctcagcgggaggatagcttaacgtgcgtcgctgccacaacctttcaaaaggtcctcgatgagtgtcagaatcaacgggcttgtcacctgctggtgaattctcgagtgtttggacccgatctgtgccctggctcttccaagtatttgcttgtttctttcaagtgtcagcccaacgaactcaaaaataaaacagtgtgcgaagatcaggaattaaagcttcactgccacgaatcgaagtttttgaacatctacagtgcaacgtatggaaggcggacgcaggagagagatatctgttccagtaaggccgaacgcctcccgccttttgattgcctctcttactccgctcttcaggtactgagcagacgatgctatggcaagcagcggtgtaaaatcatcgtcaataatcaccatttcggctccccatgcctcccaggagtcaaaaaatacttgacagttacttacgcatgtgtgccaaagaacattctgaccgccatcgacccagcgatcgctaaccttaagcccagtctcaaacagaaggacggcgaatacgggatcaacttcgatccctccggatcaaaagtcctgcgtaaagatgggattttggtgagcaattccctcgccgcttttgcttacatcagggcccatccggaacgtgctgccctcctgttcgtgtctagtgtgtgcatcggcctggcactgactctctgtgccttggtgatccgagagtcctgtgctaaggattttcgggacctccaattagggagagagcagctagtgcccgggtcagacaaggtagaggaggactcagaggatgaggaagaagaggaggatccatccgaatcagattttcctggcgagctttcaggcttttgcaggacctcttatccaatctatagctccatcgaggctgctgagctcgcagagagaatagaaagacgcgagcaaatcatacaggagatttggatgaatagtggactcgacacttccctgcctaggaatatggggcaattctactag

SEQ ID NO: 25266 - DNA, 615 bp, Artificial Sequence
  Description of Artificial Sequence: Synthetic coding sequence
atgggttgggactgccggagaactaccgttgagaacccttctccgatccggaattgcgttaaccaggaatggcccgaggggagctcacccgggctaacagaaggcaataccgggctggtacgagatcttaggccggctcaccaggataggagcggcacgagggaggaccccgctggccaagagaccacggctataactaatcctagcccgtctttagctgccgatctggctggagatgcactccctgggtgtctgggcgcagcagcgcaccagggacccctcttagatcgatcttcagaatccacattgggcccgcaagccctagaactggaacattgtcatgaaaggggatgttgccgcgggtgcgcatcattttctccttttcccgcccctaggtgcccttctgaacggttaggggctcactcctctaggtgggccatccggggacggtctaagatcaatccgcccccctgggcgcccgcttgtttgccagggggctttccagcttgcctgcctgctccaaagtccagcacagactccgcttcctcctgttttaaggggggccgagaattctcagatccactggacatcccgggggctggtgctatgggctag

SEQ ID NO: 25267 - DNA, 249 bp, Artificial Sequence
  Description of Artificial Sequence: Synthetic coding sequence
atggggtgggactgtcggaggacgactgtggaaaatccatcccccatccgtaactgcgtaaatcaggagtggcccgaggggtcaagccccgggctgacagaaggcaacaccggcctggtacgggacttacggcccgcccaccaggaccgatctgggactagggaagatcctgctgggcaagagaccaccgcaataacaaaccccagcccttcctgtacaagcggcgcttcagccggccagaaactttag

SEQ ID NO: 25268 - DNA, 483 bp, Artificial Sequence
  Description of Artificial Sequence: Synthetic coding sequence
atgactacacaggaggacaccaccggacttcatcaaaagaccagcttgtggacaatgtcaagacccggagccaaaaaggtcatgaactcatactttattgctggctgtggcccggccgtttgttactatgcagtctcctggctgagacagggtttcagcatcaatctcacaagctttggacgcatcccttggcctcatgccggagtgggcacctgtcctagccctcagtcttggatttccccgttcctgcaaagccatagagagcaccactacgctaaaaccagttcccatagtcaaccctcccctcagagtctagcattgtgtctggcatactcccgctgcagcattaatatctgccagatgaccgaatgtatttctttagccagtggttgccaccaggcccttcgcgaacctgggagatctgaggaatccttctggatcccggcgacaccttatattagcaacatcttctcagagagctag

SEQ ID NO: 25269 - DNA, 684 bp, Artificial Sequence
  Description of Artificial Sequence: Synthetic coding sequence
atggtgcctacagggtgggcggggctgggcggtgccgttgttcacggacctggaaagctcgagaaggccgtccccagtcctcgagccctggactttctgtccgtcaagtgggaggcagccatgatgaatggcaaagtgccattcttcttctcatccgaatcactgggatattttgccactgggcgacctgctgacaacgtcatgactacccaagaagataccacgggcttacaccagaaaaccagtctctggaccatgagtcggcctggcgctaaaaaggtgatgaacagctacttcattgccggatgcggccctgccgtatgttactacgcagtgagctggcttcgacaaggattctccataaacctgacctcgtttggacggatcccttggcctcacgctggtgtgggtacgtgtccaagcccccagagttggatctccccttttctgcagagtcaccgtgaacatcattacgctaaaacatcttctcacagccaacctagccctcaaagcctcgctttatgcttagcctactcgcgctgctcgatcaacatttgtcaaatgactgagtgtatctcactcgcctccgggtgtcatcaggcgctccgtgaacctgggcgctccgaggagagcttctggatccccgcaacgccctatattagcaatattttctccgagagttag

SEQ ID NO: 25270 - DNA, 831 bp, Artificial Sequence
  Description of Artificial Sequence: Synthetic coding sequence
atgtgcattatatttttcaagttcgatccgcgtcctgtttccaagaatgcttatagacttatcctagcagcaaatagggacgaattttattcccgtccatcgaagctcgctgacttctggggaaacaacaatgaaatcttgagcggcctcgacatggaagagggaaaggagggaggcacctggttgggtattagtaccaggggcaagctggctgctctgacgaactacctacagcctcagctggattggcaagcccgcggccgaggcgagcttgttacacacttcctcacaacagacgtggactctctgtcctatctaaaaaaggtcagcatggagggccatctctataacggcttcaacctcattgccgccgacctttcgacggcgaaaggcgatgtgatctgttattatggtaaccgtggcgagcctgatcctatcgtcctcaccccaggaacatatggcctttcaaatgccctgctcgaaacaccttggaggaagctgtgcttcgggaaacagcttttcctcgaggcagttgaaagatcccaagctttgcctaaggacgtcttgatcgcctccctccttgatgtccttaacaatgaagaggctcagctgccagatcccgccattgaagaccaggggggcgaatatgtacagccaatgctcagcaagtatgcagccgtttgtgtgagatgtccaggctatggcacacgaactaacacaattatactggtagacgccgatggccacgttacctttactgaacgctcaatgatggacaaagatctgagccattgggagaccaggacgtatgaatttactctgcagagctag

SEQ ID NO: 25271 - DNA, 645 bp, Artificial Sequence
  Description of Artificial Sequence: Synthetic coding sequence
atgtgtatcatcttcttcaaattcgacccacgcccagtgtcaaaaaacgcatatcgcctcatcttagctgccaatagggacgagttctactcacggccgtcaaagctcgcagacttttggggcaataataacgagatattgagtggactggatatggaggagggaaaggagggagggacgtggctgggaatctccacccgagggaagttggccgcactgaccaactacctgcagccccagctcgactggcaagccaggggtagaggaacttacggcttgagcaacgctttgctggagacaccctggcgcaaactgtgttttgggaaacagctgtttcttgaagctgttgaacgatcacaggccctcccgaaagacgttttgattgcatctctgctcgacgtactgaacaacgaggaagcccagttacctgaccctgccattgaggaccaggggggggaatacgttcagcccatgctgtcgaagtacgccgcagtgtgtgtgagatgcccagggtatgggacgcgaacaaacaccataatactcgtcgacgcagatgggcatgtcacattcacagagaggtccatgatggacaaagacctgagccattgggaaacccgaacatatgagtttacactccagagttag

SEQ ID NO: 25272 - DNA, 645 bp, Artificial Sequence
  Description of Artificial Sequence: Synthetic coding sequence
atgtgtatcatctttttcaaattcgacccacgcccagtgtccaaaaacgcataccgcctgatcctggccgctaatagagatgagttttactcccgacctagcaagttggctgacttttggggcaacaacaatgaaattctttctggcttggacatggaggaggggaaggaagggggcacttggctggggatcagcacccggggcaagttggcagctctgactaactacctgcaaccccaactcgactggcaggcccgggggagggggacgtatggactctctaatgctctgctggagacgccttggcgcaaactgtgtttcggaaaacagcttttcttggaggctgtggagcgctcccaggccctccctaaggacgttctcatcgcctctctgttagacgtcttgaataacgaagaggcacagctaccggaccctgctatcgaagatcaaggcggagaatacgtgcagccaatgctgagcaagtatgcagccgtctgcgtgagatgtccaggctatggcacaagaacaaatactattatactggttgacgccgatggccacgtcacgtttactgaacgcagcatgatggacaaggatctgagccattgggagacaaggacctatgaattcaccctgcaaagctag

SEQ ID NO: 25273 - DNA, 537 bp, Artificial Sequence
  Description of Artificial Sequence: Synthetic coding sequence
atggccgggcaccagcacacatggcaggcagggtctacacaccagctaccagccgcagccgctggtctggccggacctagagcgtctactgctaagggagacgtcatttgttactacgggaatagaggcgaacccgacccaatcgtactcactcctgggacctatgggttgagcaacgccttgctcgaaactccatggagaaaactgtgtttcggcaaacagctttttttggaggctgttgagcgatcacaggccctgcccaaggatgtccttatagcgtccctcctcgatgtcctgaataatgaagaggcacaacttcccgatccggctatagaagatcagggcggggagtacgtacagcccatgttgagtaagtatgctgcggtgtgcgttcgatgtcccggatacggcacgcgtactaacacaatcatattggtggacgctgatggacacgtaacctttactgagcgctcaatgatggacaaggaccttagccactgggagacacgcacctacgaatttacacttcagtcttag

SEQ ID NO: 25274 - DNA, 267 bp, Artificial Sequence
  Description of Artificial Sequence: Synthetic coding sequence
atgtgcatcatattcttcaagttcgatccccggcctgtgtcgaagaatgcttacaggttaatactggccgctaaccgcgatgaattttattcccgcccctctaaactggcagatttttggggcaacaataatgaaatcctgtcaggactcgatatggaagagggtaaggagggcggtacctggctgggcatttcaacccgcggcaaactggctgctcttacaaactacttacagcctcagctagattggcaggcacggggcagatag

SEQ ID NO: 25275 - DNA, 645 bp, Artificial Sequence
  Description of Artificial Sequence: Synthetic coding sequence
atgtgcatcatattctttaagtttgaccctaggcctgtgagtaagaatgcctatcggctgatcttggccgctaaccgggacgaattttattctcggcctagcaagctagctgacttttgggggaataataacgagattctgtctggtctagacatggaagagggaaaagaaggggggacatggctaggcatctctacccggggaaagctggctgcgctgactaattatctccagccgcagcttgattggcaggcccgtggaaggggtacgtacggactatccaacgcattgctcgagaccccatggcgtaagctgtgcttcggcaagcagttgttcttagaggctgtggaaagaagtcaagccctgccgaaggacgtgctgatagccagtttgctggatgtgttgaataacgaagaggcccagcttcctgaccctgctatcgaggatcagggcggcgagtacgtgcaaccaatgttgagcaaatacgctgccgtgtgcgtgcggtgcccaggatatggtacaaggactaacactatcatcctagtagatgcagatggtcacgtgacgttcaccgagagatccatgatggacaaagatctcagccattgggagactcgcacatacgagtttactctgcagagttag

SEQ ID NO: 25276 - DNA, 681 bp, Artificial Sequence
  Description of Artificial Sequence: Synthetic coding sequence
atgtgcattatctttttcaaatttgatccgagacccgttagcaagaacgcttacaggttgatactcgctgcaaatcgtgacgaattttacagcaggcccagcaagctagccgatttctgggggaacaacaatgagatcctgagtgggttggacatggaagaaggcaaggaaggaggaacatggttaggtatttcaacgagaggcaagctcgccgcactgaccaactacttacaaccccagttggattggcaggcccggggaaggggcgagctcgtgacgcatttccttactacggatgtggattccctgtcctatcttaagaaagtttcaatggagggacacctgtataacggcttcaatctgattgccgccgacctcagcacagctaagggagatgtgatctgctactatgggaaccggggagagcccgatccaattgtgctgacccccggaacatatggcctgagtaacgccttattagaaaccccttggagaaaactctgcttcgggaagcagctgtttttggaggccgttgaacggtcccaggcgctccccaaggatgtcttaatcgcgtctctgcttgatgtgcttaacaatgaggaggcacaattgcccgaccccgctatcgaagatcagggaggagagtatgttcagccaatgctgagtaagtacgctgcttag

SEQ ID NO: 25277 - DNA, 597 bp, Artificial Sequence
  Description of Artificial Sequence: Synthetic coding sequence
atgccccctaaactgctatgtgcagggcgctgcgtcggacaggatggagccgcgcaggcatggcattgccctcccggtcagggtcattctgtctgggatgctgtgcgcatgccccttggagccggaactcccgttaatgtgcagcggagagaggattcagctactgagggctcacaccggctgatcttggcggctaacagagacgagttttacagccgcccgagcaagctcgccgacttttggggcaataataacgagattctcagcggattagatatggaggagggcaaagagggtggcacttggctcggcatttcgacacgtggtaagctcgccgcactgactaattatttgcaaccacaactggactggcaggcccgaggccgcggcgagctggtcactcacttccttaccaccgacgtcgatagtctgagctaccttaaaaaagtcagcatggagggccacctatataacggcttcaacttaatagccgcggacctgtcaacggccaagggagatgttatttgttactacggtaaccgtggcgagccggaccccatcgtccttacgccggagccaactcttagcagctggtag

SEQ ID NO: 25278 - DNA, 831 bp, Artificial Sequence
  Description of Artificial Sequence: Synthetic coding sequence
atgtgtatcattttcttcaagtttgatccacggcccgtgtccaaaaatgcatacagacttattttagccgctaatcgagacgagttttacagtcggccttccaagctggcagatttttggggaaataataacgagattctgagcggcctggatatggaggaaggcaaggaaggagggacttggctcggtatcagtacacgggggaagctggcggcgctgacgaactatctgcagccccagctcgattggcaagctcgaggtagaggcgaactcgtaacacactttctgacaaccgatgtggacagtctgagctacttgaaaaaggtgtcaatggagggacatctgtacaatggatttaacctgattgccgcggatttgtctacagctaaaggcgatgtcatctgctattacggaaaccgcggggaacctgaccctattgtcttgactcctggtacctacgggctcagcaatgcgttgttggagaccccctggagaaaactctgctttggcaagcagctcttccttgaagccgtagaaaggtcacaagccctcccaaaagacgtgctgatcgcatctttactagacgtgctgaataacgaagaagctcaactgcccgatcccgctattgaagatcagggcggtgaatatgttcagcctatgctgtctaaatacgccgcagtttgcgtgcgttgtccagggtacgggacaagaacgaacactattatcctggtggatgccgatggccacgttacatttaccgagaggtcaatgatggacaaggacctgtcccactgggagacacgcacttacgaatttacacttcaaagttag

SEQ ID NO: 25279 - DNA, 498 bp, Artificial Sequence
  Description of Artificial Sequence: Synthetic coding sequence
atgtgtatcattttttttaaattcgatcctagacctgtgtcaaaaaacgcctacagattgatcttggcagctaatcgggatgagttctattccagaccatcaaagcttgctgacttttggggcaataataatgagatcctgtcaggactggatatggaagagggtaaagaagggggcacatggctgggaattagcaccaggggcaagctcgctgccctgaccaattacctacagccacaactggactggcaggcccgcggcagaggcgagctggttacccacttcctgactactgacgtcgatagcctgtcatacctgaaaaaggtatccatggagggccatttgtacaacgggttcaacctgatcgcggccgacctctctacagccaaaggtgacgtgatctgctattacgggaaccggggcgagcccgacccaattgttctaacaccaggaacctacgggctgtctaatgccctgttggagaccccttggcgctag

SEQ ID NO: 25280 - DNA, 846 bp, Artificial Sequence
  Description of Artificial Sequence: Synthetic coding sequence
atgcccctaggcgcaggcaccccggttaacgtgcagcgacgagaggatagtgctaccgagggctcccataggctcattcttgcagctaacagggatgagttttactcacgccccagtaaactcgcagatttctggggcaataacaatgagatcctgagcgggctcgatatggaggaaggcaaagaaggcggcacatggttgggtatctcgacccgcggcaagctcgccgccctcactaactacttgcagcctcagctcgactggcaggcgagaggaaggggcgaactagtcacacacttcctgacaactgatgttgactcgctgtcctatcttaaaaaagttagcatggaaggccacctgtataacggcttcaaccttatcgccgctgatttatctaccgccaaaggagacgtgatctgctactatggtaaccgtggggaacctgaccctattgtcttgacccccgggacttacggcctctctaacgcactgctggagaccccatggaggaagctgtgcttcggtaaacagctgttccttgaagcagtcgaacgatcccaagccctgccaaaagacgttcttatagccagtctactcgatgtcttgaacaacgaggaggcccagctgcccgatcccgcgattgaagaccagggaggtgaatacgtccagccaatgctcagcaagtatgccgccgtgtgcgtgaggtgcccaggctatgggactaggactaacaccatcatcctggtagacgcggacggccacgttaccttcaccgagcgttcgatgatggacaaagacctatctcactgggagaccaggacctacgagttcacacttcagtcttag

SEQ ID NO: 25281 - DNA, 324 bp, Artificial Sequence
  Description of Artificial Sequence: Synthetic coding sequence
atggccagtggcgctgccagatggttggtattagcacctgtcaggagcggagctttgaggagtgggcctagcctgcgcaaagacggcgatgtttccgcagcatggtctggcagcggccgaagtctcgtcccttcgagatcggtcatcgttacaaggtcaggcgccatccttccgaagccagtgaaaatgtctttcgggctcctcagggtcttttcaatagtgattccatttctgtacgtgggtacactgattagcaagaatttcgctgcactgttagaggagcacgacatttttgtgcccgaggacgatgacgatgacgattag

SEQ ID NO: 25282 - DNA, 1704 bp, Artificial Sequence
  Description of Artificial Sequence: Synthetic coding sequence
atgatggctgccgtaccccccgggctcgaaccctggaaccgtgtaagaatcccaaaggctgggaaccgctctgccgtgaccgttcagaatcctggagccgctctcgatctttgcatcgctgctgtgatcaaggagtgccatctggttattctgagtctcaagtcacagacgttggacgccgaaaccgacgtgctgtgcgcagttttatactcaaaccacaataggatgggcagacacaagccccatctggccctaaagcaggtcgagcagtgtctaaaacgactcaaaaatatgaacctggaggggtctattcaggatttattcgagctatttagctcaaacgagaaccagccactgacaactaaggtttgcgtggtgccctcgcagcccgttgttgagctcgttttaatgaaggtgttaggggcctgtaaattactgctgcggctactggactgttgctgcaaaactttcctgttgaccgttaagcacctgggtctgcaggagtttatcattcttaatctggtgatggttggactggtgagcagactgtgggtgctctataagggtgtcctgaagcgactcatactcctgtacgagccactgttcgggttactgcaggaggtcgcccgaatccagccgatgccgtattttaaggatttcactttccccagcgacatcactgaatttttaggccaaccttacttcgaagcctttaagaaaaagatgcccatcgcattcgccgccaaagggattaataaactgcttaacaaactgtttctgattaatgaacagagcccccgggcctccgaggagaccctgctgggcatttcaaagaaggccaaacagatgaagatcaacgtgcagaacaacgtggacctcggacagcctgtgaaaaacaagagggtgttcaaggaggaaagtagcgagttcgatgtgcgagctttttgcaatcagctgaagcacaaggccacccaagagacaagcttcgacttcaagtgttcccagagtcgattgaaaacaaccaaatactcctcccaaaaagtgattggaaccccacacgccaaaagcttcgtgcagaggttccgcgaagcagaatctttcactcaattgtctgaagagatacaaatggccgtggtgtggtgtcgctcaaagaaactgaaggctcaggccatcttccttggcaacaaacttctgaaatcaaataggctgaagcaccttgaggcccagggtacctcgctgcccaaaaaactggagtgcatcaagacttctatctgtaaccacctgctgaggggaagcggtatcaagacaagcaaacatcacctcaggcagcggcgatcccaaaataaatttttgcgtcgacagaggaagccccagaggaagctgcaatctaccttactgagagaaattcaacagtttagccaaggaacccgcaaatcagctacagacactagcgcaaaatggcggctctcacactgcaccgtgcaccgaactgacttatacccaaatagcaagcagctgttaaacagcggggtgtccatgcctgttattcagacgaaagagaagatgattcatgagaatctgagagggattcatgaaaacgaaaccgactcctggacagttatgcagattaacaagaactctactagcggcacaatcaaggagacagacgacatagatgacattttcgccctgatgggggtgtag

SEQ ID NO: 25283 - DNA, 1494 bp, Artificial Sequence
  Description of Artificial Sequence: Synthetic coding sequence
atgatggccgcagtgccacccggtctggaaccgtggaatcgcgtcaggataccaaaggctgggaacaggtccgccgtgacagttcagaaccccggtgccgctctggacctttgcattgctgccgtcatcaaagaatgccacctggtgatactgagtctcaagtcccaaacactagacgccgaaaccgatgtgctatgtgctgttctgtacagtaaccataaccggatggggcgacataaaccccacctggcactcaagcaagtggagcagtgcctcaagcgactcaaaaatatgaacttggagggctcaattcaagatctgttcgagttgtttagttcaaaggtgctgtataaaggcgtcctcaagagactgatattgctgtacgagcctttatttggtttactacaggaagtagctcgcatccagccgatgccttatttcaaggacttcacattcccttctgatatcacagagttccttggacagccttattttgaggcctttaagaagaagatgccaattgcctttgccgcaaagggcataaataagctcctcaacaagttgtttctgattaatgaacagagccctcgtgctagtgaggagactctcctggggatctccaaaaaggccaaacagatgaagatcaacgtccagaacaacgtcgatcttggtcagccggtgaaaaacaagagggttttcaaggaagagagcagcgagtttgatgtacgggccttctgtaatcagctcaagcataaggctactcaagaaacatcgttcgactttaagtgcagtcaaagtcggctgaagacaacaaaatacagtagccaaaaggtaattggcaccccccatgctaagagttttgtacagcggttcagagaggctgagagtttcacacagctgtctgaagagatccaaatggcagtcgtgtggtgccggtctaagaaactgaaagcacaggccatattcttggggaacaagttactgaagagtaaccgcctcaagcatctcgaagctcagggaacaagcctccctaaaaagctggaatgcattaaaactagcatttgcaatcatctgctaagggggagcggaataaaaacgagcaagcaccatcttcggcagcggcgaagtcagaacaagtttctgcgccggcagcgtaagcctcagcgaaaactgcaaagcactctgctcagagagatccaacagtttagccagggaaccaggaaaagcgcaacagacaccagtgccaagtggcgccttagtcactgtacggtccacagaaccgacctgtacccaaacagtaagcagctgctgaactcaggagtttccatgccagttattcagactaaagaaaaaatgatacacgaaaatctgcgtggaatccacgagaacgagaccgactcatggaccgtaatgcagatcaacaagaacagtacgagtggcaccatcaaggagaccgacgacattgacgacatctttgctctgatgggcgtctag

SEQ ID NO: 25284 - DNA, 1296 bp, Artificial Sequence
  Description of Artificial Sequence: Synthetic coding sequence
atgaaggtgctgggagcctgcaaactccttctcagactcctcgattgctgttgtaaaactttcttgcttaccgtcaaacacttggggctgcaagaattcattatacttaatctggtgatggtcgggctagtaagccgcctttgggtcctgtacaagggggtgctgaaacgcctgatcctactgtacgaacctctgtttggtctcttacaagaggtggcccgtattcagcccatgccatacttcaaggacttcactttcccttccgacatcacagagttcctcggccaaccatactttgaggccttcaaaaaaaaaatgcctatagcgttcgctgctaagggcatcaataaactactgaacaaactgtttctgattaacgaacagtcccctcgcgcaagcgaagaaaccttactcggcataagtaaaaaagccaagcaaatgaagatcaacgtacagaataatgtggacctgggccagcccgttaaaaataagagagtcttcaaagaagagagctcagagtttgacgtccgcgccttttgcaaccaactgaaacacaaagctacacaggagacatctttcgactttaaatgttcccagtcgcgtctaaagacaacaaagtacagctcacaaaaagtcattggtactccccatgcaaagtcgtttgtccagaggtttcgcgaagccgaaagttttactcagctatccgaagagatccagatggcagtcgtatggtgtagaagtaaaaagctcaaagcccaggcaatttttctgggtaataagcttttgaaatccaatagactcaaacacctagaggcccaaggcacgtcattaccgaaaaagttggaatgcatcaaaacttcaatatgcaatcatctgcttaggggcagcggcattaagacatctaaacaccatttgagacagagaagatctcaaaataagttcctgcgacgccagaggaagccacagcgcaagcttcaatcaacattgctgcgggagattcagcagttctcccagggcacccgcaaaagcgccaccgacacctccgccaaatggagattatcccactgcactgtgcaccgcacagacctctaccccaatagcaaacagcttctaaacagcggtgtttctatgcctgtgattcagaccaaggagaaaatgatccatgaaaacctgcgagggatccatgaaaacgaaactgactcctggaccgtgatgcaaattaacaagaattccacttcaggcaccattaaggaaactgacgatatcgatgacatctttgcgttaatgggggtctag

SEQ ID NO: 25285 - DNA, 645 bp, Artificial Sequence
  Description of Artificial Sequence: Synthetic coding sequence
atgcccaaggtgctctgtaaggacagcgagcggttgtcaccatcccataatttccttaaaaagtctagatggcagctctatggagctggtaagaagcttaaggcccaggccatttttttgggtaacaaactcctcaagagcaacagactgaagcacctggaggcccaaggcacatccctgcccaagaaattggagtgcattaaaacgagtatctgcaaccatctgctcagaggatctggaattaaaactagcaagcaccacctcaggcaacgacgctcccagaataaatttctcagaagacagcgaaagcctcaaagaaaactccagtcaacactgcttagggaaatacaacagttcagccagggaactagaaagagcgctacggacacatctgccaaatggcgtcttagccactgcaccgtccatcggacagacctctatcccaacagtaagcaactgctcaacagcggggtctcgatgcccgtgattcagactaaagagaaaatgatccatgagaacttgcggggcatccacgaaaacgagactgatagctggaccgtgatgcagatcaacaagaattcaacatcaggaaccattaaggaaacagatgacatagacgatatattcgccttaatgggcgtatag

SEQ ID NO: 25286 - DNA, 489 bp, Artificial Sequence
  Description of Artificial Sequence: Synthetic coding sequence
atgaattcccggaccgcaagtgcccgaggttggttttctagtcggccccctacatcggagtccgatctagaaccagccactgacggccctgccagtgaaaccactacgctgagccccgaggccacaacattcaatgacacaagaatccctgacgctgctggcggaacggcaggagtgggtaccatgctgctcagctttggcattattacagtgattggtctggctgtcgctctggtgctctacattagaaaaaagaagaggctcgagaaactccgtcatcaactcatgcccatgtataatttcgaccctaccgaggaacaggacgagttggagcaggagttgctggagcatggacgggatgctgccagtgtgcaggccgccacaagcgttcaggccatgcaaggcaaaactaccctgccctcccaagggcccctgcaaagaccgagtcgcttagtgtttaccgatgtggcaaatgcaattcatgcctag

SEQ ID NO: 25287 - DNA, 489 bp, Artificial Sequence
  Description of Artificial Sequence: Synthetic coding sequence
atgaattctcggacggcgtctgccaggggctggttctcctcccggccgccaactagtgagtcagacctcgaaccagctacagatggcccggcctccgaaacgaccacattaagtccagaagcgactaccttcaatgatacccggatccctgacgccgcaggcggcacagccggcgtaggcaccatgcttttatcatttggcatcattaccgtgattgggcttgccgtcgccttagtgctgtatatcagaaaaaagaagcgcctggagaagctgcgtcatcagctcatgccgatgtataatttcgatccaactgaagagcaggatgaattggagcaggagctgctggaacatggacgggatgctgcctccgtccaggcagcgactagtgtccaggctatgcagggcaagaccaccttaccaagccagggtccactccaaaggccatccaggctggttttcacagacgtggcgaatgccatccacgcctag

SEQ ID NO: 25288 - DNA, 429 bp, Artificial Sequence
  Description of Artificial Sequence: Synthetic coding sequence
atgaactccaggactgctagtgctcgcggctggtttagctcacggccacccactagcgagagtgacctggagcccgctactgatggacccgccagcgaaacgacgacactcagcccagaggctactacctttaatgacactcgaatcccagatgctgctggcggaactgccggggtgctgtacatccggaagaaaaaacgattagagaaattacggcaccaactgatgcctatgtataactttgatcccacagaagaacaagatgagctggagcaggagctccttgagcacgggagagatgctgcgtcagtccaagctgctacatcagtccaagctatgcagggaaaaacaacactgccgagccaggggcccctccagcgcccatcacgcctggttttcacagatgtggctaacgcgatccatgcatag

SEQ ID NO: 25289 - DNA, 489 bp, Artificial Sequence
  Description of Artificial Sequence: Synthetic coding sequence
atgaatagccgcactgcgtctgcccgggggtggttctcatcaagacccccgacttccgaatccgacttggagccggccacagacgggccagcaagtgaaaccacaacattgagccccgaagccaccactttcaacgacactcggatacccgacgcagctggcggtactgcaggggtgggtacaatgctattatcattcggcatcattactgtgattggattggcagttgcactggttttatatatcagaaagaaaaaaagacttgaaaagctcagacaccagctaatgccaatgtataatttcgatcccacagaggagcaggatgagctggagcaagaactactggagcacggccgtgatgctgctagcgttcaggccgccacttccgtgcaggctatgcagggcaaaacgacgctgcccagccagggtccattacagcggccaagtcggctcgtcttcacggacgtagctaacgcaatacatgcttag

SEQ ID NO: 25290 - DNA, 2715 bp, Artificial Sequence
  Description of Artificial Sequence: Synthetic coding sequence
atgagctacattaaatctaatctggaactctatcaacagtacactgctatggccccaaaactgttagcccggatctctaaactccttatgatctgtcagaatgccgggattagtgtgccgaaggggattagaaatatcttcgaatttacttgggaagaactcataagcgatccatcagtcccaacaccctcagacatcctcggcctggaggtttcctttggcgccccactcgtggtgctgatggagcccactttcgtgcaagtccccactctcaaaaagcccctgcctcctccccccccagccccacctcgacctgtgctcctggccactaccggggctgccaaacgcagcactctttcccctacgatggcccgtcaggtacggacccaccaggagactctcaaccggttccagcagcagagcatccacctgttgactgaattgctgaggcttaaaatgaaggccatggtggaatcgatgtctgttggggccaatccactagacatcactcggagattcgtagaagccagccagctgctgcatctgaatgcgaaggaaatggccttcaattgtctgatcagcacagcagggcggtccgggtacagctctgggcaactttggaaggagtcactcgctaacatgtctgctattggagttaactctccgtaccagctgatatatcacagtagcacagcttgcttgagcttttcgctgtctgctggcaaagaggctaagaagaagataggtaagagtaggactaccgaggacgttagcatgccacccttgcacagaggagtggggactcccgctaactctcttgagttctccgatccctgccccgaagctagggaaaagctgcaagaattgtgtaggcatatagaggccgaaagggctacatggaagggacggaacatctcctatcctatgatcttgaggaactataaggcaaaaatgccctctcatctcatgctggcaaggaagggagatagccagacgccaggcttgcactatccacctactgccggagctcaaaccctcagccccacctcacatccgagcagtgccaaccatcactttagtcagcactgccaggaggggaaggctcccaaaaaagctttcaagtttcattatacattctacgacggcagcagcttcgtgtactaccctagcgggaacgtggcagtatgtcagattcctacgtgttgccgggggcgcaccataacatgtctgtttaatgacatccctggattttcactgctggctctcttcaatacggaaggacagggctgtgtacactacaatcttaaaacttcttgcccctacgtcctcatcctggatgaggaagggggcactacaaacgatcagcaggggtacgtcgtccacaagtggtcatggacctcccgcacggagacactgctaagcctggaatacaaagtgaacgaggagatgaaattgaaagtgctcgggcaggattcaataacggtgaccttcacatcactaaatgagactgtgacgctgaccgtgtctgcgaataactgccctcatggaatggcatacgacaagcggttaaatcgacggatcagcaatatggacgacaaggtgtataagatgagtcgcgctttagctgaaatcaaaaaaagattccagaaaacggtcactcagtttatcaatagtattctgttagctgccggactcttcaccattgaataccctacaaaaaaagaagaggaggagttcgttagattcaagatgagatcacgaacccatcccgagagacttcccaaactgtcgctctatagcggggagagtctcttaagatctcaaagcggtcatcttgaaagctccatcgccgagaccctgaaggacgagcccgagagcgcaccggtgtcacctgtgagaaagacaacaaaaatacacaccaaggctaaggtgacgtcccgggggaaagcgagagagggacgctctcccacaaggtgggccgcactccccagtgattgtcctttggttctgcgcaaacttatgttgaaagaagacacccgggcagggtgcaaatgcctggtaaaggctcctctggtcagtgacgtcgagctggagagatttctactggcgcctagggacccatctcaggtgctcgtgttcggtatcatctctagccagaattatacgtccacaggccagttgcagtggctgctgaatacgttatacaaccatcagcaaagggggcggggttccccttgcattcagtgtaggtatgactcttatcgcctactgcagtacgacttggactctcccctgcaggaagaccctccactgatggtgaaaaagaacagcgtggtgcaaggcatgatactcatgttcgccggggggaagctgatattcggaggacgtgttctgaatgggtacggactgtcaaagcagaacctgctgaagcagatttttagatcacagcaggactataaaatgggctattttctgcccgatgactataagttcagcgtgcctaactctgtcctgtctctggaagatagcgagtcagtaaagaaggcagagtctgaggacatccaaggaagcagctcctccctagcacttgaggattacgtcgagaaggagctgtcactggaggctgagaaaacgcgtgagccagaggtggagttgcaccctctttcgcgagattccaaaattacatcatggaaaaaacaggcctctaagaagtag

SEQ ID NO: 25291 - DNA, 2349 bp, Artificial Sequence
  Description of Artificial Sequence: Synthetic coding sequence
atggctcgacaggtgaggacacatcaagaaactctgaacaggttccagcagcaatcgatccacctgctgaccgagctgcttcggctgaagatgaaggctatggtggagtcgatgtcagtgggagccaatccgctggacatcaccaggagatttgttgaggcaagccagcttcttcacctgaatgcaaaagaaatggcattcaactgccttatttcaaccgctggcagatctggctacagcagcggacagctgtggaaagaaagcctggccaatatgtccgccattggggtgaacagtccgtaccagttaatctatcactccagcaccgcttgcctgagctttagtttatctgccggcaaagaagcaaaaaagaagatcgggaaatctcgcactacagaggacgtttctatgcccccactacatcggggggtgggtacacccgccaattctctggaatttagcgatccatgtccagaagccagagaaaaattgcaggaattatgtaggcacatcgaggccgagcgggctacttggaaggggcggaacatctcatacccaatgatccttagaaactacaaggcaaaaatgccatctcaccttatgctggctagaaaaggggacagtcagaccccagggctgcattacccaccaaccgccggtgcccagacacttagtcccacttcgcacccaagcagcgcgaaccaccacttctcgcaacattgccaagagggaaaggcccccaagaaagcgttcaaattccactataccttctatgatggaagtagctttgtctactacccctcaggcaatgtggccgtgtgtcaaattccaacctgctgtcgaggaaggaccatcacttgtttattcaatgatatcccaggcttctctctcctggccctctttaacacagaaggtcagggttgtgtgcactacaaccttaaaacaagctgtccatacgtcctgatcttagacgaagagggagggacaaccaatgaccaacaaggttacgtggtccacaagtggagctggacctcaagaacagaaacgctccttagcctcgaatacaaggtgaatgaagaaatgaaacttaaggttctcggtcaagatagcatcaccgtgacattcactagtttgaacgagactgtcaccttaactgtctccgcaaacaactgcccacacggaatggcgtacgataagcgcctaaataggagaatcagcaacatggacgacaaagtttacaaaatgagccgagcactcgcagaaataaaaaagcgattccaaaagaccgttacccagttcatcaattctatcctcctggccgccgggttgtttaccatcgaatatccaaccaagaaggaagaggaggaattcgtaagatttaagatgcgaagccggacgcacccggaacgcctgcctaaactctcgctctatagtggcgagagcttgctgcgctcacagtccggacacttggagtcctccatagccgaaacgctgaaagatgagcccgagtcggccccagtgtccccagttaggaagaccaccaaaattcacaccaaagccaaagttacaagccggggcaaagcccgtgaagggcggagccctacgagatgggccgcattaccgagcgactgtcccctcgtgttaaggaagctgatgctgaaggaagatacccgggccgggtgcaagtgtttggtaaaggctcctttggtgtctgatgtcgaactggaaagattcctcctggcgcctcgggacccttcacaggtgttggttttcggcatcataagttctcagaactacacttcaacagggcagcttcagtggctattgaacacactgtataatcaccaacagagaggcaggggaagcccatgcattcaatgccggtatgacagttatcgcttactgcaatacgacttggatagccccctgcaggaagatcctcctcttatggttaagaagaattccgtggtgcaggggatgatactgatgtttgctgggggaaaactaatatttggcggcagggtgctcaatgggtacggactgtcaaagcaaaatctgctcaaacagatcttcaggagccagcaggactacaaaatgggatacttcctgcctgacgactacaaattcagcgtgcctaatagcgttctgagtctcgaggacagcgagagtgtgaagaaagctgaatctgaagacatccaaggttcctcttcctccctagcgttagaggattatgtggagaaagaactgagtctagaagctgaaaagaccagggaacccgaagtggagctacacccgcttagcagagatagtaagatcacctcgtggaaaaagcaggcctctaagaaatag

SEQ ID NO: 25292 - DNA, 2349 bp, Artificial Sequence
  Description of Artificial Sequence: Synthetic coding sequence
atggcgcgacaggttcgtactcaccaggaaaccctgaaccggttccagcagcaatcgatacaccttctgactgagctgctgagactgaaaatgaaagccatggtagagtcgatgtctgtgggggctaatccactggacatcacccgccgttttgtggaggccagccaactgctacacttgaacgcgaaggaaatggctttcaactgtctcattagcacggctgggcgtagcggctactcaagcggtcagttatggaaagagtccctggcgaatatgtcggccatcggagttaatagcccgtaccagctcatttaccacagctctaccgcatgcctatcctttagcttaagtgctggcaaggaggctaagaagaaaatagggaagtcacgtactactgaggacgtcagcatgccaccgttgcacagaggagttgggacaccagccaacagcctggaattttccgatccttgcccagaagccagagagaaattgcaagagctttgtcggcacatagaagccgaacgcgccacctggaaaggccgcaatatctcatacccgatgatattaaggaattacaaggccaagatgccctcgcacctgatgttggccaggaaaggagattcccagaccccaggcctgcactacccccctactgcgggtgcccagactctgagtccgaccagccaccccagtagtgccaatcatcacttcagccagcactgtcaggaggggaaggccccaaagaaagctttcaagtttcactacacgttttatgatgggagtagcttcgtctactaccccagtgggaatgtggccgtctgtcagatacccacttgttgtagaggacgaaccatcacctgtctcttcaacgatatccccggtttttctctcctagcattgttcaataccgaaggccagggctgcgtgcactacaatctgaagactagctgcccgtatgtactgattctcgacgaggaaggaggcactacgaatgaccagcaggggtacgtagtccacaagtggtcatggacatcacgtactgagactttattatctcttgagtataaggtgaacgaggaaatgaaactgaaagtcctgggccaggattcgatcacggttacatttacatcactgaatgagaccgtgaccctcacagtgagcgctaacaattgccctcacggaatggcatatgacaagcggctgaacagaagaataagtaacatggacgataaggtgtataaaatgtcacgggctcttgccgagatcaagaagaggttccagaaaactgtgacacagttcatcaatagtattctcttagcagcaggcttattcacgatcgagtatcccaccaagaaagaggaggaggagtttgttcgattcaagatgaggtcccggacgcacccagagagactacctaaactgtcactctatagcggggagtctcttctgagatcacagtccggacacctcgaatcaagcatagcagagacactaaaggacgaacctgagtcagcccccgtttcgccagtcagaaaaacaaccaagatacacactaaagctaaggtcacctcacgcggcaaagctcgagaaggcagatccccaactagatgggcagccttgccatctgactgtccactggttctgaggaaattgatgctcaaagaagacactcgggccggctgcaagtgtctggtgaaggcacccctcgtctccgacgtggagctggagagatttctgctggcccctagggaccctagccaagtgctcgtatttggcattatctcctcccagaactacacgagtacgggccagttgcagtggctgttgaacacattatataaccatcagcagcgggggaggggaagtccttgcatccagtgccgctatgacagctaccgcctgcttcagtacgatctggactcaccattacaggaggacccccccctgatggttaagaaaaatagcgttgtacagggaatgatactgatgtttgctggcggtaagctcatattcggaggccgtgtgctcaatggatacggactctccaaacagaaccttttgaagcagattttccgctcacagcaggattacaaaatgggctacttcctgcccgatgactataagttctcggtgcctaacagcgttctctcactggaagactccgagtcagtgaaaaaggcagaaagtgaagatatacaaggatcctccagttcccttgccctcgaagactatgtcgagaaggagttaagcctggaggcagaaaagacccgtgaacctgaggtggaactgcacccattatccagggattctaagatcacctcttggaaaaagcaggccagtaaaaagtag

SEQ ID NO: 25293 - DNA, 1491 bp, Artificial Sequence
  Description of Artificial Sequence: Synthetic coding sequence
atgttttgtcatctgcgtccaatgagaagattgtgcctggagaaaatctttccccattggtttcctttcagcagagccctgagtggggcagaggccgtgaatgctttacggcctttctatttcgccgtacatcccgattttttcggacagcaccccgtcgaaagagaaataaacgagaattccctgaaacggctgtcagtgtacctggaaaatctccaaaagcctgggttcaaatccctgaagcctactcagctcaccttctacgtccgtgagacagaccagtctagctcagatggacaggaaccgttttcaacctcaggcttccgggccgttaaattcacacttcacactcgagatcttttgtcaaccgtcctttatatcctcaattcctgctcgctgtccgtggagcacatccagtctttgaacactaacatgcatactcagcccctgaaggaagccaaaaggatgccagacaggcctattaaatgggacaagtcgtactactcgttcacaggtttcaaggaccccgacgaggatttggagcaagtaagtagagtggaaacaacactaacctcatggctcgataacaacggaaaaagtgccgtaaaaaagctgaaaaactctctccccctccgcaaggagctggaccgcctgaaagacgaactctcacaccagctccaattgagcgacatccgatggcagcgtagttggggcattgcccataggtgctcacagctgcatagtctgtcgagattagcacagcagaacctggagaccttgaagaaagcgaagggatgtacaatcatctttactgataggtccggcatgagtgccgtaggccacgtaatgctgggtacaatggacgtccatcatcactggacaaagttatttgagagacttccttcctatttcgatctgcagcgtcggcttatgattctggaagaccagattagctacctgttgggtggcattcaggtggtatatatagaggagctccagcctgtgctgaccctagaggaatactattcactgctcgatgttttctataaccgcctcctgaaaagcaggatcctgtttcatccccgctcgctgcggggcctgcagatgattctgaattcggaccgctacgcgccctccctccacgagttggggcactttaatataccaaccctgtgcgaccccgccaatttgcagtggttcattctgactaaggcacagcaggctagggaaaatatgaagcgaaaagaagagctgaaagttatcgagaacgagctaattcaggcttctacgaagaagttctctcttgagaagctgtataaggaacctagtataagcagtattcagatggtggattgctgcaagcgtctcctggagcaatccctaccctacctacatggcatgcatctgtgtatcagtcacttctactcagtcatgcaggacggggacttgtgcattccatggaactggaagaatggcgaagccattaaatag

SEQ ID NO: 25294 - DNA, 213 bp, Artificial Sequence
  Description of Artificial Sequence: Synthetic coding sequence
atgttctgccatctgcggccgatgcggcggctgtgcttagagaagatctttcctcactggtttccattctctagagccctgagcggcgcggaagccgtcaacgctctacgacctttctattttgctgtacacccagacttcttcggccagcacccagtcgagagggatgatacatggaagtccttccaatgtccatctgacttttctctgtag

SEQ ID NO: 25295 - DNA, 213 bp, Artificial Sequence
  Description of Artificial Sequence: Synthetic coding sequence
atgttctgtcatctgcgcccaatgcggagactctgtctggagaaaatttttcctcattggtttcctttctcccgagccctcagtggggccgaggccgtaaatgcactaagaccattctacttcgcggtgcatcccgattttttcggacaacaccctgtagagagagacgatacctggaagtccttccagtgcccctccgacttcagtctctag

SEQ ID NO: 25296 - DNA, 1491 bp, Artificial Sequence
  Description of Artificial Sequence: Synthetic coding sequence
atgttttgccatctgcggcccatgagacggctttgcttagaaaagatcttcccgcactggttcccattctcacgggccctgagcggagctgaggcagtgaacgctctgcggccattttatttcgccgtacatcctgacttttttggtcagcatcctgtggaacgcgagatcaacgagaattcacttaagcgcctgtctgtgtaccttgagaacctccagaaaccagggtttaaaagcttgaagcctacacaactgaccttttacgttcgagaaaccgatcagtcatctagcgacggacaggagccgttttctacttctggcttcagggccgtaaagttcacactgcacactcgggaccttctgtccaccgtgctgtacatcctcaactcctgttctctaagtgtggagcacatccaatctcttaataccaacatgcacacacaacctctcaaagaggcaaaaaggatgcctgaccgtcccatcaagtgggacaagtcgtattactcctttaccggctttaaagaccccgatgaagacttggaacaagtgtcaagagtcgagacaacattaacgtcctggttggataataacggcaaaagcgcagtcaagaaattgaaaaactctcttcccctgcgcaaagaactggacagacttaaggatgaactgagccatcagctgcagttgtctgacatacgctggcagcgttcatggggcatcgcccatcggtgttcacagctgcattctttaagccggttggctcagcagaacctggaaaccctgaagaaagccaagggatgtacgattatctttaccgaccgtagcggaatgtctgcagtcggccacgtaatgctgggaaccatggacgtccatcatcactggaccaagctgttcgagagactgccctcatactttgacttacaacggagactcatgatattagaggatcagatctcctaccttttgggcggcatacaagtggtgtacatcgaggagctgcagcccgtgctgacactagaggaatactactccctcttagacgtcttctataacagactactgaagtcacgaatcctttttcatccaagatcattacgcggcttgcagatgatcctgaatagtgacaggtacgctccatccctgcacgagctgggccatttcaacattcctactctttgtgaccccgccaatcttcagtggtttattttgaccaaagcacagcaggctcgcgagaacatgaaaagaaaggaggagctcaaagtgatcgagaacgaactgatccaggcatcaaccaagaaattctctctggaaaaactttacaaggagccatccatctcttctatacaaatggttgattgctgtaagaggctgctggagcagagcctgccgtatctgcatggcatgcatctctgcatctcccacttttatagcgtgatgcaggatggcgacctttgcattccttggaactggaagaacggagaggctattaagtag

SEQ ID NO: 25297 - DNA, 885 bp, Artificial Sequence
  Description of Artificial Sequence: Synthetic coding sequence
atggctggccagccggcggcgaccggctcaccttccgccgataaagatggtatggaaccaaacgtcgtggctcgcataagccagtgggcagacgatcacttacggctcgtgcgcaacatctccaccggtatggctattgccggtatcatgcttctgctccgtagcataagactgacctccaagttcacatccagctcagacattccagtggagtttatcagaaggaacgtgaagctaaggggcagactgaggcggattacagagaatggactagaaattgaacacatccctatcaccctgcctatcatcgcatcattacggaaggagccacggggtgctcttctggtaaaactcgctggagtggaattggctgaaactggaaaggcttggctgcaaaaggaactgaagccatcccaacttttgtggttccagttgttgggaaaggaaaattctgcgctattctgctacttgctggtgtcaaagggaggctatttctcagtcaatctcaacgaagaaattctacgccgcggcctagggaagacagttttggtgaagggtttaaaatatgactctaagatttactggacagtgcaccgcaacctgctgaaagcagaactgacagccttgaaaaaaggcgaaggtatttggaaagaagattccgaaaaggaaagctatctagagaagttcaaagacagctggagggaaatctggaagaaagattcatttctaaaaacgaccggatcagacttctcccttaaaaaggagtcctattacgagaaacttaaacgcacgtacgagatatggaaggacaatatgaacaactgctctcttatattaaagttcagggagcttatctccaggatcaatttcaggagaaaaggctag

SEQ ID NO: 25298 - DNA, 756 bp, Artificial Sequence
  Description of Artificial Sequence: Synthetic coding sequence
atggctatcgcagggataatgctcctcttgcgctccattcgtctgacctccaaattcacttcctcttccgacattcctgtcgagttcataaggcggaacgtgaagctgagagggcgtctccgcaggatcacagagaacggtctcgaaatcgagcatattcccattaccctgcctatcatagcaagcctgaggaaggaaccacgaggagctctcctcgtgaagctcgcgggcgtagaactggctgagacagggaaagcatggctgcaaaaggagctcaaaccatctcagctgctctggtttcagttgctcggaaaagagaattctgcactcttctgctacctcctggtctcaaagggcggctatttcagcgtgaacttaaatgaagaaatccttcgtcggggactcggaaaaaccgtcctagtaaagggtttgaagtacgattcgaaaatttattggacagtgcatcgtaatctgctgaaggcggagttaacggctcttaagaaaggggaaggtatttggaaggaggatagtgagaaagagtcatatctggaaaaattcaaagacagttggagggaaatctggaaaaaggatagcttcctcaagacaactggcagcgacttctccctgaagaaagagagttattacgagaagctgaagaggacttatgaaatctggaaagacaacatgaataactgctccttgatcctgaaatttcgggaactcattagccgtatcaactttaggcggaagggatag

SEQ ID NO: 25299 - DNA, 885 bp, Artificial Sequence
  Description of Artificial Sequence: Synthetic coding sequence
atggctgggcagcctgcagcgacaggctcgccttccgccgacaaggatggaatggagcctaacgtcgtggcccggatctcccaatgggccgatgatcatctcaggcttgtacgcaatatttctactggcatggccatcgcaggcatcatgctgttgctgcgcagtatacggcttactagtaagttcacaagcagttctgatatcccagtggagtttatccgccgtaacgtcaaactgcggggaaggttgcggcgcatcacagaaaatggcctggagatcgagcatattcccatcacgcttcctatcatcgcaagccttcgcaaagagcccagaggggccctgctagtcaaattagcaggggtggagcttgcagaaaccgggaaggcctggctccagaaggagctgaagccatcacaactgctgtggttccagctgctggggaaagagaacagtgctctgttttgctatttactagtctccaagggggggtacttctctgtaaacctaaatgaagagattctgcgtagaggactcggcaagacggtacttgtgaaggggctgaagtatgattccaaaatatactggaccgtccacaggaacttgctgaaagccgaattgacagcgctgaaaaaaggggaagggatttggaaggaggactcagagaaagaatcctatctggagaaatttaaggacagctggagagagatctggaagaaggactcctttcttaagacgaccggatctgacttctccctgaaaaaagagtcctattatgagaaactcaaacggacatacgaaatctggaaggataatatgaacaattgcagtctcatattgaaattccgtgaactcatatcaaggatcaacttccgccgcaagggctag

SEQ ID NO: 25300 - DNA, 513 bp, Artificial Sequence
  Description of Artificial Sequence: Synthetic coding sequence
atgaaaaccatggcaacaagaaagcgatgcaagctgtctcggaccggtccagaatttgaaaacgtgattaaaaggctgttgtgcgctcggacatttcacaccaggatcggcggtgatctgacacatggcatcattaacagggggcgccgagctaacgccgagcagatgggtctgcagggatctgcccagcattttaacatctttcctctcgatctttggacacaggggaagaagacggaggtccaaaagagagagggtacagactctataccggccgctggtcgctccggaacagctaaccagccttccattgcgcctcataggtgcttgttcagcaggggtatcacagcgctggacgggcttaagaggggaaggggatgcaatggagcagcacatctagttcggggtgacgcttggaagactaaacttggagaaccctgggtgtcaatagcgctcgccttggcgggccccggagcgatcctgattctggagctctcctggttcctcggttag

SEQ ID NO: 25301 - DNA, 360 bp, Artificial Sequence
  Description of Artificial Sequence: Synthetic coding sequence
atgaagacaatggcaactcggaagaggtgcaaactgagcagaactgggcccgaattcgagaacgtcattaaaaggcttctgtgcgcccggacgttccataccagaatcgggggtgacttaacacacggcataatcaaccgaggtcgccgcgcgaatgccgaacagatggggttgcagggcagcgcacagcatttcaacatcttcccactcgacctctggacacagggggactgcatgctagtcagcctggcaaagaataaggtcaacgtgtttggagctatcatcaatatggctgccagcgtgagcggcgtgataggtggactgaagttttcaaggacatactatgtgaaaggcatttag

SEQ ID NO: 25302 - DNA, 360 bp, Artificial Sequence
  Description of Artificial Sequence: Synthetic coding sequence
atgaagacaatggccacacggaaacggtgtaaactgagtaggacaggccctgagttcgagaacgtaattaaacggctgctgtgtgccaggacattccacaccagaatcggcggtgacttgacacacgggatcatcaatcgcgggaggcgagccaatgcagaacagatggggttgcagggctctgctcagcacttcaatatcttccctttagacttgtggacacaaggcgattgtatgctcgtctcgctcgcgaaaaataaagtgaacgtgtttggagccattatcaatatggccgcgagcgtgagtggggtgatcggggggctcaaattcagccggacctattatgtaaaagggatatag

SEQ ID NO: 25303 - DNA, 360 bp, Artificial Sequence
  Description of Artificial Sequence: Synthetic coding sequence
atgaaaacgatggctaccaggaaaaggtgtaaattgagtagaactggccccgagtttgagaatgtgatcaagaggttactgtgcgccaggacctttcatactcggattgggggcgacctgacacacggaatcatcaaccggggcagacgcgcaaatgcagagcagatgggccttcagggaagcgcacaacactttaatattttccccctggacctgtggacacagggcgattgcatgctcgtgagcctggctaagaacaaggtcaacgtgttcggggccataatcaatatggctgccagtgtctccggcgtcatcggcgggctgaagttctcacgaacatattatgtgaagggaatctag

SEQ ID NO: 25304 - DNA, 237 bp, Artificial Sequence
  Description of Artificial Sequence: Synthetic coding sequence
atgaaaacgatggcaacccggaaacgatgcaagctgagcaggaccggaccagagtttgaaaatgtcatcaagaggctgctgtgtgcaaggacattccacactcggataggaggggacctgacgcacggaataatcaatcgaggcaggcgagccaatgctgagcaaatgggactccaggggtctgcccaacacttcaacatcttccccctggacctctggacccaggggaagaagtag

SEQ ID NO: 25305 - DNA, 645 bp, Artificial Sequence
  Description of Artificial Sequence: Synthetic coding sequence
atgaacaacgaaacaacaaccctgatttccctgaaggaagctatgaaaagagtcgaccacaagttgcaggccctagaaactcaatttaaggaactcgacttcacgaaggataaccttatgcagaagttcgaacaccattcaaaagctttggcttcccaggcagcccaggacgaaatgtggactgcggtgcgggcccttcagttgacctccatggagttgaatatcctatacagttacgtcatcgaagttctgatctgcctacataccagagttctcgagaaactgccagacttagtgagaggattgccaactctggcatccgtcttacggagaaaggtgaaaaataaacgtgtgcgcgtggtatgggaaagcatcctcgaggaatgcgggctgcaggagggagatatcactgccctgtgcacattcttcatagcaaggggcaacaaagcggagcattataccgccaaggtgcgacagatgtacatccgggatgtgaccttccttatcaccaacatggtaaaaaatcaggcattacaggattcattgttgcgagctgtacaagtgattgagaagggcaaagcagttcggacccccgagaaacagaagtctagcctggaggagcttattccttccgtaaagaactag

SEQ ID NO: 25306 - DNA, 495 bp, Artificial Sequence
  Description of Artificial Sequence: Synthetic coding sequence
atgccatcgctcgcgcccgactgccccctgctggccatgcccgaagagacacaggaagattccgttgctcccatgatgccttcccagagaagcaggggcccactcgctccaaatcacgttcatgaggtctgtttgcaccaggtcgaatccatcagtgatctgcacagtggggcgggtaccctgcgcccctatttgactgaggaagcaaggccctgggatgagctgctcggggtgctcccgccttctttgtgtgctcaggctggctgtagtcccgtgtaccggcgggggggctttcttctactgctcgctctgctggtcctgacttgcctcgtgctggcattactggcagtatatctgtccgtcttacagagtgagagcctgcgcattctcgcccatactctgaggactcaggaggaaactttacttaaactgcggctggccagtttgtctcagctccgcagattgaattcctcggaggcccaggcgccttcctag

SEQ ID NO: 25307 - DNA, 219 bp, Artificial Sequence
  Description of Artificial Sequence: Synthetic coding sequence
atgaaggtagtcgggaattatcgagttaacacagctaatagctcgactgacacctccggagagcacctgacttgtctaaggagtcagctgttcgtggcataccgcaatgggcgagttgacgaggctgtgtccttagggttcttggactgctggatcgggggcgatctcacgaacttcaagggctgctacctcacaaatcagctcccaattcagttttag

SEQ ID NO: 25308 - DNA, 873 bp, Artificial Sequence
  Description of Artificial Sequence: Synthetic coding sequence
atgcttggtcagcgagctggcgatggcgagcgcccaggcctgcctggagacggcgaaggcggagtgcctgcgcggcctgggcggcgcgcggaacgcccacctcagcgccccgccaaggttaataaggccgtgacctgtgcagctcacttgccaggcgccgccgcctccagaccactctcacctaacaaacctgatcgcgtgcggcctggccagagagatcggataggcgcaaaacggcagagacgccgaagggccgacgccggtcaggccagggctgccagcagccgccgcgtcgttccgacagcacccgaagtcttgggagctgtggctagcttgcctgaccggggtcgaccaaccgtggccagagtcgctacgggttccaggctggagggactcttctcagctgcttctctgaagctgtctgccctgacgcagagcctgacaagagtgagacaggccccaaccgcatccggcgccactatccgattgcctgcatctccagtcgaaatgtttttgaccagtgccttcctcactgggtttagcttccactgtctgtattccggcattggacacggcgaagatatactcgctagcgtcgagcagattaccatagtaagtcggccactttccggtcaacgcggtgccggtccaggaaatagtgcctatactccaagacgctcccagggagggccacgcgccgctacaactcctggcttcaggtttccttgcagaggactggtcaggcgggccgtcctgagactgactgtgactgtgcaagattgtatactcactgccctgttggcagtgagtttccactccataggagtcgtaatcatgacgtcttcttatttactgggacccgttgtcaagtag

SEQ ID NO: 25309 - DNA, 213 bp, Artificial Sequence
  Description of Artificial Sequence: Synthetic coding sequence
atgttcacccgggcacaagttagaaggatcctgcaaagagtgcctgggaaacaacggttcgggatctaccgctttctgcccttcttttttgttctgggaggcacaatggaatggattatgattaaggtgagagttggccaggagaccttttacgatgtgtatcggcggaaggcctcagaaagacagtatcagcggaggctcgaggacgaatag

SEQ ID NO: 25310 - DNA, 3189 bp, Artificial Sequence
  Description of Artificial Sequence: Synthetic coding sequence
atggaaagccaagagttcattgtgctctatacacatcagaagatgaaaaaaagtaaggtgtggcaagacggaattctgaaaattacacacttagggaataaagcaattctgtatgacgacaaaggtgcctgtctcgaatccctattccttaaatgtttggaggtgaaaccaggcgacgaccttgaaagcgaccgctacctgataaccgtagaggaagttaaggtggcgggggcgattggcatagtcaagcagaatgtgaataaagaagctcccgagctgaattccaggacattcattagctcaggaaggtctctaggttgtcagccaagcggcttaaagcgcaaattcacaggattccagggcccgcgccaggtgcctaaaaagatggttattatggagtccggtgagagcgccgctagccatgaggctaaaaaaacaggcccaactattttttcccctttttgttctatgccaccattatttcccacagtggggaagaaggacgtaaacaacattctcgccgacccggaaaatatcgtgacctataaaaatcgcgagcggaacgcaatggactttagctctgtgttctctccttctttccagattaatccggaggtgctgtgtgaggagaattatttttgtagtccagtcaattccggcaataaattgtccgatagcctgctgaccaatgagcccgtgaaacgagactctctggccagccattactccggagttagtcaaaatatccggtcaaaggctcagatactcgctcttttgaaatcagaaagcagcagttcttgtgaggagctaaactctgagatgactgagcattttccccagaagcagccacaggggagcctcaaaatcgccactaagcccaagtatctcatccagcaggaagagtgtgccgagatgaaatctacagaaaatctctattatcaacaccaatcagaaaacaccatgcggaacaaatctcgttgggccatgtacctgtcgtctcagtccagcccaatccattcctctacagtggatggcaacgatacggaacgtaagccaaaagcccaggaagacgacgtgaactctaacctgaaagatctgtcacttcagaaaatcatccagtttgtagagacctacgcggaggaaagaaagaaatataatgtcgaccagtcagtcggcaataacgacccatcttggaatcaggaggtaaaattggagatacctagttttaacgagagctctagcctgcaggtcacctgcagttctgccgagaatgatggaattctgtccgagtctgacattcaggaggacaataaaatccccttcaatcagaacgacaaaggctgtatcaaagggagcgtgctgatcaaggagaatgcacaggaggtcaacacgtgtggtacgttggagaaggaatatgagcaaagcgagtcttccctgcccgaactgaaacacctgcagattgagagcagcaataacagtcggatttccgacgacattacagatatgatttccgagtcaaagatggataacgagtcgctgaacagcattcacgagtccctgtctaacgttactcaacctttcctagaggtaacttttaatctcaacaatttcgaaacttccgacactgaagaagaatctcaggagtcaaacaaaatcagccaagactctgagagttgggtaaaggatatcctggtgaacgacggtaattcatgtttccagaaaaggtcggagaatacaaattgcgaagagatcgagggagagcatctcccgttcctaacatccgtgtccgacaaaccgacagtcacattccccgtgaaggaaactctgccatcccagttctgcgacaaaacatatgtgggctttgatatgggaatctgcaagacggaaaacactgggaaggagatagaggagtacagcgacaccctgtcgaactttgaaagcttcaaatggacagatgcagtttatggtgacaacaaggaggacgccaataaaccgatccaggaagtgaggatcaactacgatttcgccctacctcctaacaaaagcaagggaataaacatgaacctccatatacctcacattcagaaccaaatcgctgagaactctaatctgttttccgaggatgcccagccccagcctttcattctgggcagtgacctggacaagaacgacgaacacgtgctgccctcgacaagctcttcagataactctgtgcagctactgaacacaaaccaaaatcactacgagtgtatcgcattagataagagcaatactcatatcagcaactcgctcttttatccgcttggcaaaaagcatctgatctcaaaagatacagaggcgcacatctcggaacctgaggatttaggcaagatacggtcccctccccctgatcacgttgaggtagagaccgccagggaggggaagcagtattggaaccctcgcaactcttctgagctgagcggactagtgaatacaattagcattctcaagagtttatgcgagcattccactgctcttgatagtttggagattctaaagaagaaaaacacggtgttccagcaggggacccaacaaacatatgaacccgacagccctcctgaggtgcgcaaacctttcatcaccgtggtctctccgaaatcccctcacctgcacaaggatagtcaacagatcctcaaggaggacgaggtggaactctccgaacctctgcaatccgtccagttctctagctctggttcgaaagaggagacagccttccaagcagtgatccccaaacagattgaaaggaagacctgtgatcctaagcccgtggaatttcagggtcatcaggttaaggggagcgccactagtggggttatggtgcggggccacagctctcagttggggtgcagccaattccccgattctaccgaatacgaaaactttatgacagagacccctgagctgccaagtacttgcatgcagatagactttctccaggtgacatctccggaggaaaacatctctactctgtccccggttagtacattctcgctgaactctagggacgaagacttcatggtcgaattttctgaaacgtccctcaaggccaggaccctaccagacgatctccacttcctcaaccttgagggtagccgatatcacatagcactgataagcgtttattctttcaagatgaagttcttcatatag

SEQ ID NO: 25311 - DNA, 2748 bp, Artificial Sequence
  Description of Artificial Sequence: Synthetic coding sequence
atgtttcaagctatcctgtatgatgacaaaggcgcctgcctcgagtccctcttcttaaagtgtctggaggtgaagcccggcgacgatcttgaatccgaccgttacctgattactgtggaggaggtgaaggtggcgggcgcgatcgggattgtgaaacagaatgtgaataaagaggcgcccgagttaaattcccgaacgtttatatcctcaggaagatcgctcggctgtcagccgtccggactgaagcgaaagttcactgggttccagggccctagacaagtgcctaaaaagatggtgattatggagagcggtgagagtgctgcctctcacgaggccaagaaaaccggaccaactattttcagcccgttttgcagcatgccgccactcttcccaaccgtaggcaaaaaagatgtcaacaacatcctggccgaccctgagaatattgtgacatataagaatcgcgaaaggaacgctatggactttagctccgtgtttagcccaagttttcagattaacccagaggtgctctgtgaagagaattacttctgttctccggttaacagcggcaacaaactgtcggacagcctgttgacaaacgaacccgtgaagagagattctcttgcatcccattatagcggtgtgtcacaaaatattaggtcaaaggcgcagattttagccctcctaaagagcgaaagttcatccagctgcgaagaattgaactcggagatgactgagcactttcctcagaaacaaccccagggaagcctaaagattgcgactaagcccaagtatctgatacagcaggaggagtgcgctgagatgaaatcaaccgagaacttgtattaccagcatcaatcggaaaatacaatgaggaacaagagcaggtgggccatgtacctgagcagccagagctctcccattcattcgtcgacggtggatggcaacgatacagagcgtaaacccaaagcccaagaggatgatgtgaactcaaatttaaaagacttaagcctccagaagattatccagtttgttgagacgtacgccgaagagaggaagaagtataacgtggatcagagtgtgggtaataatgatccaagttggaaccaggaagtcaagctcgagattccttctttcaacgagtctagcagtcttcaagttacttgctctagcgcagagaatgatggaatcctcagcgagagcgatatccaagaggataataaaatcccctttaatcagaacgacaaggggtgcatcaaggggtccgttctgattaaggagaacgcccaggaggtgaatacttgtggaactctagaaaaggaatacgaacaaagtgaatctagcttgcctgagctcaaacacctccagatcgaaagttccaataattctcggattagcgacgacatcactgatatgatctctgagagtaaaatggacaacgagagtcttaacagcattcacgaatctctgtctaacgtcacccagccattcctagaggtgaccttcaatctgaacaattttgaaacctcagatacagaggaggagtcccaggaatcaaacaagatctcccaagacagcgagagttgggtgaaggacatactcgtcaatgatggaaatagctgcttccagaaaagatccgaaaatacaaattgcgaggagatcgaaggtgaacacctccctttccttacatccgtctctgacaagccaacagttacctttcctgtcaaggaaacacttccttctcagttctgtgataagacatacgttggcttcgatatgggtatctgcaaaaccgagaatacggggaaggagattgaagaatactccgacacactctctaattttgaaagtttcaagtggacagacgctgtctatggcgacaataaggaggatgccaataagccaatccaggaagtcagaatcaattacgatttcgcactaccgccgaacaagagcaagggcatcaacatgaatctgcacatccctcacatccagaatcagatcgctgaaaattctaaccttttctccgaggatgcccagcctcaaccgtttattctgggcagtgatctggacaaaaacgacgagcacgtgctgccctctacaagcagcagcgacaattccgttcagcttttaaacaccaaccagaatcattacgagtgtatcgccctcgacaagtccaatactcatatctccaacagccttttctatcccctcggtaagaaacacttgataagcaaggatactgaggcacacatctcagagccagaggacctagggaaaattaggtctccaccccctgaccatgtagaggtcgaaactgcgagggagggaaagcaatactggaatcctcggaactcgagcgaactttcaggcctcgttaatacaatttcgatactcaaaagtctctgcgaacacagtaccgcgctggattccctcgagatcctgaagaagaagaacacggtattccaacaaggcactcagcagacctatgagccagattcacccccagaggtcaggaagcctttcattacagtagtatctcccaaatccccacatctccacaaggattcccagcagaagacagttaaaaagaaaattaaacccacactgccactaagaattttcataaatgtgagccgcttcttctgcgtgcagttaaagaagatggttagactcatgtacatcaacagtttcatatccttcccactgaacatcgtggtcctgagctacatcattaacaattccagctag

SEQ ID NO: 25312 - DNA, 525 bp, Artificial Sequence
  Description of Artificial Sequence: Synthetic coding sequence
atggaaagccaggaatttatagtgctctatacccaccagaagatgaagaagtctaaagtatggcaggatggcatcttgaaaattacacatctggggaacaaggcaatcctctatgatgataagggggcctgcctggaatctttgttcctgaagtgtctggaggttaaacctggtgacgatctggaatccgacaggtacttaattacggtggaagaggttaaagttgccggagctattggcatcgtgaaacaaaatgtgaataaagaggctcccgagctcaattcacgcaccttcattagctctggccggagcttgggctgtcagccttctggactcaaacggaagtttaccgggttccagggcccccgacaggtcccaaaaaagatggttatcatggagtctggggagagcgcagctagtcacgaggccaagaagacagggcctactatattcagtccattctgttctatgcctcctctcttccccaccgtcggaaagaaggatgtgaataacattcttgcctag

SEQ ID NO: 25313 - DNA, 600 bp, Artificial Sequence
  Description of Artificial Sequence: Synthetic coding sequence
atgacttctttaatcaattctccgatcaacagacgacctttgcaaaatgttgaaggaaacaacagatgccagcggaaggctaaaaattatggcaataaatacttcatccactgcttagacctggagaagatcaccctctctccccgaaggaaacacgacattgagggaggcgataagctgaacgtcaagttttcccagctcaggtcacgaagacagagaaaggctgaacccggcgcttgcgccctgggccgagtggggtctgagtgtattccagagccaggggctcgacgcactgcacaagctgccggcttacgctctgtgagcggagcagccaataccaaggttcgtgagctaaagcactttcgtttcctgggacttttgcggtcttgtaggtcagaaatggaggtggacgcacccggagtcgacggaagagatggattacgtgagaggagaggattctccgaaggtgggcgccagaacttcgatgtccgcccacagtccggtgctaatgggctacctaaacatagctactggctggacctgtggctgttcatactgttcgatgtcgtggttttcctgtttgtttattttctgccctag

SEQ ID NO: 25314 - DNA, 201 bp, Artificial Sequence
  Description of Artificial Sequence: Synthetic coding sequence
atggaggtggatgcgccaggcgtggatggccgcgatggtttgcgcgagcgaagaggcttctcagaagggggtagacagaactttgacgtgagaccccagtctggcgccaatgggctcccgaagcactcttactggttggacttatggctgttcatcctcttcgacgtagtggtgtttttatttgtgtactttctgccctag

SEQ ID NO: 25315 - DNA, 399 bp, Artificial Sequence
  Description of Artificial Sequence: Synthetic coding sequence
atgtgcagcgcgggggagttactgcggggcggcgacggtggtgagcgggacgaggacggagatgctctggctgaacgtgaagctgctgggaccggctgggatcccggcgcctcccccaggagaagaggccagcggccaaaggagtcagaacaggatgtggaagacagccagaatcataccggtgaaccagtgggggacgattacaaaaaaatgggaacgctcttcggcgagctgaacaaaaatcttatcaacatgggattcactcggatgtacttcggagagaggattgtggaacccgtcattgtgattttcttctgggtgatgctgtggtttctgggtctacaggccctaggcctggtcgctgtcctgtgcctggtgataatctacgtccagcagtag

SEQ ID NO: 25316 - DNA, 300 bp, Artificial Sequence
  Description of Artificial Sequence: Synthetic coding sequence
atggcggagggcggctttgacccctgcgagtgtgtgtgcagtcacgaacatgccatgcgacggctcattaaccttctccgacagagccaaagctattgtacagacaccgaatgcctccaagaactgcccggaccttccggggataatggcatctcagtgacaatgattctggtggcctggatggtcattgcgctgattcttttcttgctcagaccccccaatttaagaggatcctcattaccaggaaagcccacctcgcctcacaacggacaagacccccccgcaccacctgtagattag

SEQ ID NO: 25317 - DNA, 270 bp, Artificial Sequence
  Description of Artificial Sequence: Synthetic coding sequence
atggctgagggcggcttcgatccctgtgagtgcgtttgctcgcacgaacatgcaatgcggcggctaatcaacctgctaaggcagagccagtcatactgtactgataccgaatgcctgcaggaactgcccggcccctccggagacaacggcattagcgtaaccatgatcctggtggcttggatggttatcgcacttatactgttcctccttcggccacctaatttacgaggatcctcgctcccaggtaaacctacatcaccgcacaactag

SEQ ID NO: 25318 - DNA, 723 bp, Artificial Sequence
  Description of Artificial Sequence: Synthetic coding sequence
atgtaccttaggcgcgccgtaagtaaaactttagcactgccacttcgagccccccctaacccagccccgctcggcaaggatgcgagcctaaggagaatgagttccaataggtttcccggatcctcaggaagtaacatgatctactacttggtcgttggcgttaccgtcagtgctggcggatattacgcttataagactgtgacatcagatcaggccaaacacaccgagcacaagaccaatctgaaggagaaaacaaaggcagaaatccatccctttcagggagagaaggaaaacgtcgccgagacggaaaaggcttcgagcgaggccccagaggagttgatagtagaggctgaagtggtcgatgcagaggagtccccatcagctacagtggttgttattaaggaagctagtgcttgccctggacacgtggaggcagccccagagacaaccgccgtgtcagccgaaacaggcccggaggtgacagacgccgccgcccgggagactaccgaagtcaacccagagacaactcctgaagtgaccaacgccgcactggatgaggcagtgacgatcgataacgacaaagacaccaccaaaaatgagaccagtgatgagtacgccgaattggaggaagagaattcaccagctgagagcgagtcaagcgctggcgacgacctccaggaagaggctagcgtggggagtgaggccgcctccgctcagggctag

SEQ ID NO: 25319 - DNA, 2337 bp, Artificial Sequence
  Description of Artificial Sequence: Synthetic coding sequence
atggatagcaaggaatcactcaccccaggcagggaagaaaacccctcttcggtgctggcgcaggagagaggagacgtgatggatttctataagacgctgcgtgggggtgccaccgtcaaggtgtctgcctccagtccgtcactggccgtggcaagtcagtccgactctaaacagagacgtctcctggtggatttccctaaaggctctgtgtccaacgcacagcagcccgatctatccaaagccgtgtctctgagcatggggctttatatgggcgagacagagacgaaggtcatggggaatgatcttggtttcccgcagcagggccagatttccctcagcagcggcgaaactgatctgaaactgctggaggaaagcatcgctaacttgaaccgctccaccagcgtgcccgaaaatcccaagagctcggctagcacagcagtctcagctgcccccacagaaaaagaattccctaaaacacactcagacgtcagctccgagcaacaacacttaaagggccagacagggacgaatggcgggaatgtgaaactgtacacaactgatcagagcacgttcgacatccttcaggacttggaattttcaagcggaagtcctgggaaggaaactaatgagagcccatggaggagcgatctgttaattgatgagaattgtctgctcagtccgctcgctggagaagacgattcgttccttctcgaaggtaacagtaatgaggattgtaaaccactcattctgccagacactaagccaaaaatcaaagacaacggagatcttgtcctgtcttcccctagtaatgtgacactacctcaggtgaagactgagaaagaggatttcattgaactgtgcactcctggcgtaataaagcaggaaaaactgggtaccgtctactgccaggcatcattccccggcgcgaatatcataggaaataagatgtcagcaatcagcgttcatggggtctccacatctggcggacagatgtatcactatgatatgaataccgcatctttgtcgcaacagcaggatcagaaaccaatcttcaatgtgatccctcctattcccgtggggtccgagaactggaataggtgccagggttccggagacgacaatctgactagcctcggcacactgaactttccagggcgcaccgtgtttagtaacggttactcgagtccatcaatgcgccccgacgtgtcttctcctccctcttcctcctctaccgcaaccaccggtcctccccctaaactgtgcttagtgtgctccgatgaggcgtctggctgtcactacggcgtcttgacatgcggttcttgcaaagtgttctttaagcgtgctgtggagggtagacaacacaattacctgtgcgcaggtcgtaacgactgcatcatcgataagattaggcgcaaaaactgtcccgcctgccgctatcgaaaatgcctgcaggccggaatgaacctagaagcccgcaaaacaaagaagaagatcaagggaatccaacaggctaccactggggtgagccaggaaacaagcgaaaatcccggaaacaaaacaatcgtgccagctacactccctcaattaacacctacactcgtctccctactggaggtgattgagcccgaggtgctgtatgctggctatgactccagcgtccctgacagcacctggcggattatgactacattgaacatgctgggcgggaggcaagtgatcgccgctgtgaagtgggcaaaggccattccaggttttagaaatctccatctcgatgatcagatgactctgctccagtactcctggatgttccttatggcgttcgcgctgggctggaggagctaccggcagtctagtgccaacttgctgtgttttgccccagacctgataattaacgaacaaagaatgaccctaccctgcatgtatgaccagtgcaaacacatgctgtacgttagctctgagctgcatcgcctgcaagtgtcttatgaagagtacctctgtatgaaaaccctgctcctgctcagcagcgtccctaaggatggcctcaaatctcaggagttattcgacgagatccggatgacctatattaaagagctcggtaaagcgatcgtaaagagagaggggaactcctcccagaactggcagcggttctatcaactgacaaagctacttgactcgatgcacgaggtggtagaaaatttactcaactattgttttcagacttttctggacaagacaatgtccatcgaatttcccgagatgctggcggaaataattactaaccagatccccaaatatagtaatggtaacataaagaaacttttatttcatcagaagtag

SEQ ID NO: 25320 - DNA, 498 bp, Artificial Sequence
  Description of Artificial Sequence: Synthetic coding sequence
atgaagaccaagccaaatctccttttcccaaaatctgcccccccatccctgcctagaagggtgccgagaaaagtggaggaagacctccttatgcttaacagcagtccttcgaccgcgaaagatactctggacaatggcgactacggggaaccggattacgactggaccaccgggcctcgagatgatgacgagtccgacgatactttggaggaaaatcggggctatatggagatagagcagagtgtaaaatcttttaagatgccgagttccaacattgaggaagaagatagtcatttttttttccatttaataatcttcgcattctgtatcgctgtagtgtatattacttatcataataagaggaaaatctttctactggtccaatcacggaagtggcgtgatggcctgtgctcaaagacagtcgagtatcaccggctcgatcaaaacgtaaatgaagccatgccatctctaaagattactaacgactatattttctag

SEQ ID NO: 25321 - DNA, 648 bp, Artificial Sequence
  Description of Artificial Sequence: Synthetic coding sequence
atggcatctgaaactgagaaaactcatgctctactacagacatgcagcacggagagtctgatctcatcattaggtctaggtgcattctgccttgtcgctgatcgcctgctccagttttctaccattcaacagaatgattggctcagagcactgagcgacaatgctgttcattgcgttatcggaatgtggagctgggcagtggtgactggcattaaaaagaagacggattttggggagataattctcgctggcttccttgccagcgtcatcgatgtcgatcacttttttttagccgggtccatgtctctgaaagcggcgctgacccttcccagaagacccttcctgcattgcagcacagtgatccctgttgtggtgctgacactcaagttcacaatgcaccttttcaaattaaaagatagttggtgcttccttccttggatgctatttatttcctggacatcacaccatattcgtgatggaatccgccatggcctgtggatatgcccgttcgggaagacttcccccttgcccttctggttgtatgtgattattacttcctcacttcctcatatctgttcctttgtgatgtacctcaccggcacacggcagatgatgtcatccaaacacggagtgcgtatagacgtttag

SEQ ID NO: 25322 - DNA, 648 bp, Artificial Sequence
  Description of Artificial Sequence: Synthetic coding sequence
atggcaagcgagaccgaaaagacccacgctctgctacaaacttgcagcacagagtctttaatctcctccttaggactgggcgctttctgcctggtcgcagatcgattgcttcagtttagtacaatacagcaaaacgattggctgcgggccctgtcagataacgcagtccactgtgtcattgggatgtggagttgggccgtggtcaccgggatcaagaagaaaaccgattttggcgaaattattctggctgggtttttagcgagcgtcatcgacgtggaccatttttttctcgcagggtcaatgtccctgaaggccgccctcacgctgccaaggaggcctttcctgcattgctcaacagtgattccagtggttgtcctgacactgaaatttactatgcatttatttaaacttaaggacagctggtgctttctgccttggatgctcttcatttcctggaccagccatcatatccgcgacggtattcgccatggcctatggatctgtccatttggaaagacgtctcccttgcccttttggctatatgtcatcatcacatcatccctgcctcacatctgttcttttgtgatgtatttgactggtacaaggcaaatgatgtcaagtaaacatggcgtgcgaattgacgtgtag

SEQ ID NO: 25323 - DNA, 531 bp, Artificial Sequence
  Description of Artificial Sequence: Synthetic coding sequence
atggcatctgagaccgagaagacgcacgctttgcttcagacctgttcaaccgagtccctgatcagttcccttggccttggcgccttttgtctggttgcagatcggctgctccagttttctactattcagcagaatgactggctgagagctctctccgacaacgcagtacattgcgtcattggcatgtggtcatgggcggtcgtgacggggatcaaaaagaaaacggacttcggggaaataatcctggcaggctttctagcctccgtcattgacgtcgaccatttctttctcgccgggtcaatgtctttaaaagccgcactgacgctaccccgtaggcccttcctgcactgcagcactgtgatcccggttgttgttctgaccctgaagtttacaatgcatctgtttaagcttaaagattcctggtgctttttgccgtggatgctattcatttcgtggacatcccaccacataagggatggtattagacatgggctttggatctgtccctttggtaaaacaagccccctgtag

SEQ ID NO: 25324 - DNA, 648 bp, Artificial Sequence
  Description of Artificial Sequence: Synthetic coding sequence
atggcctcagagacggagaagacccatgctctcctgcagacgtgttctactgagtctctgatttcctcactgggactgggggctttctgtctggttgctgacagactgctgcagttttctacaatccagcagaacgattggttgcgtgcattatccgataacgctgtccattgtgttatcggcatgtggagctgggccgtggttaccggaatcaagaaaaaaaccgatttcggggaaattatactggccgggttcctggcctctgtgatagatgtcgatcacttctttctcgcaggcagcatgtccctgaaggccgctctgaccttaccacgccggccattcttgcattgcagcacagtgatcccagtagttgtattaaccctgaaatttacgatgcacttgtttaagctgaaagactcctggtgcttcctgccctggatgctgttcatcagctggacctcccatcatattcgggacggaattcgtcacggtctgtggatttgtccatttggaaagacttctccactgcccttttggttgtatgtgattattacctcctctcttccccacatctgctcatttgtgatgtacctcaccggcaccagacagatgatgtctagcaaacacggggtccggatcgatgtatag

SEQ ID NO: 25325 - DNA, 255 bp, Artificial Sequence
  Description of Artificial Sequence: Synthetic coding sequence
atgcatctctttaagcttaaggattcctggtgtttcctgccctggatgctgttcatcagctggaccagccatcacatcagggatggtattcgtcatggcttgtggatatgtccatttggtaagacctcacccctgcctttctggctgtacgttattatcacatcgtccctcccccatatctgttctttcgtaatgtacctgacaggcaccaggcagatgatgtcgagcaagcatggggtgcggatcgatgtctag

SEQ ID NO: 25326 - DNA, 1002 bp, Artificial Sequence
  Description of Artificial Sequence: Synthetic coding sequence
atgaagggcgaagccggccacatgttgcacaatgagaagagtaaacaggagggtcacatatggggtagcatgcgaagaacggcattcatactgggatctggacttctgtcttttgtggcgttctggaatagcgtcacgtggcatcttcaaaggttctggggagcatccggctatttctggcaggctcaatgggaaaggctgttgactactttcgagggtaaggaatggattttgttcttcatcggtgctattcaggtgccctgtctgttcttttggtcctttaacggcctgctgctggttgtggacactactggtaaacctaattttatttcccgctatcgaatacaggttgggaaaaacgaacctgtagaccccgtgaaacttcgccagtctattcgaactgtgctgtttaaccagtgcatgatcagtttccccatggtggtgttcctttaccctttcctgaagtggtggcgagacccgtgtcgacgggagttgccgactttccactggttcctcctggaactcgcgatctttacactaatcgaggaagtcctgttctattactcccacagactgctccatcaccccacattttataaaaagatacacaaaaagcatcacgagtggactgccccgattggtgtgatctcactgtatgcgcaccctatcgaacatgctgtgagtaacatgctgcctgtaattgtgggaccgttagtgatgggaagccacctttcatccatcaccatgtggttcagtcttgcgctgattatcactaccatctcccactgcgggtatcacctgccatttcttccaagtcccgaatttcatgattaccatcatctcaagtttaaccagtgttatggggttctgggggtgctcgaccacctgcacggtactgacactatgtttaagcagaccaaggcatacgaacggcacgtgttgctcttagggttcactccactgtccgaaagcatccctgacagcccaaaacggatggagtag

SEQ ID NO: 25327 - DNA, 933 bp, Artificial Sequence
  Description of Artificial Sequence: Synthetic coding sequence
atgcggcgaacggccttcatattggggtctggcctcctctcatttgtagccttttggaattccgtgacttggcatctgcaacgcttttggggcgccagcggttatttctggcaagcacagtgggagcgcttattgactacgttcgaggggaaagaatggatcctattcttcattggcgctattcaagtgccgtgtcttttcttctggtcctttaacgggctacttctggtagttgatacaaccgggaaaccgaattttatctcccgataccgcatacaagttggaaaaaatgagcccgtcgatcctgtcaagctgagacagtctatccgaactgttctgtttaatcaatgcatgatttctttcccaatggttgtcttcctgtatccatttcttaagtggtggagagatccctgcagaagagagctccctacttttcactggtttctccttgagctggctattttcaccctgatcgaggaagtgttattttactattcccaccggctgctgcaccatcctacgttttataagaaaatccataaaaaacaccacgagtggaccgcccctatcggcgtcatttctctgtacgctcatcctattgagcatgctgtgagtaatatgcttccagtgattgtaggcccattggtgatgggctctcatctttcgagcataaccatgtggttttccctggcactgattattaccactatatcccattgtggctatcatttgcctttcctgccatctcccgaatttcatgactatcaccacctgaagttcaaccagtgctatggcgtgctcggtgtattagaccacctgcacggaaccgacactatgtttaagcagacgaaagcatatgagcgacacgtgctcctgttgggcttcaccccattaagcgaatcaattccagatagtcctaaacgtatggaatag

SEQ ID NO: 25328 - DNA, 441 bp, Artificial Sequence
  Description of Artificial Sequence: Synthetic coding sequence
atgaggcgcaccgccttcatactgggatcagggctcctgtcgtttgtggccttttggaactcagtcacctggcatcttcagcgtttttggggagccagtggatacttttggcaagctcagtgggaacggctgctaaccacgttcgaagggaaggagtggatcctgttcttcatcggggcaattcaggttccctgcctattcttctggtccttcaatggactcctgcttgtggtggatacaactggcaagcctaactttatttctcggtacaggatccaggtggggaaaaatgaaccggttgaccccgtgaagctgcgccagagcatacgaacagtgctgttcaatcagtgtatgatttctttcccaatggtggtctttctttaccccttcctcaagtggtggagggacccttgtaggcgagagctgcctacatttcactag

SEQ ID NO: 25329 - DNA, 99 bp, Artificial Sequence
  Description of Artificial Sequence: Synthetic coding sequence
atgaaaggtgaagctgggcatatgctccacaacgaaaagtccaagcaagagggccacatttggggatcgatgagacggaccgcctttatcttaggctag

SEQ ID NO: 25330 - DNA, 225 bp, Artificial Sequence
  Description of Artificial Sequence: Synthetic coding sequence
atgtttgatattaaggcctgggccgagtatgtggtggaatgggccgcaaaggacccatacggctttttaaccacagtaatcttagcattgacccccctctttctggcctccgcagtactctcatggaagctggccaaaatgatcgaggcccgcgaaaaggaacaaaagaagaagcagaagagacaggaaaacattgccaaggctaaaaggctgaagaaagactag

SEQ ID NO: 25331 - DNA, 225 bp, Artificial Sequence
  Description of Artificial Sequence: Synthetic coding sequence
atgtttgacatcaaagcctgggccgaatacgtagtggaatgggcagccaaagacccctacggatttctcaccaccgtgatcctagcactcacacccctgttcctggccagcgccgtgcttagctggaagttggccaagatgatcgaggcaagagagaaggagcagaagaaaaagcaaaagcgccaggagaatatcgctaaagcaaaaaggttgaagaaagactag

SEQ ID NO: 25332 - DNA, 183 bp, Artificial Sequence
  Description of Artificial Sequence: Synthetic coding sequence
atggacgccgtctcacaggtacccatggaagtagtccttcctaagcatatcctggacatttgggtaatcgtattgattatattggcgacaatcgtgattatgacctcgctgctcctgtgccctgccaccgccgtgattatctatcggatgcgtacgcacccaattctgtctggcgctgtatag

SEQ ID NO: 25333 - DNA, 1683 bp, Artificial Sequence
  Description of Artificial Sequence: Synthetic coding sequence
tctgtgctgaagattacactggctgtcattctgacactgctagggctggccattctggccattctgctgaccaggtgggctcggtgtaaacagtccgagatgtacatttcgcggtactcatctgaacagtcagctcggttgcttgattatgaggatgggcggggttcgaggcacgcctattcaacacagagcgataccagctacgacaatagagccagatacgaagcccctttcagcccgaagatcgaaaagctcgcaatttcaaaatcttctcttgccctcccacaagggagcatgtctagcattaagtgtcttcagactacagaggaacccccctgcatcccatgtgtgatgatcctgatcttctacaacgtgcccgccacaaggggcatgggaaaggtggtgagaaagcacattatgcaaacccccggccctatcgggaagctgccggtattcagcgtacgcagtcatcctcatacaataaccgggccaccttcagcaccacgaggaaagcccgttagcacactgctgataagtaatagcgtgtgcagttacttaacacagagcttccagttccctgaggtccgtactatagccactaaaaagcgcgccactacccaggggagcgtgatcttaacaggatacatggatgaggaactggccaagaagtcctgctctaaaatccaaatcctgaaatgtggggggactgcccgaagccagaattctagggaagagaacaaggaggccttgaagaacgatatcatcttcaccaatagtgttgaatcactcaagagtgctcacataaaggaacctgagcgagaaggtaaggggactgaccttgagaaggataaaataggaatggaggtaaaggtggactcagatgccggcattccaaaaaggcaggaaacccaactgaagattagcgaaatgtccatcccccaaggtcagggagcgcagatcaagaaatcggtttcagatgtgcctcggggccaagagtctcaggtgaaaaaatccgagtctggcgtgccaaagggacaggaagcccaagtcactaaatccggactcgtggttttaaaaggccaagaagctcaggtcgaaaagagcgagatgggggtaccccgaaggcaggaatcacaggttaagaaaagccagagtggagtctctaaggggcaagaggcacaggtgaaaaaacgcgaatccgtggtcctgaaggggcaggaggcccaggtggagaaaagcgagttaaaggtgccaaaaggccaggagggtcaggtggaaaaaaccgaagccgatgttcccaaagagcaggaggtgcaggagaagaagtcagaagctggtgtgttgaagggccctgagtcacaagttaagaacactgaagtgtccgtgcctgaaacactggaaagtcaggttaagaagtctgagagcggcgttttgaagggtcaagaagctcaggagaaaaaggagagcttcgaggacaaggggaacaatgacaaggagaaagagcgtgacgctgagaaagaccctaacaaaaaggaaaagggagacaagaatacaaagggtgacaaaggtaaagacaaggttaagggcaagagggagtcagagatcaacggtgaaaagagcaagggctccaaacgcgctaaagccaataccggccggaagtacaataagaaagtggaggagtag

SEQ ID NO: 25334 - DNA, 1704 bp, Artificial Sequence
  Description of Artificial Sequence: Synthetic coding sequence
atgactgtgctggagatcacgcttgccgtcatactgacactcctagggctcgctattctggccatcctcttgacccgttgggctaggtgcaaacaaagtgaaatgtatatcagcaggtatagttccgaacagtcagcacggcttctcgactatgaggacgggcgcgttgagtgtcaccatggccagcagaaagagaccagccaccggaaaaccgagcggaagctgcggagggagagaaaaagaataaccaacgaacgacgactcataggcactgagaagtcactgccccaaggtagtatgagttccatcaagtgtttacagacgacagaagaacccccctgcaagggaatgggaaaggtgatccaagctaaacaattactgaatatcagctggccactcgccgtcagtctttccaagcctctttgtataattcacgatgtgctggagagcttcaagacaataaacctgcagagcccagccgggttccaggccgtgacatctcactgcaaaaaagggagagataaatttagaaagatattagtctataagaaggggacgtcaattaagggcaagaaaattgaaatcaagcgcaaatacttgatttcgaaatcccgtcccttcgtggtgtgctcagtcattctgaccgggtacatggacgaagaactggccaagaagagctgctctaaaatccagattttgaaatgtggcgggacagctaggtcacagaattcccgcgaagaaaataaggaggctcttaagaacgatattatattcactaatagtgttgagtctctaaagtcagctcacattaaggagccagagcgtgagggcaagggaaccgacctggaaaaggataaaatagggatggaggtgaaggtggatagtgatgcgggtattcctaagcgacaggaaacacagctgaagatcagtgacgaatacacgacacggactggcagcccaaacaaagaaaaatgcgtccgctgtactaaacggactgggcaggtaaaaaaaagcgagtctggagttcctaaaggacaggaggctcaggtgacaaaaagtgggttagttgtgctgaaggggcaggaggcccaagtggaaaaaagtgagatgggggtaccccggcggcaagaatcccaggtgaaaaagagccaatccggcgtttcaaaggggcaggaagcccaggtcaaaaagagggagtctgttgtgttgaaagggcaggaagcccaagtggagaaatctgagctgaaagtgccaaaaggccaggagggccaagtcgagaagacagaagccgacgtcccaaaagagcaagaggtccaagagaagaaatcagaagccggtgtgctgaaggggcctgagtcccaggtgaagaacacggaggtgagcgtgccagaaacgctggagtcacaggtcaaaaagtcagagagtggggtcctgaaggggcaggaagcccaagagaagaaagaatccttcgaggacaaaggaaataatgacaaagagaaagaaagggacgccgagaaagatccgaacaaaaaagaaaaaggagacaaaaacactaaaggagataagggaaaggataaagtgaagggaaaaagagagtccgagatcaacggagaaaagtccaagggaagtaagcgtcgtcaaatccaggaggggagcaccacgaagaagtggaaaagcaaggacaaattcttcaaagggccatag

SEQ ID NO: 25335 - DNA, 1686 bp, Artificial Sequence
  Description of Artificial Sequence: Synthetic coding sequence
atgaccgttctggagatcaccttggccgtaatcctaacactcttagggctcgccattttggccatcttgcttacgagatgggccaggtgcaagcagagcgagatgtacatctctcgttacagttctgaacaaagtgcgcgactcctggattacgaggacggccggggcagccgccacgcatattccacacagtcaggaaacctgtgtttccagcggtcgaagagagattatacgcccagtacaaacagcttggtgtctatggcatcaaagtttagtctcgggcagaccgagctcattctgctcttgatgtgcttcattctcgccctcagcagatcttccataggctccattaaatgtttacaaacgacggaggagccgcccagccgcaccgctggagccatgatgcagttcacagcccccatccctggggccaccggcccaattaagctgtcccaaaagactattgtccagacccctgggcctatagtccagtatcccgggagtaatgctggaccaccttctgccccccggggaccacctatggcgcctatcatcatttcccagcggacagcccgcatcccgcaagtacatactatggattcaagcggcaagataactctcacacccgtggttatactcacgggatacatggacgaagagctggctaaaaagtcgtgcagcaaaatccagatcctgaagtgtggtggaacagccagatctcagaactctcgggaggaaaataaagaagcactgaagaatgacatcattttcacaaactccgtcgaatctctgaaaagtgctcatataaaagagccagaacgggagggtaagggcactgacctagaaaaagataagatcggcatggaggtgaaagtggacagtgatgccgggataccaaaacgtcaggagactcagcttaagatttctgaaatgtccatcccacaagggcagggcgcccagattaaaaaatcagtgtctgacgtgcccagagggcaagaaagtcaagtcaagaaatccgaatccggggtgccaaaggggcaagaagctcaggtgacaaaatcagggctagtggtcctgaaggggcaagaagcccaggtcgaaaaaagcgagatgggagtgccccgtaggcaggaaagtcaagtgaagaagtcacaatccggagtctccaaaggccaagaggcccaggtcaagaaacgggagtctgtggtgctgaagggccaggaagcgcaggtggaaaaatccgaactaaaagtaccaaagggacaagaagggcaggtggagaaaacagaagccgacgtccccaaagagcaagaggtccaggagaagaaatctgaagctggcgttctgaaaggacccgagagccaggtcaagaatacggaagtcagtgtgccagagaccctggaaagtcaagtcaagaaatccgaaagcggcgtgctgaagggacaggaggcccaggagaagaaagaatcatttgaggataaggggaacaacgacaaggagaaagagcgcgacgcagagaaggatccaaacaaaaaggagaagggcgataagaacactaagggcgacaagggcaaggacaaagtgaaggggaagcgcgaatctgagataaatggcgagaaatctaagggaagtaaacgcgccaaggctaacacaggcaggaaatataataagaaggtagaggaatag

SEQ ID NO: 25336 - DNA, 1692 bp, Artificial Sequence
  Description of Artificial Sequence: Synthetic coding sequence
atgacagttctcgagatcaccctggctgttattctgacactgctaggcctggctatcctcgctatcctcctgacaagatgggctcggtgtaagcagagtgagatgtatatttcgaggtactcaagtgagcaatcagcaaggcttctggattacgaggacgggaggggtagtaggcatgcttatagcacccagtccgatacgtcctatgataacagggagcgttctaaacgggattacacccccagcaccaatagtttggtttctatggctagcaagttctctttggggcagaccgagctgattttattattgatgtgctttatacttgcattatcccgttcctccataggatctattaaatgtttgcagaccactgaggagcccccctcaagaaccgcaggtgccatgatgcagttcacagcaccaattccaggagctaccggaccaattaagttatcccagaagacaatcgtccagaccccgggacccatagttcagtatccggggtctaatgctggccctccttctgctcctcgtgggccccccatggcccctattatcatttcacagcgtacagcaaggatcccccaggtgcacaccatggacagctcaggtaaaataaccctcacacccgtggtcatcctgaccggctacatggatgaggaactggccaagaagagttgctctaagatccagattctgaagtgcggagggacagcacgaagtcagaattctcgcgaggaaaataaagaagctttgaagaatgatatcatcttcaccaacagcgtcgaaagtctcaaatccgcccacatcaaggagccagagcgggagggcaaaggaaccgacctagaaaaggacaaaatcggaatggaggttaaggtggatagtgatgccggtatcccaaagcgccaggagacccagctgaaaataagcgagatgtccatcccacagggacagggtgcacaaataaaaaaatccgtgtccgacgtcccccgcggccaggagtcgcaggtcaaaaagagtgagtctggagtgcctaagggtcaggaagctcaggtgacaaagagtggcctcgtggtgctaaaaggacaagaggcccaggtcgagaagagcgagatgggtgtgcccaggcgccaggaaagccaggttaaaaagtcccagagtggtgtctctaaggggcaggaagcacaggtgaaaaaaagggagagcgtcgttctgaagggccaagaggcgcaggtcgaaaagagcgaactgaaggtgccaaaggggcaggagggccaggtcgagaagactgaggcagatgttcctaaagaacaagaggttcaggaaaagaagagtgaggctggcgtgcttaagggacccgagtctcaagttaagaataccgaagtttctgtgcccgaaaccctcgaatctcaggttaagaagtcggagtcaggggtgttgaaaggacaagaggctcaggaaaaaaaagagtctttcgaggacaagggcaataatgacaaagagaaggaaagggacgccgaaaaagatccaaacaagaaggaaaagggggataaaaataccaagggagacaaaggaaaggacaaggtcaaaggcaaacgggaaagcgaaataaatggcgagaaatcgaaggggagcaagcgcgcgaaggcgaataccggccgcaaatataacaaaaaagtggaggagtag

SEQ ID NO: 25337 - DNA, 1692 bp, Artificial Sequence
  Description of Artificial Sequence: Synthetic coding sequence
atgaccgtcctggaaattactctcgccgtgatcctcacactgctgggtctggcaatcctggccatcctcctgacccgatgggcaagatgtaaacagtcggagatgtatatttctagatacagctctgagcagagcgcccgattgctggactacgaagatggccgcggttctcggcatgcctacagcacccaatcggatacctcgtatgacaaccgcgagagaagcaagcgggactatacaccaagtacgaacagtctggtgtctatggcttcaaaattctctctcggacagactgagctgatcttgctgctgatgtgtttcatactcgccctgtctagaagcagcatcgggtcaattaagtgcttgcagactaccgaggagcctcccagtaggaccgccggtgcgatgatgcagttcaccgcaccgattccgggcgctaccggcccaatcaagttgtctcagaaaaccatcgtgcagactcctggccccatcgtgcagtacccaggctctaacgctggcccaccatctgcaccccgcggacctcccatggcccccatcatcatttcacaacgaactgcccgcatccctcaggtccacacgatggacagttcgggtaaaattaccctcacacctgtggtcatcctcacaggatacatggacgaagaattagccaaaaaaagttgctcaaaaattcaaattctcaaatgcggcggaactgcacggtcccaaaatagccgggaggaaaacaaagaagccttaaagaacgatatcattttcaccaattccgtggaatccctgaagagtgcgcatatcaaggaaccagagcgggagggcaagggcactgatttggaaaaggataaaattggcatggaggtgaaagtggacagtgacgctggtataccaaaaagacaagagacacagttgaaaatctcagagatgtctatacctcagggccagggggctcagatcaagaagagtgttagcgacgtgccgcgcgggcaggaatctcaggtgaagaaaagtgagtccggggtcccaaaaggacaggaagctcaggtgacgaaatccggcctagtcgttctgaagggacaggaggcccaggtcgaaaagtccgagatgggagttcctagaaggcaggagtcccaggttaagaaatcacagtcaggcgtgtctaaagggcaggaggcacaggtgaaaaaaagggaatccgttgttctcaagggccaggaagcccaggtcgagaaaagtgaattaaaagtgccaaaagggcaggaagggcaggtggagaaaactgaggcggatgtccctaaggagcaggaggtgcaggagaagaaaagcgaggctggagtgcttaagggaccagagtcacaggtgaagaatactgaggtttcagtgccagagactctggagagccaggtgaagaaatctgaatctggggtactgaaaggtcaggaagcccaagagaagaaggagagctttgaggacaaggggaacaatgacaaagagaaggagagagacgctgaaaaagatcccaacaaaaaggagaagggcgataaaaacactaaaggcgacaaaggtaaagacaaggtgaaaggcaagcgcgaaagtgaaattaacggggagaagagtaagggttctaagcgtgctaaggccaacacgggacgcaaatacaataagaaggtagaggaatag

SEQ ID NO: 25338 - DNA, 1689 bp, Artificial Sequence
  Description of Artificial Sequence: Synthetic coding sequence
atgacagtgctcgaaatcactctggccgtcatcctcacattgctgggcctcgcaatactggcaatcctgctgactagatgggcgaggtgcaaacaatctgaaatgtatataagtaggtatagttcagagcagagcgcccggctcctggattacgaggacggccgagggagcaggcacgcctactcgacacagtcggacacatcctacgacaaccgggagagaagcaagagagactacactcccagcactaattctttagctctatcaagaagctcgatcgctcttccccaggggagcatgagttcaatcaaatgtctgcagaccacagaggagccaccttctcgcactgcgggtgctatgatgcaattcaccgccccaatccctggggcaactggacctattaagctctcccagaaaacaatcgtccagactcctggcccaatagtccaatatccgggctctaacgtccgatcacaccctcatacgatcacaggccccccaagtgcacctagggggcctccaatggcccccattattatcagtcaaaggacagcctcgcagttggctgcgcctatcagaattccccaagtgcacaccatggacagttcaggtaaaattacgctcacgcctgtagtcatactaacgggctacatggatgaggagctcgccaagaagtcctgctcaaagatacagatcctgaaatgtggaggcacggcgcgttcacagaattcgagagaagaaaataaagaggccttaaagaatgatatcatcttcacaaatagtgttgagtccctgaagagcgcccacatcaaggaaccggagcgcgaagggaaaggcacagatctggagaaggacaagataggaatggaagtcaaagttgatagtgacgcaggaatcccaaaacgacaagagacacagttgaaaattagcgagatgtctattcctcagggccagggagcacagattaagaagtcggtgtctgacgttccccggggccaggagtctcaggtcaagaaatctgagtctggtgtaccaaaaggccaggaagcacaggtgacaaagagcggattggttgtgttgaagggccaggaggcccaggtggaaaagagtgagatgggagtacccaggcgccaagaatctcaggtgaagaagtcgcagtcaggcgtgtcgaagggccaagaggctcaggtcaagaagcgtgaaagcgtggtcttgaaaggacaagaagcgcaggtggagaaatcagagctgaaagtgcctaaaggtcaggaaggccaggtggagaagaccgaggctgatgtgcccaaggagcaagaagtgcaagaaaagaaatctgaggcaggggtcctcaaaggccccgagagccaggtgaagaacaccgaggtgtcagttcctgaaacactggaatctcaggtgaagaaaagcgagtccggcgtcctgaaaggccaggaggcccaggagaagaaagaatcatttgaggacaaggggaacaacgataaggaaaaggagagagacgccgagaaggaccctaacaagaaagaaaaaggagataaaaataccaaaggtgataaagggaaagataaagtcaaaggtaaaagggaatcggaaataaatggcgagaagagcaagggctctaagagggccaaagcaaacacaggccgaaagtataacaagaaggtggaggagtag

SEQ ID NO: 25339 - DNA, 1686 bp, Artificial Sequence
  Description of Artificial Sequence: Synthetic coding sequence
atgacggttcttgagatcaccctggcagtaattctcacattattgggcctggccattttagcaatactccttacccgatgggctcgatgtaaacagtcggaaatgtatatctcccgctatagctcggagcagtcggctcgcctcttggattacgaagatggaagaggttcgcgccatgcctactccacccagtctggcaatctttgctttcagcgtagcaagcgcgactacacgccatctaccaattctctcgtctcaatggcctctaaattcagcctggggcaaacagaattgatactcttgctaatgtgcttcatactggccttaagtaggtcgtcaattgggtccataaagtgtctccagacgaccgaggagcccccatccaggaccgccggtgcgatgatgcagtttacagcccctatccccggagcaacagggccgatcaagctgtcacagaagaccattgtgcagacacctggaccaatagttcaatacccaggcagtaacgccgggccaccctcagctcccagaggacctccaatggctcccatcatcattagtcagcgaacggctaggatcccacaagtgcataccatggatagttccggtaaaatcactcttacacctgtggtcatcctgaccggctacatggatgaggagctggccaagaaatcatgcagcaagatccagattctcaagtgcggagggaccgctcgctctcagaacagccgggaagagaataaggaggcactgaaaaatgatattatcttcacaaactctgtggagagtctgaagtcagcgcacatcaaggagcctgaacgggaaggtaagggaaccgacctcgaaaaagataagatcgggatggaggttaaggtggactccgatgcggggatacctaaacgccaggaaactcagctgaaaataagcgagatgagcatcccccaaggacaaggggctcagatcaagaaatcagtatctgacgtgcctagaggacaggaatctcaggtgaaaaaaagcgaaagcggggtgccaaaaggccaggaggcacaagttaccaagtctggccttgttgtgctgaaaggccaggaagcccaggttgagaagtccgaaatgggggttcctagaaggcaggaaagccaagtgaaaaagtcccagtctggcgtcagtaaggggcaggaagcccaagtcaagaagcgagagtctgtcgtgctcaaaggtcaggaggcccaggtcgaaaaatcagagttgaaagtccctaagggacaagaaggccaggtggagaagaccgaggctgacgtacctaaagagcaggaggtgcaagagaaaaagtccgaagccggcgtccttaaaggtcctgaaagccaagtcaaaaacaccgaggtttcagtgccagagacactcgagtcacaggtaaagaagtctgaaagtggagtgctgaagggccaggaagcccaagagaagaaagaaagctttgaggacaaagggaataatgataaggagaaggaacgggacgccgaaaaagatccaaataagaaagaaaagggagataaaaacacaaaaggggataagggtaaggacaaagtgaagggtaaacgtgaaagcgaaatcaatggagagaagagtaaaggctcaaagcgggctaaggcaaacaccggccggaagtataacaaaaaagttgaagagtag

SEQ ID NO: 25340 - DNA, 1683 bp, Artificial Sequence
  Description of Artificial Sequence: Synthetic coding sequence
agcgtcctcaaaatcaccttagctgtgattcttacacttctgggcttggcaattttggccatcctgctcactcggtgggctcggtgcaaacaaagtgagatgtacatctcaaggtactcaagcgagcagagtgcccgcctgctggactacgaggatggaagaggttcacgacatgcttattccacgcagagtgacactagctacgataacagggcccggtacgaagccccattttctccgaaaattgagaagctggcgatttcgaaaagttctctggccctgcctcaaggaagcatgagtagcatcaagtgcttacaaactaccgaagagccaccttgtattccgtgtgttatgatcttgatcttctataacgtgccggccactcgggggatgggaaaggtggtccgaaaacacataatgcaaacccccggccccattggtaaactccctgtcttcagcgtgcgaagccaccctcacacaatcaccgggccacccagcgcacctagaggaaagcctgtgagcaccttactaatttctaactcagtttgttcctacctcacacaaagctttcagttcccagaagtaagaacaatagccactaagaaaagggccactactcagggcagtgtgatcttaaccggatatatggatgaagaattggcaaaaaagagttgttccaaaatccagatcttgaagtgcggagggacagcaagatcccaaaattcacgcgaagagaacaaggaggctctgaaaaatgacattatcttcactaatagcgtggagagtctgaagtccgcccatattaaggagcctgagagagaaggcaaagggacggacctggagaaagataagatcggaatggaggtgaaggtcgactccgacgccggtattcctaagaggcaggagactcagctgaagatctctgagatgtcaataccgcagggacaaggcgcgcaaatcaagaagtccgtcagcgatgtgcccaggggccaggagtctcaagtcaaaaaatctgaatcaggggtgccgaaaggccaggaagcacaggtgacaaagagcggtttggtcgtattgaaaggccaggaagctcaagtggaaaaatccgaaatgggggtccctcgaaggcaggagtcccaggtgaaaaagagccagagcggtgtgtccaaaggccaggaggcacaggtgaaaaagcgggagtctgtggtcctgaaggggcaggaggcccaggtggaaaagagcgagttgaaagttccaaagggccaggaagggcaggtcgaaaaaacagaggcagacgtacctaaagagcaggaggtgcaggagaaaaaaagcgaggcaggtgtccttaaagggccagagagtcaggtgaaaaatacagaagtgtccgtgcccgaaactttagagagccaggtaaagaagtccgagtccggggtgcttaaaggccaggaagcccaggagaagaaggaatcttttgaagacaagggtaataatgacaaggaaaaagagcgcgacgcagaaaaggatccaaacaagaaggagaaaggggacaaaaacaccaagggagacaaggggaaagacaaagtcaagggcaagagagagtccgagattaatggagagaaatcaaaaggatctaaacgtgccaaggccaacacaggccgaaaatataacaaaaaagtcgaagagtag

SEQ ID NO: 25341 - DNA, 1704 bp, Artificial Sequence
  Description of Artificial Sequence: Synthetic coding sequence
atgactgtgctggaaataacactggccgttatactgacactgttgggactcgcaatcctcgccattctgctaacacgctgggcgcgctgtaagcagtctgaaatgtacatctctcgctactcttccgagcagagtgcacgcctcctagactacgaggatgggagagttgagtgtcaccacggtcaacagaaagaaacctctcataggaaaactgagcgtaagctcaggagggagcgcaagaggatcacaaatgaaagaaggttaataggcaccgagaaaagcctcccacaggggtcaatgtcctccatcaagtgtctgcagacgacagaagaaccaccttgcaagggaatgggaaaggtcatccaggctaagcagttgctcaatattagctggccccttgccgtgtcactttcgaagcccctgtgtattatccacgacgttcttgagagcttcaaaaccattaaccttcagtcccctgccgggttccaggctgtgacttcacactgtaaaaagggacgagacaaattcaggaagatcctggtctataagaaaggaaccagtattaaaggaaagaaaatcgagatcaaacgaaaatacctgatttccaagagccggcctttcgttgtctgtagcgtgatactaactggctacatggatgaggagcttgccaagaaatcatgctctaaaattcagatcctgaaatgcggcggtaccgctcggtcccagaacagccgggaggaaaataaggaggcactgaaaaacgatataattttcacaaattcggtagaatctctgaaatctgcgcacatcaaggaacccgaaagagagggaaagggaaccgacctggaaaaagataaaattgggatggaagtaaaagtggatagcgatgctggcatccctaaaaggcaggagacccagcttaaaattagtgacgagtacaccacacgcactggttctcctaataaggagaaatgtgtcagatgcacaaagagaaccggccaagtgaaaaagtctgagtctggggtgccaaagggccaggaagcccaagtcacaaagagcggcctggtggtgcttaaagggcaggaggcacaggtcgagaagagtgagatgggagtaccccgccggcaggaatcacaggtgaagaaatcgcagtctggagtcagtaaggggcaggaggcccaagtaaagaagcgagagtccgtcgtgctcaaggggcaagaagcacaggttgagaaatccgaacttaaagtaccaaagggtcaagagggacaggtggagaagaccgaggccgatgtgccaaaagaacaggaggtacaggagaagaagtcagaagcaggagtcttaaaagggcctgagtctcaggtgaagaacactgaggtgtcagtgcctgagactttagaatcccaggtgaaaaagagtgagtcaggcgtgctgaagggacaggaggcccaggagaaaaaggagagctttgaagacaaaggcaacaatgataaagagaaagagcgcgacgcagagaaagaccccaataaaaaggaaaaaggcgataaaaatactaagggcgataaaggcaaggacaaggtcaaaggcaaaagggaaagtgaaataaacggagagaagagcaaaggaagcaagagacgccagattcaggagggtagcaccacaaaaaagtggaaaagcaaggacaagttctttaaggggccttag

SEQ ID NO: 25342 - DNA, 1644 bp, Artificial Sequence
  Description of Artificial Sequence: Synthetic coding sequence
atgactgtgctggaaattaccctcgctgtgatcctcacactgctggggctggcgattcttgctattttattgactcgatgggcacggtgcaaacaatccgaaatgtacatttctaggtactctagcgaacaatctgcccgcctcctggactacgaagacggtcgcgggtccaggcatgcttatagtactcaaagtgagcgttccaaaagggattacacaccaagtacgaattcacttgccctctcaaggtcaagcattgctttaccacagggcagtatgtctagcatcaagtgcctgcagactacagaggagccgccttctagaactgccggagctatgatgcagttcacagctcccattcccggcgccacagggcctattaagctctctcaaaagacgatagtccagaccccaggaccaatagtgcagtatcccggctctaatgctgggcctccaagcgctcctcggggtccgccaatggctccaatcattatctcccagcgtaccgcctctcagctcgcagcgccgattcggattccgcaggttcacaccatggactcaagtgggaagattacactgacacccgtagtgattttaaccggctacatggatgaggagctcgctaagaaatcctgcagtaaaattcagatcttgaagtgcggtggaactgcccggagccagaattcccgggaggagaataaagaggcgctgaaaaacgacattatatttaccaactccgtggagtccctgaaatccgcccacatcaaggagccagagcgggagggaaagggtacagaccttgaaaaggacaaaattggtatggaagtaaaggtggattccgatgctggcatccctaaaagacaggagacacagctgaaaatctcagagatgagcattccccagggtcagggggcccagatcaagaagtctgtttctgatgtacctaggggccaggagtctcaggtcaagaagagcgaaagtggtgtgcccaaaggtcaggaggcacaagttacaaagtccgggctagtggtgctcaaagggcaggaggcccaagttgagaagtccgaaatgggcgtccccagacgccaggaaagtcaggttaaaaagtctcagtccggggttagcaaaggccaggaagctcaagtgaagaaaagggagagtgtcgtgctgaaaggccaggaggctcaggttgaaaaatccgagctcaaggtcccaaagggtcaggaggggcaggttgagaagacagaggcagacgttcctaaggagcaagaggttcaggagaagaaatcagaggctggcgtcctaaaggggcccgaaagccaggtgaagaataccgaggtgtctgttccggaaaccctcgagagtcaagttaaaaagtctgaatccggagtcctgaaagggcaggaggcccaggagaagaaagagagctttgaagataaaggtaacaatgataaagaaaaggaaagggacgccgaaaaggatcccaataagaaagagaagggagataagaacacaaaaggagacaaaggaaaagacaaagtgaagggtaagcgcgagagcgagataaacggagaaaaatcaaagggcagcaagcgggctaaggcaaacactggtagaaagtacaacaaaaaagtggaggagtag

SEQ ID NO: 25343 - DNA, 306 bp, Artificial Sequence
  Description of Artificial Sequence: Synthetic coding sequence
atggccgcctctcggtatagacgatttcttaaactgtgtgaggaatggcccgttgatgagactaagcggggccgggacctcggcgcatacctgaggcagagggttgctcaagcgtttcgggaaggcgagaacacccaatatcccagacccagggacacctcattttcgggtctgagcctcgaagaatacaaactgatattatcaacagacacccttgaggagctgaaagaaatagacaagggcatgtggaagaagctccaggagaaatttgctcctaaaggtcccgaagaggatcataaggcctag

SEQ ID NO: 25344 - DNA, 381 bp, Artificial Sequence
  Description of Artificial Sequence: Synthetic coding sequence
atggccgctagccgttacaggaggttcctgaagctttgcgaggaatggcccgtcgacgagaccaagaggggacgggacctgggcgcatatctccgtcagcgggtggcacaggcctttcgcgagggggagaacacacaggtggccgagcccgaggcatgtgaccagatgtacgagagcctggctcgactgcattccaattattataaacataaatatccccgtcccagagacacaagttttagcggtttgagcttagaagagtacaagctgatcttaagtacagacacacttgaagagctgaaggaaattgacaaaggcatgtggaaaaagctccaagagaagttcgctccaaagggacctgaagaagaccacaaggcttag

SEQ ID NO: 25345 - DNA, 1491 bp, Artificial Sequence
  Description of Artificial Sequence: Synthetic coding sequence
atgtaccagccatcccgcggtgctgcgcgtaggctcgggccctgtctgagggcataccaggctaggcctcaggtgtctgggggagaagaagggggccgaaggggagggggtgagcgaccctctagtaagcctgtgcgtggcgcagagcgggcccttggatctgcacaggcgcaacgtcatcccccaccactcccaacctgcgccctgcagagagtcgataggctcggagtcgccggtgccggcggccggaggtgccgagcttgtagggccagaacatctgtgctgccaggcctgcgggctgttagacgggggcaggggcaggccgcaggcagagtgtgtgtagcccccgatagtccaagattgccggttcctagaggagatttaaaagggagagggagggagattcgatcccccgctgctgccccttctcggtcttcccctgctcagaccaggccggccgggcgccctcagcaacccgctaggctggctttgggggaaagatcctggcaggaaggacgtcctgtgtgcacaaggttcggcccgttacgtcccgggtggcaggatggacatgctcctagtagagacggagcatcaaggaccccaagtggaactgaagaccagctgtatcctggaacactgccatttccgcccctgtggccgcacagtaccactaccacaagtccatctagtcccctcttctggtctcccctgcccccccgtctgcccacacagcggctgccgcaggttcctcctctgccgttgccacaaatacaggccctgagttcagcctgggtagttcttcctcccgggaagggcgaggaggggccaggtccggagcttcattccggttgtctggacggactgaggagcctgttcgaggggcccccctgtccctacccaggagcctggatcccctttcaggttcccggcactgcgcaccccagtccagctacaccgagtggagacccctcaatggaggaacatttgtcagtgatgtacgaacgactgcgacaagaattgccgaaacttttcctgcagtcccacgattactccctctatagcctcgatgttgagttcatcaacgagattttaaatatccgaacaaaagggcgaacgtggtacattctgtcactcaccctatgtcggtttctggcatggaactactttgcacatctgcgcttggaggttctgcagttaactcgccaccccgagaattggacactccaggcaagatggcgactagttgggcttccagttcacctgctcttcctacgtttctataagagagacaaggacgaacactaccgcacctacgacgcatattcaacattctacctgaatagctccggcctgatatgccggcaccgcttagacaagcttatgccgagccattcgcctcccacccctgttaaaaagctcttggttggcgcgctggttgcacttggactttctgaacccgaaccagatttgaatctatgctccaaaccttag

SEQ ID NO: 25346 - DNA, 546 bp, Artificial Sequence
  Description of Artificial Sequence: Synthetic coding sequence
atgtatcagcctagcaggggcgccgctcggcgcttgggtccatgcctgagggcatatcaagcccgtccacagttaccaaaactgttcctgcagtcccatgactactctctctatagtttggacgtggaatttatcaacgagattctcaatatcaggacgaagggtcgcacctggtacatcttgtctctaaccctgtgtcgattcctggcttggaactatttcgcccacctcagactggaggtcctacagctcaccagacatcccgagaattggactctacaggcccggtggagactggttgggttaccagtacacctcttattcttacgtttctacaagcgcgataaagatgagcattaccgcacatatgatgcgtactctactttctacctcaactcaagtggcctcatatgcagacatagactggataaattaatgccatctcactcacctcccacccctgtgaagaagttattggtgggcgccttggttgctctagggctcagcgaacccgaaccggacctgaatctgtgctccaagccctag

SEQ ID NO: 25347 - DNA, 948 bp, Artificial Sequence
  Description of Artificial Sequence: Synthetic coding sequence
atgtaccagccgagcagaggggcggctcggcggctcggcccttgcctgagagcctaccaagcacgaccccaggatcagctgtacccaggaacacttccattcccacctctctggccgcatagcacaaccaccacatccccatcaagtccattgttctggtctccccttccccccaggctccccacacagcgcctgcctcaggtgccccctctacccctgccccagatccaggccctgtcttcggcttgggtggtactccccccaggtaaaggcgaggagggccccggtccagagttacactccggctgtctcgacggattgcgttctctgttcgaggggccgccctgcccatacccaggtgcttggatcccctttcaggtcccaggcacagcccatccatcccccgccacaccgtctggagatccgagcatggaggagcacttgtccgttatgtatgagcgacttagacaggagctgccaaagctgtttttgcagtcccatgattattctctgtattctctggatgtggaatttataaatgagattctgaacatcaggaccaaagggcgaacttggtatattttgagtctgaccctgtgtcgcttcctggcctggaactactttgcccatcttcgcttggaagtcctgcagctcactagacatccagaaaattggactcttcaggccaggtggcggctggttgggttgcctgtgcatttgcttttcttgcggttttacaagagagataaagacgagcactatcggacctacgatgcctattctactttctacctaaattcttccgggttgatctgtagacataggttggacaaacttatgccaagtcattcaccccccacccctgtgaaaaaattactggtgggagcattggttgctctggggctaagtgagccggagccagatctgaacttgtgtagcaagccttag

SEQ ID NO: 25348 - DNA, 519 bp, Artificial Sequence
  Description of Artificial Sequence: Synthetic coding sequence
atggaggaacatctctccgtaatgtacgagcgtttgcgacaggaattgccaaaactctttctacagtcccacgattattccctgtacagcctcgatgtggaattcattaacgagatcctaaatatacgcaccaaggggcgcacttggtacatcttgagcctcaccctgtgcagatttctggcctggaactacttcgctcacctccgcctcgaagtcctgcagcttaccaggcacccggagaactggaccctgcaggcgagatggcggctggttggactgcccgtccacctcctatttctgcgtttctataagcgtgataaagacgagcattaccgtacatacgacgcatattctaccttttatctgaactccagcggacttatatgtcggcatagactggacaagctaatgcccagccacagtccacctacccctgtcaagaagttgctagtgggagcactggtggccctagggctctccgaacccgaacctgacctcaacctctgctcaaagccctag

SEQ ID NO: 25349 - DNA, 2541 bp, Artificial Sequence
  Description of Artificial Sequence: Synthetic coding sequence
atgtgcttcttacggaggccaggcgcacccgcatcttggatttggtggcggatgttacgccaggtcctgcggcgcggcttgcaatctttttgccacagattgggtctttgtgttagccggcaccctgtgttttttctaactgtccccgcagtgctcacaataacatttggcctgagtgctctgaacaggtttcagccagaaggtgatcttgagaggctggttgctccgtcacatagcctggccaagatcgaacgctccctggcttcaagcctgtttcctctggatcagagtaagtctcagctgtatagcgaccttcacacaccaggtagatatggacgggttatcctgttgtctcccactggggacaatattctgctgcaggctgaggggattcttcagacacatagggctgtgcttgagatgaaagatgggagaaactcctttattggccaccagttgggcggggtcgtcgaggtgcccaattccaaggaccaacgagtaaagtcagcccgcgctattcagataacatactacctccagacctacggctcggcaacccaggacttaatcggagagaagtgggagaatgagttttgcaagttgattcggaaactacaggaagagcaccaggagctgcagctttactctctggccagctttagcctctggcgggatttccacaaaaccagcatccttgctcgcagcaaggtgctggtcagtttggtgctcatccttaccaccgccacactaagctccagtatgaaggactgcttacggtccaagccgtttctcggtcttctcggcgtcctaaccgtctgcatctccatcattacagctgccggcatcttcttcattaccgatgggaaatataactctaccctgcttggaattccttttttcgcaatggggcatggaaccaagggggtgttcgagcttctgagcggctggcggagaactaaggagaatttgcctttcaaggatcgaattgctgatgcctatagtgatgttatggtaacttatacaatgacttcgagcttatatttcataacattcgggatgggagcctccccttttaccaatattgaggctgtgaaagttttttgccagaatatgtgcgtgtcaatccttttgaattatttctatattttctctttcttcgggtcttgtctggtcttcgccggacagctggaacaaaatagataccattcaatattctgttgtaaaattccgagtgcagagtacctcgacagaaagccagtttggttccagacagttatgtcagatggtcatcagcagacaagtcaccatgaaactaatccatatcaacatcacttcatccagcattttctgcgcgaacactacaacgaatggatcacaaacatttacgtgaaacctttcgtcgtaattctgtacttgatttacgctagcttctcctttatgggatgcttacagatcagcgacggggccaatatcataaatcttcttgccagtgactcgcctagcgtgtcttatgccatggtccagcagaaatacttttcaaattatagcccagtcatcggcttctatgtctacgagccgctcgaatactggaattcctccgtccaggatgacctgagaagattgtgctcgggttttacggccgtgtcctgggttgaacagtactaccagttcttaaaagtctcgaatgtgagtgccaacaacaagagtgacttcatctctgttctacagtccagcttcttgaaaaagccagagttccagcactttcgcaatgacatcattttctctaaggccggagacgagtctaacataattgccagcaggttgtacctggttgcaagaactagcagagacaagcaaaaggaaataacggaggtcttggagaagcttcgcccactttccctgtccaagtccattcgtttcatagtgtttaatccctccttcgtgtttatggaccattattccctgtctgtgactgtgcccgtcttgatagccggcttcggcgttctcttggttctgattctcaccttcttcctagtgatccatcccttggggaatttttggctcattctttctgtgacgagcattgaactgggggtactgggtctcatgaccctgtggaacgtggacatggattgtattagcatactgtgccttatctatacactcaattttgccattgaccattgcgcccctctgctctttacctttgttctggcaactgaacatacccggactcagtgcatcaagagctctctgcaggatcacggcactgctattctgcaaaatgtgacgagctttctgatcggcttggtcccactacttttcgtcccttccaatctgacattcacactgttcaaatgcctcctcctaacagggggatgcacgctgcttcattgtttcgtgattttgcctgtgttcttgacattctttcctcccagtaaaaagcaccacaagaagaagaagagagcaaagcgtaaggaacgcgaggaaattgagtgtattgaaattcaggagaatcccgatcacgtaacgactgtgtag

SEQ ID NO: 25350 - DNA, 936 bp, Artificial Sequence
  Description of Artificial Sequence: Synthetic coding sequence
tgatgcttcctacgcaggcctggggcaccggccagctggatctggtggaggatgctgaggcaggtgctgcggagggggttacagagcttttgccatcgattggggctgtgtgtcagtcgccacccagtattctttctgacagtaccagcagtactcactattacttttgggttgtcagctcttaacagattccagcccgagggggatttggagcgattagtggctccatcccacagtctggccaagatcgagcggtcactagcttcatcacttttccccctggatcagtccaagagtcagttgtattctgacctacatacccccggcagatatggcagggtcattctgctgtctcccacaggggacaacatcctccttcaggcggagggcatcctgcagactcatcgggccgtattagaaatgaaggacggcaggaactcatttatcggacatcaacttgggggcgtcgtagaggtcccaaattcaaaggatcagcgcgtaaagtcggcccgcgcgattcagatcacttattatttacagacctatggctctgcaacccaagatctgattggagagaaatgggaaaatgagttttgcaagctcatacggaagctgcaagaagagcatcaggaactgcagctctacagcctagccagcttttctctgtggagggattttcataaaacatctatattagcacgaagtaaggtcctggttagcctggtgctgatactaacgacagccaccctatccagttctatgaaggactgccttagatccaaaccttttctcggattactaggcgtgctgacggtctgcatttccatcattacagcggccggcatcttttttattaccgacggaaagtacaatagtaccctactaggcattccattctttgcaatgggcatttctacagaattcacctctagttag

SEQ ID NO: 25351 - DNA, 885 bp, Artificial Sequence
  Description of Artificial Sequence: Synthetic coding sequence
atgctccggcaggttcttaggcgtgggctccagtccttctgccaccggctcggcctctgtgtcagcaggcaccccgtcttttttttgacagtgccagcagtgctcacgatcacatttggtctttcagcgctgaataggttccagccagaaggagatcttgaaagactcgtcgccccatcccacagtttggccaaaatcgagcgatctcttgccagcagcctgtttcccctggaccagtctaaatctcagttatatagcgacctgcacacaccggggcggtacggcagggtgatcttgttgtccccgacgggggataatatcctgttgcaggctgagggaattctgcagacccatcgcgctgtcctggagatgaaggatggcagaaactcattcatcgggcatcagcttggtggtgtggtggaagttcccaacagtaaagatcagagggtgaagagtgctcgcgcgattcagatcacttactacctacagacctatggatcggcaacacaggacctgattggggagaaatgggaaaatgagttctgcaagctcatccgaaagctgcaggaagaacaccaggaactccaactgtacagcctggccagctttagtttgtggcgggatttccacaaaacctccattctggcccgtagtaaggtcctcgttagtttggttctgattttgacgactgctacactctcctcttctatgaaagactgcctgcgatccaaacccttccttggactcctgggtgtgttgaccgtctgtataagcattattaccgccgccgggatctttttcatcacggacggaaaatataatagcacattgttgggcatcccatttttcgcaatgggtattagcaccgaattcacatcgtcctag

SEQ ID NO: 25352 - DNA, 339 bp, Artificial Sequence
  Description of Artificial Sequence: Synthetic coding sequence
atgcaagacaccggttcggtggttcctctgcattggttcggattcgggtacgccgcactggtggcttcaggaggaatcattggctatgtgaaggcagggagtgtgccctccttggccgcagggctgctctttggatctttagccggccttggcgcataccaactgagtcaggatcctcggaacgtctgggtcttcctcgcgacatccgggaccctcgccggaataatggggatgagattttaccattctggcaaatttatgcccgctggtcttatcgccggagccagccttttaatggtggccaaggtgggcgtcagcatgttcaaccggccacactag

SEQ ID NO: 25353 - DNA, 294 bp, Artificial Sequence
  Description of Artificial Sequence: Synthetic coding sequence
atgagctccgcccccgagcctcccaccttcaagaaagagccaccgaaagaaaaagagtttcagagcccggggttgaggggagtgaggacaacaacactgttcagagcggtcaatcccgagctgtttatcaaacccaataagcctgtcatggctttcggattggtgactttgtccctgtgtgttgcctatattggatatctgcacgctatccaggaaaacaagaaggacttgtacgaggcaatcgactccgaaggacattcctatatgcgccgcaagacctccaagtgggactag

SEQ ID NO: 25354 - DNA, 2844 bp, Artificial Sequence
  Description of Artificial Sequence: Synthetic coding sequence
atgagtcagccgcctattggtggtgcagcaccagcaacagccgcagcaagccctgctgccgctgctactgaggctagattgcaccccgaagggtccagcagaaagcagcagagagcacagagccccgccagacccagggacagcagcctgcgccagactatcgccgccacacgctctcctgttggggctgggactaaattaaactctgttaggcagcagcaattgcaacagcagcagcaacagggcaataagactgggagccgaaccgggcccccagcaagcattcgaggcggcggagggggggcagaaaaagctacccctttagctcctaaaggagccgctccgggagcagttcaacctgtggccggagccgaggccgcacctgccgctaccctggcggctctgggggggagaaggcctgggccgcctgaggagccacctagagaactggagtccgtcccatctaaactgggtgaacctcctccactcggagagggcggagggggtggaggagagggtggaggagctgggggtggttcgggtgagagggaggggggcgcacctcaaccaccaccacctcgtggatggcggggcaagggcgtgcgcgctcagcagcgtggtggttctggcggggagggggcctccccaagtccatcatcttcatccgcagggaaaactccagggactggctctaggaactcaggcagcggcgtagcaggcggtggttctggggggggtgggtcgtattggaaggagggatgtctgcaaagcgagctgatccagtttcatctcaagaaagagcgagccgctgccgccgcagcagccgctcagatgcacgcaaaaaatggcgggggcagcagcagcagatcttcccccgtgagcggaccgccagcagtttgcgagacacttgctgtggcttccgccagccctatggcagcagccgccgagggcccccagcagtcagccgaaggtagcgcaagcggcggtgggatgcaggccgccgcaccccctagctctcagccacacccgcaacaactccaggagcaggaagagatgcaagaagagatggagaaattaagagaagagaatgaaaccctcaaaaatgaaattgacgaactgaggactgagatggatgaaatgcgggacaccttttttgaagaagacgcctgccagctgcaagagatgagacacgagctagaacgtgccaataagaattgccggatactgcagtatcggctaaggaaggctgagcggaagagactccggtatgcccagactggagaaattgacggggagctgttgcgctcactggagcaagatctcaaagtggctaaggacgtgtccgtgagactacatcacgaactagaaaatgtggaagaaaaaaggaccactacggaggatgaaaacgagaagctgaggcagcagctcatcgaagtagaaattgcaaagcaggccctgcagaatgaactggagaaaatgaaagagctgtcgctgaaaagacgcggcagcaaggatctgcctaagtccgagaaaaaagcccagcaaacacctacagaagaagataacgaggacctgaaatgtcagttgcaatttgtgaaggaagaggcagcactgatgcgtaaaaagatggctaagatcgacaaggagaaagatcgctttgagcatgaactgcagaagtatcggtctttttacggggacttggactcccctttgcccaagggtgaagccggaggccccccctccacccgagaagcagaattaaaattacgactcagactcgtagaggaggaggctaacatcctcgggaggaaaatagtggaactggaggtcgaaaaccgcggcttaaaggctgagttggacgatctgagaggggatgactttaacggctccgctaatccactcatgcgcgagcaatccgagtcactctccgaactcagacagcacctgcagctagtcgaggacgagaccgagctacttcggcgaaacgtagcagatctggaggagcaaaataagaggatcacagccgagctgaacaaatataagtataagtccggaggccatgactccgccagacaccacgacaatgctaagacggaggctctccaggaggaactaaaagctgcacgtctccaaatcaacgagttgagtgggaaggtgatgcaacttcagtacgagaaccgggtacttatgtcaaatatgcagaggtatgacctggcttctcatctcgggatacggggatccccgcgcgattctgatgctgaatcagatgccggaaaaaaggaaagcgatgatgatagccgcccccctcatagaaagagagaaggccctattggtggcgagagcgacagtgaagaggtccgaaatatcagatgtctgacgcccaccaggagtttttatccagccccaggcccgtggcccaaatcctttagcgatcgtcagcaaatgaaggatatacgctctgaggccgagcgcctcggcaaaacgatagacagattgatcgcagacacatctactatcatcacagaggcccgaatatacgtggccaatggcgatttgtttggccttatggatgaggaggacgatgggagccgaatccgtgaacacgagctcctctaccgaataaatgcccagatgaaggcatttaggaaagaattacaaacctttattgatcggctagaggttcctaagagtgcagacgatcgcggggccgaggagcctattagcgtctctcaaatgttccagcccattatcttactgattctgatactcgtcctcttttctagcttgtcctatacaactatttttaagctagtttttcttttcacactgttctttgtgctgtag

SEQ ID NO: 25355 - DNA, 33 bp, Artificial Sequence
  Description of Artificial Sequence: Synthetic coding sequence
atgagccaaccgcctattgggggagcggcttag

SEQ ID NO: 25356 - DNA, 2844 bp, Artificial Sequence
  Description of Artificial Sequence: Synthetic coding sequence
atgagtcaaccaccaatcggcggagctgcacctgccactgcagcagccagtcctgctgcagccgcaaccgaagccagacttcacccggagggatcgagccgaaaacagcaacgagcccagtcccctgccaggcctcgagatagttcactgaggcagacaatcgcagccacccgtagccccgttggagccggcacaaaactgaactccgtgaggcaacaacagcttcagcagcagcaacagcagggaaataaaacaggctctaggactggacccccagcgtcaatacgcggcggtgggggaggcgcggaaaaggcaaccccactggcccccaagggggctgcacccggcgccgtccagcctgtggctggtgctgaggcagcacccgcggccacacttgcggccctcggagggagacgccccggaccccctgaggagccccctcgtgagcttgaatccgtgcccagcaaattgggagaacctccacctttgggcgaggggggtggtggcggcggggaagggggaggcgccggcggtggatctggcgaacgcgagggcggcgcccctcaaccccccccacctaggggatggcgtggaaagggggttagggctcagcaacggggagggtccgggggtgaaggcgccagcccctctccctcaagctcctcagctggaaaaacccccggcaccggatccaggaacagtgggagcggagtggccggaggtgggtcagggggcggaggctcttactggaaggaagggtgtcttcagagcgaactgatccaattccacctaaaaaaggaacgtgccgctgcagctgcagcagcggcacaaatgcacgccaaaaatggaggcggaagctcctcaagaagctcacccgttagcggtccgccagcagtctgcgaaacactggccgtggcctctgccagtcctatggccgcagccgccgagggtccccaacagtccgctgagggatccgcctccggtggaggtatgcaggccgccgcgcctccctcttcacaacctcacccccagcaactccaggagcaggaggagatgcaggaggaaatggagaaattgagagaagaaaatgaaacattgaaaaatgagatcgatgagctcagaacagaaatggacgaaatgcgggacacattctttgaggaagatgcttgccaattgcaagagatgcggcacgaattggagagggcgaacaagaactgcagaatccttcaatacaggctaaggaaagccgagaggaagcgcctgcgatacgcccaaactggcgaaatagacggcgagctgttgaggtcactggagcaagacctcaaggtggcaaaggacgtgtcggttagactgcaccacgagttggagaacgtcgaagagaaaagaaccacgactgaagacgagaatgagaagctgcgccaacagcttatcgaggtagagattgccaaacaggcactgcagaacgagttagaaaagatgaaggagctcagcctcaaaagacgaggaagcaaagatcttcctaagtcagagaaaaaagcccagcaaacgccgactgaggaagataacgaagatttaaagtgtcagttgcagttcgtgaaggaggaggctgctctgatgaggaaaaagatggccaaaattgacaaggaaaaagatcgttttgagcatgagctccagaaatacaggagcttctacggtgacctggacagtccgctgcctaaaggtgaggcgggcggaccaccatcaactcgggaggcagagttaaagctcagacttcgtctggttgaggaggaggcaaatatcctgggcaggaaaattgtggaactggaagtagagaaccgcggcctaaaggccgagctggatgacctgaggggagacgacttcaacggtagcgccaatccactgatgcgcgagcagtcagagagcctgagtgagctgcgtcaacacctccagctagtggaagatgaaactgagcttctccgacgcaatgtggcagacctcgaggagcagaataaaagaattactgccgaattgaacaaatacaaatacaagagtggaggccatgacagcgctcggcaccatgacaacgcaaagaccgaggccctccaggaggaattgaaagccgccagactacagattaatgagctctctggcaaggtcatgcagctccagtacgagaacagggtgctcatgtctaacatgcagcgctatgacctggcatcccatctaggtattagagggtccccaagagacagcgatgccgagagcgatgctggaaagaaagagagcgacgatgactcccgacccccccaccgcaagcgcgaggggcccatcggaggcgaatctgacagcgaggaggtcagaaatatccgatgcttaacgcctactagaagcttttatcccgcacctggcccttggcccaagtccttcagtgaccgacagcagatgaaagacataaggagcgaagcagagaggttgggaaaaacgatagatcgacttatcgcggacacctccactatcatcactgaagcgcgcatatatgtagccaacggagatctgttcgggcttatggatgaggaggatgatggcagcaggattcgagagcatgagctgctgtatcgaatcaatgcccagatgaaagcttttcggaaagaactccagacattcatcgatcgtttggaagttcctaaatcagcagacgacagaggggcagaggagcctatctcagtatcgcagatgttccagcccatcatactccttattctgatcttggtcctttttagcagcctatcatatacaactatatttaaactggtgtttctctttacattattctttgttttgtag

SEQ ID NO: 25357 - DNA, 2844 bp, Artificial Sequence
  Description of Artificial Sequence: Synthetic coding sequence
atgagccagcccccaattggtggggccgcgcccgccacagcagccgcttctccggccgctgcagctaccgaggctaggctccaccctgagggaagctctcgcaagcagcagcgggcacagtcacctgctagaccccgcgactcgtccctgagacaaacaatcgccgccacaaggagccccgttggagccggaacaaagctcaattcagtcaggcagcagcagctccagcagcagcagcagcaggggaataaaaccggaagccgcaccggcccccccgcctccatccgaggcggtggcggaggcgcggagaaggccacccccttggctccgaaaggcgctgcccctggtgccgttcagcccgttgctggtgccgaagccgcacccgcagcgacgctggcagctctggggggacgccgaccaggaccacccgaggagccacctcgagagctggaaagcgtcccttctaaactgggggagcctccccccctcggcgaaggcgggggcggtggcggtgaggggggaggcgccgggggcgggtccggtgaacgcgaaggcggagcacctcagccaccaccccccagaggctggagaggcaaaggagtccgcgctcagcagagggggggtagcggcggagagggagcttcccccagcccttcttcttcctccgcaggcaagacacctggaacaggtagcagaaactctgggtctggtgttgccggggggggcagcggcggcggcgggtcatattggaaggaaggctgtttgcagagcgagctgatccagttccacttaaaaaaggaaagagcagcagccgcagccgctgcggcacaaatgcacgccaaaaacggcggggggagcagtagcagaagctcccctgtatcaggcccccctgccgtgtgtgaaacactggccgttgccagcgcctctccaatggcagcggccgccgaaggaccacaacaaagcgcggagggatctgccagcggaggtggaatgcaggccgcggctccaccgtctagtcagccccaccctcagcaacttcaggaacaggaggagatgcaggaagagatggagaaactgcgggaggaaaatgaaacactgaaaaacgagattgatgagttgcggactgaaatggacgagatgagagataccttcttcgaggaggacgcctgtcagctacaggagatgcgccatgaactggagcgtgctaacaagaactgcagaatcctgcagtatagactccggaaagccgagcggaaacggctgcgctacgcacagacaggcgaaatcgatggtgagctgcttcggagtctggagcaggatcttaaagttgcgaaagacgtgtccgtgagactgcaccacgagctggaaaatgttgaggaaaagagaacgaccacagaggacgaaaacgaaaaattacgccagcagctcattgaagtcgagattgccaaacaggccctgcagaatgaactcgagaagatgaaggaactgagcctcaaacggaggggatccaaagacctgccaaaatcagagaagaaagctcaacagacccccacagaggaggataacgaagacctcaaatgccagctgcaattcgtgaaggaagaggcagcattgatgagaaagaagatggcaaaaatcgataaagagaaagatcgatttgaacacgagctgcagaagtatcggagcttttacggcgaccttgatagcccactgcctaagggggaggccgggggtcctcccagcacaagagaggccgagttgaaactgaggctaagacttgtggaggaggaggcaaacatcctcggccggaaaatcgtcgagttagaagtagaaaacagaggcttaaaggccgaactagacgatcttcgcggagatgattttaacggcagtgccaacccactgatgcgagagcagtctgagagtctgagcgagctccggcagcatctgcagcttgtcgaggatgaaactgaactcctccggcggaatgtcgcagatttagaggagcaaaacaaaaggattaccgctgagctgaacaagtacaagtacaagtctggaggccatgacagtgcccgccaccacgataatgccaaaacggaagctcttcaggaggagctcaaggcagctcgcctgcaaataaacgagctgagcggcaaagttatgcagctgcagtacgagaacagagtcctcatgtcaaatatgcagaggtacgacctggcatcccacctcgggattcggggatcaccacgtgatagcgatgctgaatcagatgctggtaagaaggagagtgatgacgactcaagacctccacaccgcaagagggagggccccatcggaggtgagtctgattctgaggaggttcgcaatattcgctgcttgacgcctacgaggtcgttttaccctgcccctggcccatggccaaagagcttcagcgataggcaacagatgaaggacatccgctccgaggccgagcgcttggggaaaacaatcgataggctgatcgctgatacatctactataatcactgaggctcggatctacgtcgccaacggagatttgttcgggctgatggatgaagaagacgacggctcaagaataagggaacacgagttactgtaccgcataaatgctcagatgaaggcattccggaaagaattacagactttcattgaccggcttgaagtacctaagagtgccgatgaccgcggcgctgaagagcctatatccgtttcccagatgtttcagcccatcatcctgttaatcttaatcttggtcctgttctcctccctgtcttacaccaccattttcaagctcgtcttcctgtttaccctgttttttgtgctgtag

SEQ ID NO: 25358 - DNA, 387 bp, Artificial Sequence
  Description of Artificial Sequence: Synthetic coding sequence
atggcactgcaggtcagagtcgcacctagcaaggtggtcctgcagaaatttctgctgtgtgtcatcttgttttataccgtatattatgtcagcctgtccatggggtgtgtgatgtttgaggtccacgaactcaacgtgttggcaccattcgattttaagactaacccctcttggctgaacattaattacaaggttctcctggtaagcacagaagtgacttatttcgtgtgtggcctgttctttgtgcccgtggttgaagagtgggtctgggactatgccatcagcgtcacaatactacacgtggcgataacttcaaccgtcatgcttgaatttcctctcacatcacattggtgggctgccttgggaatttctaaactgctggtctag

SEQ ID NO: 25359 - DNA, 387 bp, Artificial Sequence
  Description of Artificial Sequence: Synthetic coding sequence
atggcactgcaggtgcgcgtggcacccagcaaagtcgtgctccagaaatttcttctgtgcgtcattctgttctacactgtgtactatgtcagtttgagtatgggatgcgtcatgtttgaagtccacgaacttaacgtactggcaccgtttgactttaagacaaacccatcatggctgaatataaactataaagtcctgctggtttctaccgaagttacctacttcgtctgcggcctctttttcgtgccggtggtcgaggagtgggtgtgggattatgctatcagcgtgaccattttacacgtggccattacatctaccgtaatgttggaatttccactcacatctcactggtgggccgctctgggtatcagcaagctgcttgtctag

SEQ ID NO: 25360 - DNA, 723 bp, Artificial Sequence
  Description of Artificial Sequence: Synthetic coding sequence
atggctatggcgtcagtaaagttgttggcaggtgttctgagaaaacccgatgcgtggatcggcctctggggtgttctcaggggaacaccaagctcttataagctttgtacgtcatggaacaggtacctgtacttttcttccacaaaactccgggcgccaaattataaaacgctgttttataatatcttctcactgcgcttgcccgggcttctccttagtcctgagtgtatctttcctttctccgtacgactcaaaagcaatattaggtcaacaaaaagcacaaagaaaagcctccagaaagtggacgaggaggacagcgacgaggagtctcaccacgacgagatgtctgaacaggaggaggagctggaagacgatcccacagttgtgaagaactacaaggacctagagaaggctgtgcagtcattccgatacgatgtggtgttaaaaaccggactcgatattggcagaaacaaagtagaggacgcattctacaagggagaactgcggctcaatgaagagaagctttggaagaagtcccggaccgttaaagtgggtgatacactggacctgctgattggggaggataaggaggcgggaaccgagacagtgatgcggatacttctgaaaaaggtttttgaggagaagaccgagtccgagaagtatagagtggtgctccggagatggaaaagtctgaaactgcccaaaaaacgaatgagcaagtag

SEQ ID NO: 25361 - DNA, 723 bp, Artificial Sequence
  Description of Artificial Sequence: Synthetic coding sequence
atggccatggcctccgttaagttgttagccggagttttgcgcaagccggatgcatggatcggcctgtggggggtgcttcgaggtacaccatctagttacaaattgtgcaccagctggaacaggtatctgtatttttcttcgactaagctccgagctcctaattataaaacgctcttctataacatattctctctcaggttgccaggtttgctcctgagccccgagtgtatcttccccttctccgtcaggctgaagtcaaatatcagaagtacaaaatctacaaaaaaatccctgcagaaagtcgatgaggaggactcagacgaagagagtcatcacgacgaaatgagcgagcaagaggaggaactggaggacgatcccacagtggttaagaactacaaggatctggagaaagccgtccagtccttccgatatgatgtggtgctaaagacaggcctggatattggtagaaacaaggtggaagacgccttctataagggggaactccgattgaatgaggagaaactgtggaaaaaatctagaacggttaaggtcggcgatacactagacctgctgatcggcgaagacaaggaagcggggaccgagacagttatgagaatactcctgaagaaagtgttcgaggaaaagacggagtccgagaagtacagggtggttcttcgacgctggaaatcgttaaaacttccgaaaaagcgcatgtccaaatag

SEQ ID NO: 25362 - DNA, 738 bp, Artificial Sequence
  Description of Artificial Sequence: Synthetic coding sequence
atgatcatcagcgcaatggctatggcgagcgtgaagctgctggccggggtgctgagaaagccagatgcatggatcggattgtggggggtcctcaggggaaccccatctagctataaactgtgcaccagttggaacaggtatctgtactttagttctacaaagctgcgcgcacccaactataaaacactgttttataatatctttagtttacggctgccgggccttctcctgagtcctgagtgtatttttcccttttctgtaagactgaaatcaaatattaggtccaccaaaagcactaaaaaatccctgcagaaggtagacgaagaagacagcgatgaggaatcacatcatgacgagatgtctgaacaggaagaggagctggaggacgaccccaccgtagttaagaactataaagacctcgaaaaggccgtgcaaagcttccggtatgatgtcgtgctcaaaacagggttggacatcggaagaaacaaggtggaagatgccttttataagggtgagcttcgtctgaatgaggagaagctttggaaaaagtccaggactgtgaaagtcggggatactttggacctcttgatcggcgaggataaggaggctgggaccgagacggttatgcgaattctgttgaaaaaagtgtttgaggaaaagaccgaatccgagaagtacagagtcgtcttacggagatggaagagcctgaaactgccaaaaaagaggatgtccaaatag

SEQ ID NO: 25363 - DNA, 582 bp, Artificial Sequence
  Description of Artificial Sequence: Synthetic coding sequence
atggcagtgttcctgcaactgctgccccttctgctctcacgcgctcaggggaatccaggcgcttccctggacggccgtccaggagaccgggtgaacttaagttgcggcggcgtctcccatccaatcaggtgggtctgggcgccttctttcccagcctgtaagggcctttccaaggggcggcggcctatcttgtgggcttctagctccggcacgccaaccgttcctccactccaacccttcgtgggcaggctgagatctctcgatagcggtatcaggaggctcgagctccttcttagtgctggagactccggcacatttttctgtaaaggccgacacgaggacgaaagccgcactgtgttgcacgtgctgggcgacagaacctactgtaaggcacccggacccacacacgctctgtctcccccccacagctctacctgtgaaaatagagcacctgaagcttctaaggggggacgcgctcaggactctcggggtcccggtcccggcaccgaacccgccctgtgcggctccggcccctcttcacctcaacaggccccgccagcggtacacagtggtccttgctag

SEQ ID NO: 25364 - DNA, 654 bp, Artificial Sequence
  Description of Artificial Sequence: Synthetic coding sequence
atggccgtctttctgcagctgctccccctcctgctgagccgcgcgcaaggcaatcccggagcaagtctggacggtcgaccaggcgaccgtgtcaatctgagttgtgggggggtaagccatccaatccgttgggtgtgggcccccagtttccccgcctgcaaggggctatccaaaggccgaagacctatactttgggcttcgagcagcggcaccccgacagtgccccctctgcagccgttcgtgggccgtttacgctccctggactcaggcatacgtcggctggagcttctactgagtgccggagactccggcaccttcttctgtaaaggacgccacgaggacgaaagtagaaccgttttacacgtgctgggcgacaggacctattgtaaggcacctggcccaactcacggggcttgcccccggaataggttcgaccactctctggatttgctctgtccaccacacatcgctccccttgttaaaaccgaaccccagaggccagtcaaagaggaggagcccaagattccaggcgatttagatcaggagccttccctgttgtatgccgatctggaccacctggctttatctaggccacggaggctctcaactgctgatcctgctgacgcctccactatctatgccgtcgttgtctag

SEQ ID NO: 25365 - DNA, 726 bp, Artificial Sequence
  Description of Artificial Sequence: Synthetic coding sequence
atggccgtgtttctgcagctcttaccattactcctgtccagagcccagggcaatcccggggcctcactggatgggcgaccaggcgacagagtgaatctgagctgcggcggagtgagccacccaatcagatgggtatgggcaccttcattcccggcatgtaaaggactatctaagggtagacgacccatactctgggccagctccagcgggacccctaccgtgcctcctttgcagccattcgtgggcaggttacggagtttggattctgggattcggcggcttgagctcctgctgtctgccggagattccgggacgttcttttgtaagggccgccacgaggatgaaagccgaacagtacttcacgttcttggcgacagaacttactgcaaagcgccaggacccacacacgggagtgtctacccccagctgctcattcctctgcttggtgccgggttagtcctcggcctgggggcgctgggtcttgtgtggtggctgcaccgtaggctaccacctcagccaatccgtccacttccccgcttcgcaccgctggtgaagaccgagcctcagaggccagtgaaagaggaagaaccaaaaatcccgggtgatcttgaccaggaaccttccttgctatacgcagaccttgaccacctggctctgagcagacctaggcggctgagcacagccgacccggcagacgcaagtaccatttacgcagtagtcgtctag

SEQ ID NO: 25366 - DNA, 714 bp, Artificial Sequence
  Description of Artificial Sequence: Synthetic coding sequence
atggctgtttttttgcagcttctcccattgctcctgagtagggcacagggcaatcctggtgcctctctggacggcaggcccggcgaccgagtcaatctgtcatgcggaggcgtgtcgcacccgattcggtgggtatgggcaccatctttccccgcatgcaaggggctaagtaagggtcgtcgacctattctgtgggcttcctcctccggcacgcctacagtgccaccattacagccatttgtcggacgcttacgatcattggattcaggaataaggagacttgaacttttactgtctgccggtgacagcggcacctttttttgtaagggcaggcacgaggacgagtcccgcaccgtgctccacgtgttgggtgatcggacctattgtaaagccccgggtcccactcacggaagtgtctacccgcagctgctaatccccctgctgggcgccggtctggtcctgggattgggggctctgggcctcgtgtggtggctgcatcggcgactgccgccgcaacctattcggcctttaccccggtttgccctctctcctccacactcaagtacatgcgagaatcgtgctccagaagcatcaaagggcggtcgggcacaggacagccgtgggcccggaccaggaacagaaccggcactgtgcggatccggaccatcttccccacaacaagctccacccgcagttcacagcggaccatgctag

SEQ ID NO: 25367 - DNA, 669 bp, Artificial Sequence
  Description of Artificial Sequence: Synthetic coding sequence
atggccgtgttccttcagctgttgcccttactattgagtcgggctcagggtaacccaggtgcctccctcgatggacgcccaggagaccgtgtgaacctgtcttgcggcggggtctctcatcctattcgttgggtttgggcaccttccttccccgcatgcaaagggctttccaaaggcaggcgcccgattctatgggcatcttcaagtggcactccaacagtgccccctctgcagcccttcgtcggcagactccgcagcctggactccggtattcggagactggagctcctgctgtcagctggagattccggcacgtttttttgcaaagggcgacatgaagacgaaagccgaactgtgttgcatgttctgggcgatcgtacctactgtaaagcgccaggacccacccatggcagcgtttatccacaactcctcattccgcttctgggggcagggctagtgctgggccttggagcgctcggcctcgtgtggtggctgcatcggcgtcttcccccccagcccatccggcccctgccacgatttgctttgtcccctccccatagctccacgtgcgaaaacagggcccctgaagctagcaagggtggccgcgcacaagatagtagaggcccagggcctggcaccgggaaaggcatggggatgggcagagggtag

SEQ ID NO: 25368 - DNA, 594 bp, Artificial Sequence
  Description of Artificial Sequence: Synthetic coding sequence
atggcagttttcctgcagttactgcctttactgctgtcccgggctcagggcaacccaggagcctccctggatggccgcccgggtgacagggtgaatttgtcatgtggaggagtttcccaccctattaggtgggtttgggcaccatccttcccagcttgtaaaggcttaagcaaggggcggagacccattttatgggccagctcatctgggacacccaccgtgccacctctgcagccttttgtcgggagactgcggtctctagactccggaataagacgattagagttgctcctgtccgcgggagactctggtacgtttttctgcaaaggccggcacgaggatgagagcagaactgtcctgcacgtcctgggcgatcgcacatattgcaaggccccagggcctacacatgctcctcttgtgaagacggaaccacagcgcccggtgaaggaggaagagcccaaaatcccaggggatctggaccaggaaccttctttactttacgccgatctagaccacctagccctgtcaagaccccgtaggcttagtacggccgatccagccgatgcctctacaatctatgccgtggtggtttag

SEQ ID NO: 25369 - DNA, 594 bp, Artificial Sequence
  Description of Artificial Sequence: Synthetic coding sequence
atggcagtatttctccagctgctgcccttgctgctgagccgcgctcagggcaatcctggtgcaagcctggatgggcggccgggcgatagggttaatctaagttgtggaggagtttcccaccccattcgctgggtgtgggcacctagcttcccagcctgcaagggcctgtctaaggggcgccgccctattctctgggcatcctccagtggcaccccgactgtcccacccctgcagccttttgtgggaaggctgcgatcactggactccggaatccgccgtctggaactcttgctatccgcaggagacagtggaacattcttttgtaagggccggcacgaagatgagagccggacagtactgcatgtcttaggagaccggacgtattgtaaggcaccggggccaacacatgctccattggttaagactgagccgcagcggccagtaaaggaggaagagcccaagattccaggcgacctggatcaggaaccaagcttgctttatgcagatctcgatcacctcgccctgtcacgccctaggcgcctgagtacggcggacccagctgatgcatccacaatctacgccgtggtcgtgtag

SEQ ID NO: 25370 - DNA, 654 bp, Artificial Sequence
  Description of Artificial Sequence: Synthetic coding sequence
atggctgttttcctgcaactgctccctctccttctgtcaagagcacaggggaatcctggggccagcctggatggccgccccggcgaccgtgtcaatttatcttgtggaggcgtctcccaccccatccgttgggtatgggcgccatctttcccagcttgtaagggcctgtcaaagggacggcggccaattctatgggcatccagtagtggcactcctactgtcccaccactccagccctttgtggggcggttgcgctctctagactcagggatacgacggctggaactgctgttgtccgctggcgatagtggtactttcttctgcaagggaaggcatgaggacgagagcaggactgtcctgcacgtcctgggtgatcgaacttattgcaaggcaccaggccctacccacggggcatgcccacggaataggttcgaccattccttagatttgttatgcccaccccatattgcacccctggttaagaccgaacctcagagaccggttaaggaagaagaacctaagatccccggcgacctagaccaggaaccaagtctgctttacgccgacctggatcacctcgctcttagtcgtcctcgtcgcctctcaactgccgacccagcggacgcctctactatatacgccgtggttgtgtag

SEQ ID NO: 25371 - DNA, 714 bp, Artificial Sequence
  Description of Artificial Sequence: Synthetic coding sequence
atggccgtgttcctgcagttgctgccgttactcctctcccgcgcccaaggcaacccaggcgcgtcactggatggcaggcccggcgatcgcgtgaatctgtcatgtgggggagtgtcccatcccatccgatgggtatgggccccttccttccctgcctgtaagggactgtccaaaggtaggaggccaattctctgggcttcaagctcaggcacccccactgtgcctccactgcagccatttgtggggcgactgaggtcactcgattcagggattaggcggcttgaattgctgttgagtgcaggcgattcagggacattcttctgcaaaggccgccatgaagacgaaagccgcacagtcttgcatgtcctaggggaccgcacctactgcaaagcacccggccccacccatggcagcgtctaccctcaactcttgatcccactccttggtgcgggcctcgtgcttggcttgggagcgcttggattggtctggtggctgcaccgccgactgcccccgcagcccattcgccctctgcctcggtttgcactctctcctccacattcttccacatgcgagaacagggctcccgaggcctctaaaggaggtcgcgcccaagactcacgcggtccaggcccgggcacggagcccgccttgtgtggttcagggccaagcagccctcagcaggcaccccctgctgtccacagtggaccctgttag

SEQ ID NO: 25372 - DNA, 582 bp, Artificial Sequence
  Description of Artificial Sequence: Synthetic coding sequence
atggccgtgttccttcagctgctgccactcttactaagcagagcccaggggaaccctggcgcaagcctcgacgggcggccaggcgatcgcgtgaacttgagctgtggcggggtctcccaccccattcggtgggtttgggcacccagttttcctgcctgtaaggggctctccaaagggcggaggcccatcctgtgggcaagctctagcgggactccaacggttccccctctccagccctttgtcggacggctgcggtctctggactctggcattcgtagattggaactgcttctgtccgcaggggactctggtacattcttctgtaagggccggcatgaagacgaatcaaggacagtcctgcacgtgctgggtgatagaacttattgcaaagctccagggccaactcatgccctatcacctccgcacagttctacgtgcgagaatagagcacctgaagctagcaaaggggggcgtgctcaagactctcgcggtcccgggcccggtacagagccagccctttgtggctccgggccaagtagccctcagcaggcaccccctgcagtccattctggcccatgttag

SEQ ID NO: 25373 - DNA, 726 bp, Artificial Sequence
  Description of Artificial Sequence: Synthetic coding sequence
atggccgtgttcctccagctattgcctcttctcctatctagagcgcaaggcaatcccggcgcaagcctcgatggcagacctggcgatcgtgtgaacctgtcgtgtgggggggtgtcacatcccatccgctgggtatgggccccttcgtttcccgcttgcaaaggcctgtccaaagggcgtagaccgatcctgtgggcctcttctagcggcacccccaccgtgccgcccctacagccgttcgttgggaggctgcggagtttggattcagggatcaggagactggagctgttgctgtccgcaggggatagtgggacattcttttgtaagggcaggcatgaagatgaatcccggactgtcctgcatgtgctaggggatagaacttattgcaaagctcccgggccaacccatggctccgtgtacccccagctgttaattcccctcttgggggcagggttggtgttaggtctaggggcccttggcctagtgtggtggcttcacaggcgactcccacctcaacccatacggcctttgccacgctttgcccctctcgtgaaaacggagcctcagaggcccgtgaaggaagaagaacctaagatccccggcgatctagatcaagagcctagcctcctttatgccgatctggaccatctggccctgtcccgccccagacgcctgtctaccgcagatccagcagatgccagtactatctatgccgtcgtcgtgtag

SEQ ID NO: 25374 - DNA, 726 bp, Artificial Sequence
  Description of Artificial Sequence: Synthetic coding sequence
atggccgtgtttctgcagctgttgcccttactgttgtcaagggcccaaggcaaccctggtgcgtccctggacgggcggcccggcgacagagttaacctctcatgtggtggcgtcagtcatcctattcgctgggtgtgggccccctcttttcccgcctgcaagggtctatctaaaggcaggaggccaatactgtgggcatcgagctcaggcacacccaccgttccccccctgcagccatttgttggacggctgagatcactcgattctggaatccggaggctcgagcttcttttatctgccggagatagcggaacttttttctgtaaaggcaggcatgaagatgaaagccgcaccgtgctccacgtcctgggtgacaggacctattgcaaggcccccggcccaacacacggctccgtgtaccctcagctgctcataccactactaggcgccggactcgtgctcggtctgggtgcacttggcctcgtgtggtggctacatcggaggcttcctcctcagccaattcgcccattacctcggtttgcgcccctggtaaagactgagccccagcggccggtaaaggaggaagaaccgaagatcccgggggatctggaccaggaaccatccctcttgtatgccgacttggaccatctggccctgtcacggcctaggcgcctcagtacagcagaccccgccgacgcctctaccatctacgccgtcgtggtttag

SEQ ID NO: 25375 - DNA, 594 bp, Artificial Sequence
  Description of Artificial Sequence: Synthetic coding sequence
atggctgtttttctgcagctcttgccgttgttgttgtcgagggcccaaggaaacccaggcgcctctctggatggtagacctggtgaccgcgtgaacttgtcttgtggcggtgtatcacacccaataaggtgggtgtgggcaccctcttttcccgcctgtaagggtctcagcaagggccgccgccctatcttgtgggccagtagcagtggaacccccactgtgccaccgctccagccctttgtcgggagacttagaagcctggacagtggcataaggcggcttgaactactgttaagcgccggggatagtgggacctttttctgtaagggtcgtcacgaagatgagtctcgaactgtcctgcatgtgcttggggaccgaacatactgtaaggcacctggacctacacacgcacctttggttaaaaccgaaccacaaagacctgttaaagaagaggagccaaagatcccaggggacctggaccaggagcctagcctgctgtatgcggacttggaccatctggccctgtctcggccccgcagactgtctaccgcagaccctgctgatgcctctaccatttatgccgttgtggtctag

SEQ ID NO: 25376 - DNA, 582 bp, Artificial Sequence
  Description of Artificial Sequence: Synthetic coding sequence
atggcagtgtttcttcagctcctgcccttattgctatccagagcccaggggaaccctggggcatccctggatggccgacccggcgatagggtcaacctgtcatgtggaggggtatctcaccccattagatgggtttgggccccttcattcccggcgtgtaaaggcctttcgaaaggtcggcgccccatcctgtgggcatcttcctctgggaccccaacagtgccccctctgcagccgttcgttgggcggctaaggagcctcgacagcgggatccggcgtcttgagctcctgttgagtgccggagattccgggacgttcttctgcaagggccgtcatgaggacgagtccagaaccgtactgcacgttctgggggataggacctactgcaaagcacccggacctacacacgcactgtcacctccacattcctctacgtgtgagaatcgcgccccggaggccagcaagggcggtagagcacaggatagcaggggtcccggccccggcaccgaacccgcgctctgtggctccggcccttcctcaccccagcaggccccccccgctgtacacagtgggccgtgctag

SEQ ID NO: 25377 - DNA, 654 bp, Artificial Sequence
  Description of Artificial Sequence: Synthetic coding sequence
atggccgtctttctccagctgctacccctccttcttagtagggcccaaggtaacccaggcgcatccctggacggtaggcccggcgatcgtgtgaatctctcttgcggcggggtctcccatccaattcggtgggtgtgggccccatctttccccgcctgcaaaggtctcagtaaggggaggaggccaatcctctgggccagcagttccggcactcccacggttccgccactgcagccgttcgtggggaggctgcgcagcctcgatagcggaataagaagactagagcttttgctttccgcgggcgacagtggaaccttcttttgtaagggccgccatgaggatgagagccggaccgtgttacatgttctcggcgaccggacttactgcaaagccccgggcccaacacatggtgcgtgtccgaggaatcgatttgatcattcgttggatttactctgtcccccccatatcgccccgcttgtgaaaacagagccccagcggcctgtgaaagaagaagagcctaagattcccggtgacctagatcaggaacctagcttgttgtacgccgatctggatcatctagctctcagtcgtcctcgtcgcctgtctactgcagatcctgccgatgccagtaccatttatgccgtggttgtttag

SEQ ID NO: 25378 - DNA, 582 bp, Artificial Sequence
  Description of Artificial Sequence: Synthetic coding sequence
atggctgtctttttgcagctgctccctctgctgttgtcaagagcccagggcaaccccggcgcgtcattggacggccgccctggggatcgagtcaatctgtcttgcggtggagtgagtcatcctatccgctgggtgtgggcccctagttttccggcttgcaagggactgtctaagggcaggcgaccaattctttgggcatccagttcaggcacccctacagtgccacctcttcaaccctttgtaggtagactccggagcttggacagcgggatacgcagattagagctgctgctgtcagctggagattcaggtacgtttttctgtaaggggcgccatgaggacgaatccaggacggtcctgcatgtgctcggagacagaacctattgcaaggcaccaggacccacacacgctctatcccccccacactcttccacatgtgaaaatagggcaccggaggcctctaaaggcggtcgggcccaggattcacgtggcccaggcccggggacagaacccgccctttgcggcagtgggcccagctcaccccaacaagcacctcctgcagtgcatagcggcccctgttag

SEQ ID NO: 25379 - DNA, 714 bp, Artificial Sequence
  Description of Artificial Sequence: Synthetic coding sequence
atggcagtgtttctgcagcttttaccactgctgctgtcacgtgcccaagggaaccccggggcttcactggacggccgacctggcgacagagtaaacttatcctgtgggggagtctcccacccaattcgatgggtttgggccccttccttccctgcatgcaaagggctgtcaaagggtcgcagaccaatcttatgggccagttcttccggtaccccaactgtaccccctctgcagcccttcgtcggacgcctccggtctctagatagcggcattcgaagacttgagcttctgcttagcgcgggtgacagtggcaccttcttttgtaaagggagacacgaggacgaatcccggaccgtgctacacgtgctgggtgaccgcacgtattgcaaggccccagggccaactcacgggtccgtgtaccctcagctcttgatcccactgctgggtgccggcttggttttgggtttgggggcccttggccttgtgtggtggctgcatagacggctacccccccagcctataagacctctacctcgctttgccctgtcacctcctcacagtagcacctgtgaaaacagggcacctgaggcatccaagggtggccgagctcaggactccaggggtcccggcccaggcaccgaaccggctctgtgcggtagcgggccttcttctcctcagcaggcgcctccagcagtccatagtggtccctgttag

SEQ ID NO: 25380 - DNA, 714 bp, Artificial Sequence
  Description of Artificial Sequence: Synthetic coding sequence
atggccgtattcctgcagctccttccccttctcctctctcgagcccagggcaacccaggcgcatccttagatggtagacccggcgaccgtgtgaatctgagttgtggtggtgtgagtcatccaatccgatgggtgtgggccccgtctttccctgcctgtaaggggttgagcaagggccggcgtcccattctttgggcgagttcctctggtacacctactgtcccgcctctgcagcccttcgtggggcgcctgaggtcactggacagcggaattcgccgcctcgagctgttgctgtccgccggcgacagcggcacatttttctgcaaagggaggcatgaggatgagagccgtacggttttacacgtcctaggagacagaacttattgtaaagcgccagggccaacgcatggaagtgtctacccccagcttttgattcccctgctgggggcaggcctggtactcggcctcggcgccctgggccttgtgtggtggctgcaccgccggctgcctcctcagcccatcagaccgcttcccaggtttgccctctctccacctcattccagcacttgtgagaacagggcgccagaggcctcgaaagggggtcgggcccaggactcccgaggcccagggcctggtaccgagcccgcactctgcgggtcaggcccgtccagcccacaacaggccccccccgccgtacacagcggaccgtgttag

SEQ ID NO: 25381 - DNA, 594 bp, Artificial Sequence
  Description of Artificial Sequence: Synthetic coding sequence
atggccgtttttctccagttattgccgcttctgttgtcccgtgctcaagggaaccctggcgccagcctcgatggcaggcctggggatagggtgaacctgtcctgcgggggcgtttcccaccccatacggtgggtgtgggctccctcctttccggcctgcaagggcctgagcaagggacgaagacccatcctctgggcctcctcgtccggaacgcccactgtgccccccctccagccctttgtggggcgcctgagaagcctggacagcggaatcagacggttggaattactgcttagtgctggcgactccggcactttcttctgcaaaggcaggcacgaggatgaatcacggacggttctgcatgttctcggagatagaacctattgcaaggccccagggcctactcatgcacccctagtgaagactgagccacagcgaccagtcaaagaggaagagccaaaaatccctggcgaccttgaccaggaaccatcccttctgtacgcagacctggatcacctggcactgagccggcctcgccggttgtcaactgccgacccggccgatgcctcaacgatttacgcagtcgtagtttag

SEQ ID NO: 25382 - DNA, 654 bp, Artificial Sequence
  Description of Artificial Sequence: Synthetic coding sequence
atggcagtctttttacagttattgcccctgctcttaagcagggcccagggcaatcccggcgcctcattggacgggcgtccaggcgaccgcgtgaaccttagctgcgggggagtttctcacccaattcgctgggtgtgggctcctagctttcctgcatgtaaaggactcagtaagggtaggcggcccatcctctgggcaagctcatcgggtacaccaacagtcccccccctgcagccatttgttggacgattgcgcagcctcgattccgggatccggagactcgaactcctcctgtcagccggggatagcggcaccttcttttgcaaaggccggcatgaagacgaaagtagaaccgtgctccacgtgctgggggatcgaacctactgtaaagcccccggacccactcacggcgcttgtccgcggaataggttcgatcactcgctggatctgttgtgccccccacatattgctcccctggtgaaaaccgagccgcagcggccagttaaggaggaggagcccaagatccccggggatctagatcaggagccaagtctgctgtacgctgatcttgatcacctggctctgagtagaccccggcgcctgtccacggccgacccggccgatgccagcacaatttacgcagtcgtggtgtag

SEQ ID NO: 25383 - DNA, 726 bp, Artificial Sequence
  Description of Artificial Sequence: Synthetic coding sequence
atggcagtcttcctccagctgctgcccttactgctgtcaagagctcaagggaacccaggtgctagccttgacggcaggcctggggaccgcgtgaacttaagttgtggaggcgtatctcatcccatcagatgggtctgggcccctagtttccctgcttgcaaggggctgtcaaaaggacggaggcctatcctttgggcgtcgtcctctggtaccccaaccgtgcctccactgcagccattcgtcggccgattgagaagcctggactccggaatcaggaggctcgagcttctgctctctgcaggggacagtggaactttcttctgtaaaggtagacatgaggacgagtcgcgtacagtactacatgtcctgggcgacaggacctattgcaaggcccccggaccgacccacgggtccgtgtacccgcagctcctgatccccttgcttggagccggattggtgcttggactgggggcgttagggcttgtgtggtggttgcatagacggttacctccccagccaattcggccactacctagatttgccccgttagtcaagaccgagcctcagagaccggtgaaggaggaggagcccaagatccctggcgatctggaccaagagccaagcctgctatacgctgacctggaccacttggctctgtcacgccctcgacggttgtcaaccgccgatcctgcagacgctagcaccatatacgccgtggttgtctag

SEQ ID NO: 25384 - DNA, 582 bp, Artificial Sequence
  Description of Artificial Sequence: Synthetic coding sequence
atggctgttttcttgcaactgctgccgctgctgttaagtcgcgcacagggtaatccaggggcttccctggatggacggccaggagaccgtgtcaatttgagctgcggcggcgtcagccatcctatccgatgggtatgggctcctagtttccctgcatgtaagggactgtcaaaaggccgccgacccattctctgggccagctcctccggtactcctaccgtaccacctcttcaaccctttgtgggccgactcagaagcctcgatagcggaatcaggaggctggagcttttgctgagcgctggcgacagtggaaccttcttctgtaaaggccggcacgaagacgagagtcgaaccgtgctgcacgttctgggagaccgaacctactgcaaggcacccggtcccacacatgccttaagccccccacactcctctacatgcgagaatagagccccagaagcttctaagggaggtagagctcaggattcccggggtcctgggcccgggacggagccagctctgtgtgggagtggtccctcctcccctcagcaggccccaccagctgtgcatagtgggccttgctag

SEQ ID NO: 25385 - DNA, 582 bp, Artificial Sequence
  Description of Artificial Sequence: Synthetic coding sequence
atggcagtgttcctccagctgctgcccctcctgctgagccgggcacagggaaaccctggcgcatctctggatgggagacccggcgatcgggttaatttgtcctgtggcggcgtgagccacccgatacggtgggtctgggctccgtcattcccagcctgtaaggggctgtcaaagggaaggcgccccattctttgggcatctagtagtgggacacccaccgtccccccactgcagccattcgtgggacgcctcaggtccctcgattcgggcattagacgcttggagctgctcttaagtgctggcgactcagggacattcttttgcaaaggtagacatgaagatgaaagcaggacagtactccacgtccttggtgacaggacatattgtaaggctccaggcccaacccacgccctgagcccgccgcatagctccacatgtgaaaaccgcgcccccgaggcatccaaaggtggaagagcccaggacagtcgcggcccggggcccggtaccgagcctgcactgtgcggaagcggaccctcctccccacagcaggcccctccggccgtccactcaggaccttgctag

SEQ ID NO: 25386 - DNA, 714 bp, Artificial Sequence
  Description of Artificial Sequence: Synthetic coding sequence
atggcagtattcctgcagctgctgccactccttctatcgcgggcacaaggcaatcccggagcttctctagacggtcgacctggggatagggtaaacctcagttgcggcggcgtgagccatccaatacggtgggtgtgggctccctcctttccagcttgtaaagggctatctaagggacgtcgcccaatcctctgggcatcatctagtgggacccctaccgtacctccacttcaaccatttgtgggtcggttgcggtctctcgattccggaatccgcagactggagttattgcttagtgcgggggactccggcacctttttctgcaaagggaggcacgaggacgagagccggaccgtcctgcacgtcttgggtgatcggacatattgtaaagcgccaggcccaactcacggcagtgtctatcctcagctgcttatcccactgcttggcgctggtttggtactgggcctgggcgccctgggcctcgtgtggtggctgcaccgaagactgcccccccaacctatcaggcccctgcctagatttgctctgtcacccccccatagcagcacttgcgaaaatagggcaccagaggcatctaaagggggccgggcacaggacagtcgtggaccaggtcctggtaccgagcccgccctttgcggatcggggcctagttcccctcagcaggctccaccagccgtacactccggaccatgctag

SEQ ID NO: 25387 - DNA, 654 bp, Artificial Sequence
  Description of Artificial Sequence: Synthetic coding sequence
atggccgtcttcctccagctgcttccactcctgctctctcgcgcacaggggaacccgggtgcttcactggacggccggccaggcgaccgtgtcaacttgagctgcggcggtgtcagtcatccaattcggtgggtttgggctccatcgtttcccgcctgtaaagggctgagcaaaggccggcgcccgatcctctgggcgtcttcttccggcactcctacagtgccacctctgcagccatttgtgggacgccttcggagccttgatagtgggatcaggaggctcgaactgttgctgagtgccggagatagcggtacattcttctgcaaaggaaggcatgaagatgagtctagaaccgtactgcatgttctgggcgatcgtacttactgcaaggccccaggaccaacacacggcgcctgccctcgcaataggtttgatcactccctcgatctactgtgtcctccgcacatcgcccctttagtgaagaccgagcctcaaaggccagtcaaggaggaagagccaaaaatcccaggcgatctggatcaggaaccatctctgttatacgccgatctcgatcacttggccctcagccgaccacgccggctgagcactgctgaccctgccgacgctagcactatttacgcggtggtcgtctag

SEQ ID NO: 25388 - DNA, 726 bp, Artificial Sequence
  Description of Artificial Sequence: Synthetic coding sequence
atggccgtctttctgcagctcctccctctgctgctgtctagagcacagggtaacccgggggcctcccttgatggaaggcccggggatcgcgtgaatctcagctgcgggggggtgtctcatccgatccgatgggtgtgggccccctctttcccagcctgtaaaggactctccaagggacgccgtccaatcctgtgggcctctagcagtgggactccaacagtccccccattgcagccattcgttggccggttgcgctctctcgattcaggaatcaggcggttggaactgttgctatctgccggcgatagcggaaccttcttttgtaaggggagacacgaggatgagtctcggacagtgctgcatgtactgggagacaggacttattgtaaagcgcccggtccgacacacgggagcgtatatccacagcttctcatccctctacttggtgccgggctggttctgggattaggcgccttaggacttgtatggtggcttcacaggagactccctccacagcccataaggccgctgcccaggtttgctccattagttaaaactgagcctcagcggcccgtgaaggaagaggagccaaagattcccggcgacctggaccaggaaccttccctcctttacgccgatctcgatcacctcgcgctcagcagaccccgtcgactttcaaccgccgaccctgcggatgcctcgacaatatatgccgtcgtcgtgtag

SEQ ID NO: 25389 - DNA, 594 bp, Artificial Sequence
  Description of Artificial Sequence: Synthetic coding sequence
atggccgtctttctacagctgttgcccttgttactctccagagctcagggaaaccctggggcttcccttgatgggaggccaggggaccgcgtgaacctctcatgtggtggagtctcacaccctattagatgggtctgggcaccgagctttccggcctgcaagggattatcaaagggtcgtagacctattctgtgggcctctagcagcggcactcccacagtccccccccttcagccgttcgtgggtaggctcaggtccctcgactctgggatcagaaggctcgagctgttgctaagcgccggagacagcggaacattcttctgtaaagggcggcacgaggacgaatcgaggacagttttgcatgtcttgggagatcgtacatactgtaaggcccccggacctacacatgctcccctcgtcaaaacagagccacagcggcctgtgaaagaagaggaacccaaaattcccggagacttagatcaggagccctccctgctttacgcagatctggatcatttggctctgagccgcccgcggaggctgtctacggcagacccggccgatgcctccaccatatatgcggtcgtggtgtag

SEQ ID NO: 25390 - DNA, 714 bp, Artificial Sequence
  Description of Artificial Sequence: Synthetic coding sequence
atggcggtattccttcagctattgcctctcctgctgtcacgagcccaaggtaaccccggcgcaagcctggacgggaggcccggagatagggtgaacctgtcttgcggcggagtgagccatccaatccgctgggtgtgggctccttcttttcccgcatgcaagggactcagcaagggccgccgcccgatcttatgggctagtagctctggtacccctacggtgccacccttgcaacccttcgtcggccgtttgcgtagcctggacagcggaatcaggcgattagaactgttactatctgccggagatagcggaacctttttttgcaaaggccggcacgaggatgagtcccgaacagtgctgcacgttcttggcgataggacatattgtaaggctcctggaccgacccacggtagtgtctaccctcagttgctgatcccattactaggggccgggttggtcctggggcttggggcactgggcttagtatggtggctgcatcgaaggctcccgccccaaccaattcgtccactccctaggttcgccttgagccccccacacagtagcacctgtgagaacagagctccggaagctagcaagggaggccgcgctcaggactcacgaggacccggtccagggaccgaacccgccctgtgtggttccggaccatccagcccacaacaagcaccccccgcagtgcatagcggtccatgctag

SEQ ID NO: 25391 - DNA, 594 bp, Artificial Sequence
  Description of Artificial Sequence: Synthetic coding sequence
atggcggtctttctgcagctgctgcccttgttgctctcccgcgcacaggggaatcccggcgcatcactggacggtcggcctggtgatagagttaaccttagctgtggtggggtatcacatcctattcgctgggtctgggcccccagtttccccgcctgcaaagggttgagtaaaggccggaggcctatcctgtgggcctcctcctctggaacacccacagtgccccctttgcagccattcgtgggcagactgcgcagcttggattctggaatcagacggctggagctgttgctgtctgcgggggactcgggcaccttcttttgtaaagggaggcacgaagatgaatctcgaaccgtgctccatgtgctgggcgaccggacctattgcaaagcccccggcccaacccacgctccacttgtcaagaccgaaccccagagacccgtgaaggaagaggagcccaagataccgggtgacctggatcaggagccctccctgttgtacgccgatctcgaccacctggctttaagccggccacggcgcctttcaacagcagatcctgccgatgcctcaactatttatgccgtggtggtttag

SEQ ID NO: 25392 - DNA, 654 bp, Artificial Sequence
  Description of Artificial Sequence: Synthetic coding sequence
atggctgtcttcctgcaacttctgccgctgctgctctcccgtgctcaggggaacccgggcgcttctctggatgggcgacctggagacagagttaacttgagctgcggcggagttagccacccaattcgctgggtatgggcacctagcttccctgcctgtaaggggctgtctaaaggccggagacccattctctgggccagctcgtccgggacacccactgtgccacctctgcagcctttcgtcggcagactgagatccctggactccggaattcgacgactagaactcctgttaagcgcaggagattcaggcacgttcttctgtaaaggacgccacgaggatgaatcacggaccgtcctgcacgtactgggtgataggacctactgtaaggcacctgggccaacacacggggcgtgccccagaaaccgatttgatcacagcctggatctgctgtgtccaccccatatcgcaccactagtcaagaccgaaccacagcgcccggtaaaagaggaagagcctaagattcccggggatctcgaccaggagccgagcctactgtacgctgacttggatcacctggcccttagcaggccacgtcgcctatctactgccgacccagccgacgctagcaccatatacgctgtcgtggtgtag

SEQ ID NO: 25393 - DNA, 726 bp, Artificial Sequence
  Description of Artificial Sequence: Synthetic coding sequence
atggctgtgtttctgcagttgctgcccttgcttctgtccagggctcagggtaaccctggcgcctccctcgatggccggcctggcgaccgggttaaccttagttgcgggggcgtctcgcacccaatccgctgggtctgggccccttcctttcctgcgtgtaagggccttagcaaggggaggagacctatactgtgggcctctagctctggcacgcctacggtccctcctcttcagccatttgtgggaagactccgctctctggattctggaattcgaagattggaactgctcctgagcgcaggggactccggaaccttcttctgcaagggcagacatgaggatgaatctcgaacagtattgcatgttctaggtgaccgcacctactgtaaagctccggggccgacccacgggagtgtgtatcctcagctgctgatcccccttctcggcgccggcctggtcttaggccttggcgccttgggactggtttggtggctgcacaggcgtctgcctccccagccgattaggcctcttcccagatttgcgcccctggtcaagacagagccccaacgcccagtgaaggaggaggagcccaagatccccggggatcttgaccaagaaccaagtttactctatgcggatctggaccacctcgccctgtctcgaccaaggcggcttagcaccgccgatcccgccgatgcatctacaatttacgccgtggtggtgtag

SEQ ID NO: 25394 - DNA, 981 bp, Artificial Sequence
  Description of Artificial Sequence: Synthetic coding sequence
atggaatttctctgggatttcttgaatcaccaggaggggccaagaattagagaccacttgagccatggcgaaatcaatctgcatgagttctcaaaagagactacaaaccaactgcttgcttttagccttgtgctccttcttaggtttgtcgacgactgcctgctttctgtcttcaaggagaaaagcgccgtagaactcctgattagcttggctgaaggatactcttcgcgctgtcatcctgtattccagctaaaaaagcaagtgttgagttgtgaagagagtatccgggtgtgggctcttctgccatttccggaagaattgactcgacaagccgtacgcttagaggataatagcgaaaccaatgcctgccactcgctgatcacgaagatgactgacgaactgtatcaccacatgccagagaatcgctgcgtgttaaaggacctggatagactccccaccgaaacctggccacaactactacgggagctttgcagcacacctgttccaaccctgttttgcccccgtatcgtactggaagtgctcgtggttctgcgcagcattagcgaacagtgtagaagagtcagcagccaagtgactgtagcctctgaacttagacaccgacagtgggttgaacgaacgcttcggagtcgtcagaggcagaactacctgcggatgtggagctctatacggctgctgagcccagttttgtcgctgatcttgctgttaatcgctctagaactcgtgaacattcacgccgtgtgcgggaagaacgcccacgagtatcagcaatatctgaagtttgttaaatccattctacaatatacagaaaacctcgtagcttacacatcttatgagaagaataagtggaacgagaccatcaacctgactcatacagccctactcaagatgtggacttttagcgagaagaagcagatgcttattcatttagcaaaaaagtctacaagtaaggtgctgctttag

SEQ ID NO: 25395 - DNA, 1896 bp, Artificial Sequence
  Description of Artificial Sequence: Synthetic coding sequence
atggaggtcttgatcggggatcccatcactacttgcctttcgccatctgtttacgacatcatctgcaaccttggcttccaactgagggaaaactgcgacatcaattcaatcgtcacacagaatggtgaggtgtgctggaaaacgatcactgattgtgtgagttacacagaaagcgagcaaggccttgactactggggctctgtgcggctgctcgggcccgtttgtgaagcggtccattcccattttctgagtctgactaagggccagttcgagatcagatacgctccctggttccagtggacgtcatttcccgaattattcccagagatattcgatgctctggaatctctccagagccctgccatctcactgtccctgatgaaactaacctcttgcctggagcgagctctgggagatgttttcctgctcatcggaaaagaatgtccctttctgttaagagaccttctcagttctgaggagttggcccaggtgttcagtcaatcagtgatgaatgtacttaaagtgtttgtgggatccccgtgcggccttaacctccgcaacgtgctgtggcacggcttcgcgtcaccggaagaaatacccccgaaatattgcagcatgatgatactgctgaccgcaggtcttggccagttgttgaagtcgtatctgcaaaacaccaagctgacactggctcaccggagtttcatatccctgaccaacctcgaggatctaatcgttttccccgatgttacctacgaggttctgtccgtgctggaagaggtgatgatgaaaagtgcctttatcctgaagatcatgctcccgtattgggaggtcgctttagttaagttcaaatcgcatcgttttgctgactgtgccattcttttgcttactcaacttgagacaggactccggaatgtatttgccacactgaatcgctgtccaaagcggctgcttacggcggagagcactgccttgtataccacatttgatcagatcctggcaaaacatctgaatgatgggaaaattaaccaacttcccctcttcttaggggaaccggctatggagtttctctgggactttcttaaccaccaagagggccccagaatccgggatcacctcagtcatggagagatcaacctgcacgaattttcgaaggagactactaaccagcttctagccttcagcctggtattgttgcttcgttttgtcgacgattgcctgctgagcgttttcaaggaaaagtcagccgttgagctcttgatctctctcgcggaaggttatagttcacgctgccaccccgtgtttcagctcaagaaacaggttctgtcgtgtgaagagtccattagagtgtgggctctcttgccctttcccgaggaattgacccgtcaggctgtcaggcttgaagataacagtgagacaaacgcttgccattccctcattactaagatgacagacgagctctaccatcacatgccagaaaacaggtgcgtcctgaaagatctcgatagactgccaaccgagacgcctacttcagacactcctttggccctcgccccacgtaagccacaaccctgcaggtgtcgcaggcgggtcagaccgtcaatccggctcctttccccagtcctctctttaattctcttgttgatagctctggaactcgttaatatacatgcagtgtgtgggaaaaacgctcacgaatatcagcaatacttaaagttcgtgaagtctattctgcaatacactgagaacctggtcgcatacacttcatacgagaaaaacaaatggaacgaaactattaacctcacccacactgccctgttaaagatgtggacattctcagagaagaaacagatgctaattcatctggctaaaaaatcaacatcaaaagtcttgttgtag

SEQ ID NO: 25396 - DNA, 2037 bp, Artificial Sequence
  Description of Artificial Sequence: Synthetic coding sequence
atggaagtgctcatcggggaccctatcacaacctgcctgtccccatctgtgtacgacatcatttgcaatctcggttttcaacttcgggagaattgcgatattaattcaatcgtgacacagaacggtgaggtttgctggaagactattactgactgcgtgtcctacaccgagtctgaacagggactcgattactgggggtccgtaagactgttaggccccgtgtgcgaggctgtccatagtcatttcctgtctctgaccaaaggtcagtttgagattcgctatgcaccgtggttccagtggacttcgttccccgaactctttcccgagatcttcgacgctcttgagtccttgcagtcccctgccatttccctctctctcatgaagctgacttcctgtttggagcgcgcactcggcgatgttttcttgctgatagggaaagagtgtccgttcttactgcgtgacctgctgagcagcgaggagctcgcccaggtgttctcccagtccgtgatgaatgttctgaaagtcttcgtaggcagcccctgtggactcaatctccgaaacgttctctggcatgggttcgcatctccagaggagattccgccaaaatactgctctatgatgatcttgttgacagctgggcttgggcaactcctgaaatcctacttgcagaataccaaacttaccctggcccaccgcagcttcatctctctcaccaacttggaagacctgatcgtgtttcccgacgtcacttacgaggtcttgagcgtgttggaagaggttatgatgaagtccgcattcattctgaagatcatgcttccatattgggaagtggccctggttaagtttaagtcacatcgctttgcagattgcgcgatcctgttgctgacacagcttgaaaccgggctaagaaacgtctttgccacactgaatcggtgccccaagaggttgctcaccgctgaatcaactgccctttatacaaccttcgatcagattctggctaaacatttgaatgacgggaaaattaatcaactgcccctgttcttaggagagcctgcgatggaatttctgtgggatttcctcaatcaccaggaggggccgcgaatccgcgatcacttaagtcacggggagatcaacctacacgaattctccaaggagacaactaatcaattgctagccttctcacttgttctgctgctacgttttgtggatgattgtctcctgtcagtgttcaaggagaagtcagccgtcgaactgttaattagcctcgcagaaggatatagttccagatgtcatcctgttttccagctgaaaaaacaagtgctatcttgtgaagaatcaatcagagtttgggcattgttgccttttcctgaagagctcactcgacaagccgtgcgcttagaagacaattctgaaaccaatgcgtgccacagtctcattaccaagatgacagacgaactctaccaccacatgccagaaaatagatgtgtgctgaaagatctggaccgcttacccactgagacgtggccccaattgctgcgagagttatgttcaacacccgtgcccaccctgttttgcccgcgtatcgtgctcgaagtgttagtggtgcttcgcagcatctcagaacagtgtcggagagtctcgtcccaggtgaccgttgcttctgaactcaggcaccgccagtgggtggaacggaccctaaggagccggcaacgccagaattacctcaggatgtggtcctcaatcaggctcttatcacccgtcctgtctctgatcctattactgatcgcattggagctcgtgaacatccatgcagtttgcggaaaaaatgcacatgaatatcaacagtatctcaaattcgtcaagtcaatcctccagtataccgagaacctggtggcctatacttcctacgagaagaacaagtggaatgagacaatcaatttaacccacaccgctctcttgaagatgtggacattcagcgagaagaaacagatgctcattcacctcgccaaaaagtcaaccagcaaggttctgctctag

SEQ ID NO: 25397 - DNA, 1659 bp, Artificial Sequence
  Description of Artificial Sequence: Synthetic coding sequence
atgaagctgaccagttgcctcgaacgagccctgggggatgtattcctcttgataggcaaggaatgtcctttcctcctgagagacctgctgtcatcggaggagctggcccaggtcttttcacagagcgtgatgaacgtgctgaaggttttcgtgggatctccctgtggacttaacctaaggaatgtcttgtggcacggctttgctagccctgaggagataccgccaaagtactgcagcatgatgatcttgttaaccgcgggactggggcaacttctgaagtcgtacctgcagaacactaaattgacactcgcccaccgatcatttataagtctgactaaccttgaagatctaatcgtcttccccgacgtcacctacgaggtcctctccgtgttagaggaggtgatgatgaaatccgcctttattttaaaaatcatgctgccttattgggaagtggccctggtcaaatttaagtctcatagattcgcagactgcgctattttgttgttgactcaactggagactggactacggaacgtctttgcaaccttaaaccggtgcccaaagaggcttctgaccgcggaaagcactgccctgtacaccacatttgaccagattctggctaaacacctaaatgacggaaaaattaaccagctgccattgttcctgggtgaaccagctatggagtttttatgggactttttgaaccatcaagaaggcccccgcatcagagaccatctcagtcatggcgaaataaacctccacgaattctcaaaagagacaacaaatcagctcttggcattcagccttgtcctcttgctgcggtttgtggatgattgtctccttagcgtgttcaaggaaaagtctgccgtggaactgctcatcagccttgctgagggttatagctccagatgccaccccgtgtttcagctaaaaaagcaagttctaagttgtgaggagtcgataagagtctgggctctcctcccatttcccgaggagctgacaaggcaggctgtccgcctcgaggacaatagcgaaactaacgcatgccattcactgattactaagatgactgatgagctgtaccatcacatgccagagaatcgctgcgttctgaaagaccttgaccgcctccccacagagacctggccccaattactccgtgaactatgttctaccccagtccccacattgttctgcccacgaatcgtgctggaagtgctggtggttctacgttctataagtgaacagtgccggcgtgtgtcctctcaagttacggtcgcttcagaacttaggcatcggcagtgggtggaaaggacactgagatccaggcagcgacagaattacctaaggatgtggtcctctattcgcttgctctctcctgtgctgagtctgatccttctgcttatcgccctcgaactcgttaacatccatgctgtgtgtggtaagaacgcacacgagtaccagcagtacttgaagttcgtcaagtctattctccagtacaccgagaacctcgtagcatacacctcctacgagaagaacaagtggaacgagaccatcaacctgacacatactgcattgctcaagatgtggaccttctccgagaagaagcaaatgctcatccatctcgctaagaagagcactagcaaggtactcttatag

SEQ ID NO: 25398 - DNA, 1818 bp, Artificial Sequence
  Description of Artificial Sequence: Synthetic coding sequence
atggaagtgctcataggcgacccaattacgacctgtctgtcacccagcgtgtacgatatcatatgtaatttgggctttcagctccgggaaaattgcgacattaatagcattgtcactcaaaatggggaagtgtgttggaagacgattacggactgtgtgtcctacaccgaatctgaacagggactggattactggggctccgtccgtttgctcggacccgtctgcgaggccgtgcatagtcacttcctcagtctcaccaaaggccagttcgaaatccggtacgcaccatggttccaatggacaagtttccccgaactcttccccgagatttttgacgcattagagagccttcagtcccctgcaatctcgttatccctgatgaagctgactagctgcctcgaacgcgcgcttggagacgtcttcttgctgatcgggaaagagtgccctttcctcctcagggacctgttaagttcggaggagttggcccaggtgttcagtcagtcagtcatgaacgtactgaaagtctttgtcggcagcccttgcggactgaacctccgcaacgttctgtggcacgggttcgcaagccccgaggaaatccccccgaagtactgcagcatgatgatcctactgactgcaggcctcggtcagctgctcaaaagctacctccaaaatacaaaactgactttggcccacaggtcatttatcagcctgactaacctggaagacctgatagtatttccggacgtcacgtacgaggttttgtccgtgttagaagaggtgatgatgaaaagcgcctttatactcaagatcatgctcccatattgggaggttgctctggttaagttcaaatcccataggttcgccgattgcgccattcttcttctgacccaactggagacgggattacggaacgtatttgcaacactgaaccgctgtcccaagaggctcctcactgctgagagcaccgccctctacaccacgtttgaccagatcctagccaagcatcttaacgacggcaaaataaaccagttgccgttgttcctgggcgagcccgctatggagttcttgtgggactttcttaatcaccaggaaggcccccgtattagggatcacctatcacatggagagataaatctgcacgagtttagtaaggaaaccactaaccagttgttagcattttccttggtcctactgttgagattcgtagatgactgcctgctgagcgtcttcaaggaaaaatctgcggtcgagttacttatctcccttgctgagggttattcaagtcgatgccatcccgttttccagctaaaaaagcaggtgctgtcctgcgaggagtctatcagggtgtgggccctactaccattccctgaggaactgacccggcaggctgtgcggttggaggataactctgagacgaacgcttgccactctctcattaccaaaatgacagacgaactgtatcatcacatgccagagaatcgatgtgttttgaaggatctggatcgcctcccgacagagacgatccggttattgtctccggtgttgtctctgattctcttgctcatcgctctggaactggtgaacatccacgcagtctgcgggaagaacgcacacgaatatcagcaatatctgaagttcgtgaaatctatactgcagtatacagagaacctcgtggcatacacttcttatgagaagaacaaatggaacgagaccatcaacctgacccacaccgcactcttgaagatgtggacgttctcagaaaaaaaacaaatgctaatccatctcgccaagaaatctacatcaaaggtcctcctgtag

SEQ ID NO: 25399 - DNA, 993 bp, Artificial Sequence
  Description of Artificial Sequence: Synthetic coding sequence
atggaaggcgcacctccaggctcactggccctgcgcctgcttctgtttgtcgccctcccagccagtggatggctcaccacaggcgcaccagaacctcctcccctgtccggagccccacaagacggcattagaatcaacgtaacaacgctgaaggatgacggggacatcagtaaacaacaggtggtcctgaatatcacctatgagagtggacaggtgtatgttaacgatctgcctgtcaattccggtgttactcgaatcagttgtcagacgttgattgtcaaaaatgagaatctcgagaacctcgaggaaaaagagtactttgggatcgtctctgtgcgaatattagtgcacgaatggcccatgactagtggcagcagtctgcagctgatcgtaatccaggaagaggtggttgagattgatggcaagcaggtgcagcagaaggatgtgaccgagattgatatcttagtcaaaaacaggggcgtcctaaggcattcgaactacaccttacctctggaggagagtatgctctacagcattagccgagatagtgacattctgttcacacttcccaatttgagcaaaaaagagtcagttagtagcctgcagaccacatctcagtatctcattagaaacgttgaaacgactgtggacgaagatgtcctacctggtaaactgccagaaacaccattacgcgccgagccccctagctcttataaagtcatgtgccagtggatggagaaattcagaaaagatctgtgtcgcttctggagcaatgtgttccctgtgtttttccagttcctaaacattatggtggttggaatcactggcgccgctgtggtgattactattctgaaagtctttttccccgtctccgagtataagggcattctgcagctggacaaggtggatgtcatccccgtgaccgccatcaacctgtatcccgacggtccggagaaaagagcagagaatctagaggataaaacatgcatctag

SEQ ID NO: 25400 - DNA, 396 bp, Artificial Sequence
  Description of Artificial Sequence: Synthetic coding sequence
atgaccagcggtagttccctgcagttaatcgtgattcaagaggaggtggtggaaattgacggtaaacaagtgcagcagaaagatgttacagagattgatatcctcgtgaagaaccgaggcgtgcttcgtcacagcaactataccctgccgctggaagagagtatgttgtactctatctcgcgtgattcggatatcctgtttaccttgccaaatctcagtaagaaggagtcagtgtcttccctgcagactacctcccagtatcttatccgcaatgtggagaccactgttgacgaggatgtgctgcccggaaaactgcccgagacgccattgcgcgctgaaccaccatcatcctacaaagtgcttgagacagtagactccgcgcctttccgtctgtag

SEQ ID NO: 25401 - DNA, 378 bp, Artificial Sequence
  Description of Artificial Sequence: Synthetic coding sequence
ctccagttgattgtgatccaagaagaggtcgtggagatagatggcaagcaggttcaacagaaggacgttacggagatcgacatcctggtcaagaacagaggagtccttcgacattcaaattatactttgcccctggaagagtccatgttgtactccatctccagagattctgatatcctcttcacactgcccaacctgtctaagaaagagagcgttagcagcttgcagaccacctcccaatacctgattaggaatgtggagactactgtggacgaggacgttcttcccgggaaactgcctgaaacacccctgagagccgaacctcccagtagctacaaagtgctggaaacagtggatagcgctccgtttagattgtag

SEQ ID NO: 25402 - DNA, 1065 bp, Artificial Sequence
  Description of Artificial Sequence: Synthetic coding sequence
atggacttcatattagaagatatggatctggcggctaacgagatctccatttatgataagctgagcgaaacagttgatcttgtgaggcaaaccgggcatcaatgtggtatgtctgagaaggccattgagaaattcattaggcagctactggagaagaacgagccccaacggccaccaccacagtacccgttgttaatcgtggtctacaaggtgctcgccactctcgggttgatcttgctgactgcctactttgtgatccagcctttcagccccctcgcacccgagccagtgctgtctggggcacatacatggcggtccctcatccatcacatccgactcatgtccctgcctatcgctaagaagtatatgagcgagaacaagggcgtgcctctccacggcggtgacgaagaccgaccttttcctgactttgacccctggtggactaacgactgtgaacagaacgaaagcgaaccgatccccgccaactgcacaggatgcgcccagaagcatttaaaagttatgctactcgaggacgcacctagaaagttcgagagactccacccgcttgttatcaaaaccggtaaacccctcctggaagaggagatccagcacttcctgtgtcaatacccggaagccaccgaagggttctcggaaggtttcttcgccaaatggtggagatgctttcccgaacgctggtttccatttccttacccttggagacggccactcaaccgaagccagatgctccgcgaacttttcccagtgtttactcaccttcccttcccaaaggatgcctccttgaacaagtgctcttttcttcatcccgagccagtggtcgggtcaaaaatgcataaaatgccggacctgtttatcatcggatctggagaggccatgctgcaactcatcccaccttttcagtgtaggcgacattgtcagtccgtcgccatgccaattgagcccggagatatcggctacgtggacacgactcattggaaggtgtacgtgattgccagaggagttcagcccttggtcatctgtgatgggacagctttttctgagctctag

SEQ ID NO: 25403 - DNA, 726 bp, Artificial Sequence
  Description of Artificial Sequence: Synthetic coding sequence
atgtctttgccaattgccaaaaagtacatgagtgagaacaaaggtgtacccttgcacggtggagacgaagaccgacctttccctgacttcgacccgtggtggaccaacgactgtgagcagaacgagtctgaacctattcccgccaattgcacaggatgtgcacagaagcatctcaaagtcatgcttctggaggacgccccgcgcaagtttgagcgactgcaccccctggtaatcaaaaccggtaagccgctgcttgaggaagagatccagcactttctgtgtcagtatcccgaggccacagagggattctccgagggtttcttcgctaagtggtggcgatgcttccccgagcgctggttcccattcccatacccatggcgtaggcccctgaacagaagccaaatgctaagggagctgttccccgtctttactcacctgcctttcccaaaggatgcgagcctcaataagtgcagctttctacaccccgagcccgtcgtgggcagtaagatgcacaagatgccagacctgtttataatcggatcaggcgaggctatgctgcagctgatcccaccatttcagtgccgcaggcactgccagagcgtagccatgcccatcgagccaggcgatatcgggtatgtcgacactacccactggaaagtgtacgtcatcgcaaggggtgtgcagccactggtcatttgtgacggcactgccttctcagaactatag

SEQ ID NO: 25404 - DNA, 1044 bp, Artificial Sequence
  Description of Artificial Sequence: Synthetic coding sequence
atggacctggccgcgaatgaaattagcatttatgacaagttgagtgagaccgtggatctcgtgcgccagaccgggcaccaatgcggaatgagtgagaaggcaatcgagaagtttattaggcagcttctcgagaagaacgaaccacaaagaccacctcctcagtaccctctgctgattgtggtctacaaagtgttggcaacattggggctgattttgctaaccgcatattttgtaatccagcctttttcccctctggcaccagagcccgtgctgtcaggagcgcacacctggcggagcctgatccatcacattcggctgatgagcctacctatcgccaaaaagtacatgtctgagaacaaaggcgtgcctctgcacggcggtgacgaggatcgccccttcccagactttgatccttggtggacgaacgactgcgaacagaatgagtccgagccaatccccgccaactgtaccggctgcgcccaaaaacatttgaaggtcatgttattggaagatgctccgcgcaagtttgaaagactccatccactggtaatcaaaacaggcaaaccactgctggaagaggagattcaacacttcctgtgccagtatcctgaggcgacagaggggtttagcgagggctttttcgctaagtggtggaggtgttttccggagaggtggtttccattcccatatccctggcgacggcccctcaatagatcacagatgctccgagagcttttccctgtattcacccacttgccttttccgaaagacgccagccttaacaagtgctcatttctgcaccctgagccagtggtgggctccaagatgcacaagatgcccgatttgttcatcattggatcgggcgaagctatgcttcagttaattccccctttccaatgtagaaggcactgccaaagcgttgctatgcctatagagccaggagatattggatacgtggataccacccactggaaagtctatgtaattgccaggggggtgcaacctctggtaatatgcgatggcacagcattctcagaactctag

SEQ ID NO: 25405 - DNA, 708 bp, Artificial Sequence
  Description of Artificial Sequence: Synthetic coding sequence
atggactttatcctggaggatatggatctcgccgccaacgagatttctatctacgacaaactgagtgagaccgtcgacctcgtgagacagacaggccaccaatgtggtatgtcggaaaaggccatcgagaagtttatcagacagctgttggagaagaatgagccacaacgtcctcctcctcagtatcctttgctcattgtggtttataaagttttggcaactttaggcctcattctgttaaccgcatactttgtgattcagcctttcagccccctcgccccagagcctgttctctctggagcccatacatggcgatccctgattcaccacatcaggttgatgtccctgccaattgccaagaaatacatgagtgaaaacaaaggggtccctttacacggcggggacgaggaccggccatttcccgactttgatccctggtggactaatgactgcgaacaaaatgaaagtgagccaatccctgcaaactgtaccggttgtgcacaaaagcatctgaaagttatgttactggaagacgccccccggaaattcgagcgattgcaccccctcgttattaaagagatcgaactgtgtactggcacggcttcccgggctgagaaccaggtggagcgcggcaagatcaagaccaagaccatgaaactgttgtcaggtggctggcttctctcctatcttcctttcgcttgtatgtag

SEQ ID NO: 25406 - DNA, 726 bp, Artificial Sequence
  Description of Artificial Sequence: Synthetic coding sequence
atgtcactgccaatcgccaaaaaatatatgtccgaaaacaagggtgtgcctttgcatggtggcgacgaagaccgaccattccccgactttgacccctggtggacaaatgattgcgagcagaatgagtctgagcccatcccagcaaactgtaccggatgcgcccagaagcacctcaaggtgatgctgttagaggatgcgcctcgaaagtttgaacgcctgcatcccttggtgatcaaaacaggtaagccactgctggaagaagaaatacagcattttttgtgtcagtatccagaagcgactgaagggttcagtgagggatttttcgctaagtggtggaggtgcttccccgaaaggtggtttccttttccctatccttggcgccgcccgttaaaccggagccagatgctcagggagctgttccctgtgtttactcacctgccctttccaaaggacgcctctctcaacaagtgtagtttcctgcaccccgagcctgtggtagggtccaagatgcataagatgcctgatctattcatcatcggaagcggtgaagccatgctgcagttgatcccccccttccagtgcagacggcactgccagtccgtggcaatgccgatcgaacctggtgatattggatacgttgataccactcattggaaagtttacgtgatcgctaggggggtgcagccactggtgatatgcgatggcaccgctttttctgaactgtag

SEQ ID NO: 25407 - DNA, 705 bp, Artificial Sequence
  Description of Artificial Sequence: Synthetic coding sequence
gactttatcctggaagatatggacttggccgccaatgagatatcaatttacgataagctcagtgagactgtcgacctcgtcaggcagaccggccatcaatgtgggatgtctgagaaagccattgaaaaattcatccgacagcttctcgaaaagaacgagccccaacggccccccccgcaataccccttgctgattgtcgtctataaagtactggccactctcggcctgattctgctgaccgcgtactttgtaatccagcctttttcacccctggccccagaacctgtgctgtcgggagcccatacatggaggagccttattcatcatatccgcctgatgagtctgcctattgctaagaaatacatgagcgaaaacaagggggtgcccctgcacggaggcgacgaggatagaccgttcccagattttgatccatggtggacaaatgactgtgagcaaaacgagtccgagcccatccccgccaactgtaccggttgtgctcagaagcacttgaaggtcatgttgttagaggacgctcctaggaagtttgagagactgcaccccctcgtgattaaggagattgagctttgcacgggtaccgcctcccgagctgagaatcaagtggaacgcgggaagatcaaaacaaaaaccatgaaactgctgtcgggcggctggttactgagttatctcccgttcgcgtgcatgtag

SEQ ID NO: 25408 - DNA, 651 bp, Artificial Sequence
  Description of Artificial Sequence: Synthetic coding sequence
atgttagccagccctgcccgcccaacactgcgtatgcttgcaaaccatgctctgtccactccccattgtgcctgcagtccagcccctgcaccgcgaacggcttcggcgtctaggagacgatgcgttcctgtggaggcacgggccgccggcgtgttcggagaccggctcgccggggtctttgggagcagggggctaaagcatggaggcgtgcaggccccacgtccaagggtggtaagggccgagcctagagctggctttgccgtggtgagaagccctcgcaggctgtgcggcaggagccatgccccccagcctcctgctcacctcggtctgggccccggctgtttcccagcagtggccgtggtggtacctgtacctggctctagagcacatagaccttttgctgccttactggttgagggcagtttccttggcgatcctccaatcccccccagacgttcaggggtgctagcgagaggctctgctggcgcagattgtctggccagtagcgtgacgcctgggccatccctatggatccccctcctcttagtcgcgggctgcgtatcatgctttgtcggcctggcagtttgtgtgtggatgcaggcacgcgtttctccagcctggcctgctggactctttttactgccacgatag

SEQ ID NO: 25409 - DNA, 357 bp, Artificial Sequence
  Description of Artificial Sequence: Synthetic coding sequence
atggaagactttgccacacgcacctatggaacctcagggctggacaatcgcccactcttcggagagacttctgctaaggatcgcatcattaacctagtggtggggagcctaaccagcctgctcatcctggtcaccctgattagcgcctttgtgtttccccaactcccccctaaaccacttaatattttctttgcagtgtgcatttcactgagcagcatcaccgcctgcatcctgatttattggtacaggcagggcgacctggagcccaaattccgaaaactgatttactacataattttttctatcattatgctttgtatctgcgcaaatctctactttcatgacgtggggcggtag

SEQ ID NO: 25410 - DNA, 357 bp, Artificial Sequence
  Description of Artificial Sequence: Synthetic coding sequence
atggaggacttcgcaaccagaacatacggcacttctggcttggataacagacccttgttcggcgaaacatctgcaaaggacaggatcatcaacctggtggtcgggtctctgactagtttgttgattctagtcaccctaatttctgcgtttgtgtttcctcaattgcccccaaagcccctcaacattttcttcgccgtctgtatctccctttcctctatcacggcatgtatcctcatttactggtatagacaaggggacttggagcctaagttcaggaagctgatctactacatcatcttttccatcattatgctctgcatttgcgctaacctgtactttcacgacgtgggccgatag

SEQ ID NO: 25411 - DNA, 18 bp, Artificial Sequence
  Description of Artificial Sequence: Synthetic coding sequence
atggaggatttcgcttag

SEQ ID NO: 25412 - DNA, 705 bp, Artificial Sequence
  Description of Artificial Sequence: Synthetic coding sequence
atgggacctggtggcagggttgcccgactgttagctcctcttatgtggcgacgggccgtgtcctccgtggctggttccgccgtgggagctgagcctgggctaagacttctggcggtgcaacgactgccagttggtgcggctttttgccgagcttgtcagacacccaacttcgtgcgcggactgcattctgaaccaggcctagaggagagagcagaaggaacggtaaatgagggcaggcccgaatcagacgccgccgatcacacagggccaaagttcgatatagatatgatggtgagtcttcttcgccaggagaatgcccgagatatctgtgtgatccaggtgccgccagaaatgagatacactgactacttcgtgatcgtatccggaacaagcacaagacatctacacgcgatggcgttctatgtcgtgaagatgtacaagcaccttaagtgtaagcgcgaccctcatgtcaaaattgaaggtaaagatacagatgattggctgtgtgtggactttggcagtatggtcattcatctaatgttaccagagaccagggagatatacgagctggaaaagctgtggaccctgaggtcctatgacgaccagctggctcagatcgccccggagacggtgccagaagactttatactgggtattgaagacgatacatcgtctgtgaccccagtagaattaaaatgtgaatag

SEQ ID NO: 25413 - DNA, 945 bp, Artificial Sequence
  Description of Artificial Sequence: Synthetic coding sequence
atgttctccatcaaccccctggagaacctgaaagtgtacatttcttccaggcctccactagtggtgttcatgatatctgtgagtgcaatggcaatcgcattcttgactttgggctacttcttcaagattaaggaaatcaagtcacctgagatggcggaggactggaacacctttctgctgcgcttcaatgatttagatttgtgcgtttctgaaaatgagaccctaaaacatctaacaaatgacacaacaactcctgagagcacaatgacaagcggacaggcccgggcatcaacacagtccccacaggcactggaggactcaggtcctgtgaatatcagcgtctcaattacattgacactcgacccgcttaagccctttggcggttactcacgcaacgtcacgcacctctatagtactatacttggccaccagatcggcctgtcagggcgagaggctcatgaagagatcaatattaccttcactctgcctactgcctggtcgtccgatgattgtgcattgcacggtcattgtgagcaggtagtgttcaccgcatgcatgactcttaccgcctctcctggcgtcttcccggtaactgtgcagccgcctcactgtgtgcccgatacctactctaatgcaaccttatggtataagatattcactacagcccgggacgccaataccaaatatgctcaggactacaatccattctggtgctataaaggggccattggaaaagtgtatcatgctcttaacccgaaacttacagtgatagtcccagacgacgaccgctccctcattaacttgcacctgatgcacacctcctattttctgttcgtgatggtcataactatgttttgctatgctgtaatcaaaggtagacctagcaaactgagacagagtaaccctgaattctgccccgagaaggtggcgcttgctgaagcctag

SEQ ID NO: 25414 - DNA, 219 bp, Artificial Sequence
  Description of Artificial Sequence: Synthetic coding sequence
atgttttccataaatcctctggaaaacctgaaggtctacatttcaagtcgcccacctcttgtggtcttcatgatttcagtttccgctatggccatcgcctttttgacccttggctactttttcaagattaaagagatcaagtcaccagagatggccgaagattggaatactttcctgctgcgtttcaatgacttggacctgtgtgtgtcagagaactag

SEQ ID NO: 25415 - DNA, 285 bp, Artificial Sequence
  Description of Artificial Sequence: Synthetic coding sequence
atgtttagtattaatccattggagaatcttaaggtttacatttcatccagaccacccctggtggtgtttatgatctctgtgtcagcaatggccatcgcctttcttacactaggctactttttcaaaatcaaggaaataaaatcccccgaaatggcagaggattggaacacatttctccttcgatttaatgatcttgatctttgtgtcagcgaaaacgagacgcttaagcatcttaccaacgacaccactacacccgaaagcaccatgacttccggacaggcctag

SEQ ID NO: 25416 - DNA, 420 bp, Artificial Sequence
  Description of Artificial Sequence: Synthetic coding sequence
atgtttagcatcaatccgttggaaaacctcaaggtttacatatccagtcggccacccctcgtggtgttcatgattagtgtgtctgccatggctatcgccttcctgactctgggatatttctttaaaattaaagagattaagagccctgagatggccgaagactggaataccttcctcctgagattcaacgatttagacctgtgtgtcagcgaaaacgaaacgctgaaacacctgaccaatgacacgactacccccgagtctacaatgacaagtggtcaggcccgcgcgtctactcagtccccgcaagcccttgaagactccgggccagtcaacatctcagtgtccatcactcttactttagaccctctgaaaccttttgggggctattctcggaacgtgacacacttatactcaacctag

SEQ ID NO: 25417 - DNA, 567 bp, Artificial Sequence
  Description of Artificial Sequence: Synthetic coding sequence
atggcactagctatgttggtattggtggtttctccctggtctgcagctaggggagtgctgagaaactactgggagagattactcagaaagctacctcagtctcggcctgggttcccctccccaccctggggccctgcactggccgtccagggccccgccatgttcacagagcctgccaatgatacatctggctccaaggaaaattcaagcttgctggactctatattttggatggccgcccctaagaaccggaggaccatcgaagtgaaccggtgtcggagaagaaatccacagaagttaataaaagtgaagaacaatatagatgtgtgcccagaatgcggccacctgaaacaaaaacacgttttgtgcgcttactgttatgagaaagtgtgcaaggagacagctgagattcgccgccagatcggaaagcaagaaggcggtcccttcaaagctcccactatcgagactgttgttctttataccggagagaccccttccgaacaggaccagggcaagaggatcatcgagcgggatcgaaagcgacccagttggttcacacaaaactag

SEQ ID NO: 25418 - DNA, 441 bp, Artificial Sequence
  Description of Artificial Sequence: Synthetic coding sequence
atgatgtggcagaagtacgcaggaagcaggcgaagcatgcctttgggggctcgcatcttgttccacggagtgttctacgctggcggctttgccattgtatattacctcattcagaagttccactcccgggccctgtactacaaactggcagttgaacagttgcagtctcaccccgaagctcaagaggctctcgggcccccactgaacattcactatctgaaactaatagacagagaaaactttgttgacatagtggacgctaaactgaagattccagtttctgggagcaaatccgaagggctgctgtacgtccactcgtcccgcggcggaccatttcagagatggcaccttgatgaagtgttccttgagttgaaagacgggcagcagatccccgtttttaaattgtctggcgaaaatggcgatgaagtgaaaaaagagtag

SEQ ID NO: 25419 - DNA, 441 bp, Artificial Sequence
  Description of Artificial Sequence: Synthetic coding sequence
atgatgtggcaaaaatacgccgggagtaggagaagcatgcctcttggtgcgagaattctgtttcatggtgttttttacgctggaggatttgcaatcgtgtattacctgatccagaaattccacagcagagctctgtactacaagttagccgtggagcagctccagtcccacccagaggcgcaggaagccctgggccctcccctgaatatacactatttgaagctgatagatcgggagaattttgtggacatcgtcgacgccaaattgaaaattcccgtgtctggtagtaagagtgaaggcttactgtatgtgcatagcagccgtggcggcccatttcaacgatggcacctggacgaggtgtttttggagcttaaagatgggcagcagatacccgttttcaaattgtccggcgagaacggcgatgaggtcaagaaggagtag

SEQ ID NO: 25420 - DNA, 441 bp, Artificial Sequence
  Description of Artificial Sequence: Synthetic coding sequence
atgatgtggcagaagtatgcaggcagcagacgctctatgcctcttggggctaggatcctcttccatggtgtgttttacgccggcggctttgccattgtatactatctgatccaaaagtttcatagcagggccttgtactataagctggcagtagagcagttacagtctcaccctgaagctcaggaggcgttgggccctccactcaatatccattatctcaaactcatcgatcgcgagaacttcgtggatatcgtggacgcgaaactgaagatcccagtttcagggagtaagtctgaaggcttactgtacgtgcactcatcccgaggtggaccattccagcgttggcacttagacgaggttttcttggaactgaaagacggccagcagatccctgtttttaagttaagtggcgaaaacggagatgaagtcaaaaaggagtag

SEQ ID NO: 25421 - DNA, 441 bp, Artificial Sequence
  Description of Artificial Sequence: Synthetic coding sequence
atgatgtggcagaagtatgctggcagtagacgctccatgccgctgggtgcacggatcctgtttcatggagtcttctatgctggaggattcgctattgtgtattacctcatccaaaagtttcactctcgcgccctctactacaaacttgctgtggagcagttgcagtcccaccccgaagctcaggaggcattaggaccacctctgaatatccactatctgaaactcatcgaccgagagaactttgtagacatagttgacgccaagctcaagattcctgtgtcagggagtaagtccgagggcctcctctacgtgcattctagtagaggcggccccttccagcgatggcacctcgacgaagtattcctagaactgaaggatggccagcaaatccctgtattcaagctatctggtgagaatggcgacgaagtgaagaaagaatag

SEQ ID NO: 25422 - DNA, 342 bp, Artificial Sequence
  Description of Artificial Sequence: Synthetic coding sequence
atgatgtggcaaaagtacgctggatcccgccggagtatgccgctcggcgcccggattctgttccatggtgtcttttatgccggtgggtttgctatagtgtattacctgatacagaagttccacagccgcgctctctattacaagcttgctgtcgaacaactgcagtctcaccctgaagcccaagaggcattgggtcctcctcttaatatacactaccttaagctgatcgaccgggaaaattttgttgacatcgtggacgccaagcttaagatcccagtgagcggctccaaatcagagggcctgctgtacgtccactctagcagaggtgggcctttccagtag

SEQ ID NO: 25423 - DNA, 267 bp, Artificial Sequence
  Description of Artificial Sequence: Synthetic coding sequence
atgatgtggcagaaatacgctgggagccggcgatcaatgcccttaggggccagaattctgtttcacggagtgttctacgcaggcggctttgctattgtgtactaccttattcagaaattccactcccgagccctgtattacaaattggcggtcgaacaactgcagagtcacccagaagcccaggaagcacttggcccacctctgaatattcattatttaaagttgatcgacagggagaactttgtggatatagtagacgcaaagtag

SEQ ID NO: 25424 - DNA, 441 bp, Artificial Sequence
  Description of Artificial Sequence: Synthetic coding sequence
atgatgtggcaaaagtatgccggcagcaggcggagtatgcccctgggagcaaggatcctttttcacggggtcttttacgcgggcggctttgcgatagtctactatctgatccaaaagtttcacagtcgagccctatactacaagctcgcggtcgagcaacttcaatcccacccagaggctcaggaggctctgggaccgcctttaaacatccattatctgaagctgattgaccgggagaacttcgtagacattgtcgatgcaaaacttaagatccccgtgtcagggagcaaaagcgagggtctgctctacgtccattccagcagaggaggccccttccagcggtggcatctcgatgaagtgtttctcgaactaaaagatggtcagcagattcctgtgtttaaattgtctggcgaaaacggggacgaagttaagaaggaatag

SEQ ID NO: 25425 - DNA, 441 bp, Artificial Sequence
  Description of Artificial Sequence: Synthetic coding sequence
atgatgtggcagaagtacgctgggagtcgccgatccatgccactcggagctcgtatcctctttcatggcgtattctacgcaggcggattcgccattgtgtactacctcattcaaaagtttcatagccgagctctgtattataaactcgccgtggagcaactccagtcacaccccgaagcacaagaggcactggggccccccttgaatatccactacctgaaattgatcgacagggagaactttgtcgacattgtagatgccaaactgaaaatacccgtatcaggttcaaaatcagagggactcctgtatgtccacagcagcagaggcggaccgtttcagcggtggcacctcgacgaggtgtttttggagctgaaggatgggcagcagattcctgtatttaaactgagcggtgagaatggtgatgaagtgaaaaaggagtag

SEQ ID NO: 25426 - DNA, 441 bp, Artificial Sequence
  Description of Artificial Sequence: Synthetic coding sequence
atgatgtggcagaaatatgccgggtcacgccgaagcatgcctctcggggctaggatcctttttcacggggtgttctatgccggcggctttgccatcgtctactatctgattcaaaagtttcacagccgagctctgtattataaactagcagtggaacaattacagagccaccctgaagctcaggaagccctggggccacccctcaacatacactacctaaagctgatcgaccgcgagaattttgtcgacatagtggacgctaagcttaagatccccgtatccggcagtaagtctgaaggtctgctgtatgtccatagctcccgaggtggaccattccaacggtggcatctggatgaagtatttttggaactcaaggatgggcagcagatcccagtctttaaactttcgggcgagaacggagacgaagtgaagaaggaatag

SEQ ID NO: 25427 - DNA, 735 bp, Artificial Sequence
  Description of Artificial Sequence: Synthetic coding sequence
atgggagaccttttttccctcttttgggaagtcgacccaccccccatcccggtgaattgcgccatccctaaccaggattatgagtgctggaaagacgattcgtgtggaactattggctcattcttgctttggtactttgtgatcgtctttgttctgatgttcttttccagggccagtgtttggatgagcgaagataaaaaggacgagggcagcggcacatccacaagcgtacgcaaggcttccaaggaaacttcctgcaaacggcagtctaaagactccgcctgggacccctcccagacaatgaagaagcccaagcagaatcagctgacgcccgtgaccaattcggaggtggccctggtgaatgcctaccccgagcagaggcgcgcccggcggcagtcccaattcaatgaggtaaaccagaatcaacacgattcagacaccacagaatatggctctgaagagagtaactcggaagccagcagctggaaggagtcggagagcgagcatcacccttctccagattcaataaaaagaagaaagatggctcagagacaacgcaacctgggaagctatcaaatgtctgagcggcattgcctgcactgcaaagctctcagaaccaacgagtggttggcgcaccacagccgccaaaagccaagtgtcactccccctatgaagcgggacagccaggaggaaagctcaatttcagatataaacaaaaagttttctaagttttag

SEQ ID NO: 25428 - DNA, 396 bp, Artificial Sequence
  Description of Artificial Sequence: Synthetic coding sequence
atgacccactctagccaggatacaggttcttgcggtatccaagaggacgggaagctctatgtggtggactctatcaacgacttgaataagctgaatttatgcccagccggctcccagcacctgtttccattagaggataaaatccctgtgttggggaccaatagtggtaatggcagccgcagcctgttctttgtgggtttgctgatagtactgattgtgagcttggccctcgtgttcttcgtgatttttttgattgtacagactggaaacaagatggacgatgtgtccagaagactcaccgcagagggcaaagatattgacgacctcaaacggatcaacaatatgatagtgaagcggcttaaccaattgaaccagttggactctgagcagaattag

SEQ ID NO: 25429 - DNA, 180 bp, Artificial Sequence
  Description of Artificial Sequence: Synthetic coding sequence
atgactcattcaagccaggacacaggtagttgtgggatccaggaagacggaaaactgtacgttgttgatagtattaacgacctgaacaaattgaacctctgtcctgctgggtctcagcatctcttcctgctgaggcaaagctcgaaaaacttcccaaaacgatcaaaggaaatcgcttag

SEQ ID NO: 25430 - DNA, 396 bp, Artificial Sequence
  Description of Artificial Sequence: Synthetic coding sequence
atgacccattccagtcaggataccggatcatgcggaattcaggaagacggaaaactgtacgtggtggacagtattaatgacctgaacaaactgaacctgtgtccagcaggctcccagcatctcttccccctggaggacaaaattcccgttctcggaacaaattcggggaatgggtcccgcagcctgttttttgtcgggcttctgatagtgctgatagttagtctcgcactcgtcttctttgtcatatttctgattgtgcagacaggtaacaaaatggatgacgtctcccgccggcttaccgccgaaggcaaggatatcgatgatctcaagaggatcaataacatgatcgtgaaacgcctaaatcagcttaatcagctggacagcgagcaaaattag

SEQ ID NO: 25431 - DNA, 342 bp, Artificial Sequence
  Description of Artificial Sequence: Synthetic coding sequence
atggctgctctggggtcaccttcacacacttttcggggactcctgagagagctgagatatctttcagcagccactggccgaccttacagagacacagctgcatatcgctatctggttaaggcgttccgagcgcatcgggttacctctgagaagctgtgccgtgcccagcacgaattacacttccaggccgccacctacctctgtctgttacgctcgatacgaaaacacgtggccctccaccaggaatttcacggtaagggtgagaggtccgttgaggagtctgccggtctggtgggcctgaaactgccacaccagcctggcggaaaagggtgggagccgtag

SEQ ID NO: 25432 - DNA, 3081 bp, Artificial Sequence
  Description of Artificial Sequence: Synthetic coding sequence
atggtctgtagacctgtatttccgtgtcgcagaaggttctgcccccgcccctttttggtggggcttgtagtggcaatatgcctgttctaccagactctcactctgcggggaagcaggaagctcacagccgccgcgcccggagctgtgccgcacacgagcaccgagacccaggcttcacggtgcaagaagggatttagccaagataaacagtgtttccttctgtctggcaatgcgcaggagactcgaaaggtaaaggagagtatggaaacccattttggctcacatggccggagggccatcctgtacaggccacccttctactcaaagacagagctgcaactgcatcaacacattttgacgcagcatggttacaccgtggttatcgccgaggagcggctcaacgccgggctgggaccaggactgttagagcagggggacctgggaagttgggatttgctgatctgcctctcctcgaaaaaagctgagggcaccccgtgcatcagtaaggaagtgatgtgccaactcggccttcaccaaaaagcaaacaggctgccagaaatccagcagcctctgtgtcgcaaggagggactctgtcagatcgttaggcgttttcctgagctccaactacccgttagtcctagcgtctgccttgatcagggaatgcaactaaaacccagtacgtcctctcatctgcttaagaccgtcaaacctagagtttggaagccgggggattggtcacgcgagcagcttaatgagactaccgtgttagcaccacatgagaccattttccgagcggaggacctatcagtgattctgaaggcctatgtcctggtgacctctctaacgcccctcagagccttcattcactctaccggtactgtctggaatcccccgaaaaagaagcgcttcacggttaagttgcagaccttttttgaaacattcctcagggcgagctccccccagcaagcgttcgatattatgaaagaggcgatcgggaaactgctcctggccgcagaagtttttagcgaaaccagtactcttgggcccaagacgttccaccgatgtaggttttgctttcagctgctgacatttgatatcggctacggctccttcatgtaccccgtggtgttgcaggttcatgaacatttaaacttccaggattacgacaacatggactttgaggatcagaacactgaggaatttttgctgaatgacactttcaacttcttgtttccaaatgagagttctctgtctatattctctgagatcttccagagactgtacaggtccgatgtgtttaaaggcgagaactatcagaaagagttgaatcagtgcctttccttagaggaaataaattccattatgacatttatcaaagagttgggatctctgggtcaattccagttactgtttccctcaacaacccccggcatccagtcactgatgcacgagttctacgacgtggcgaatcccgtggggaatcctgggtcggtgctaacacagtattggtcgctcttaaacgtcttcgagcagttccagttcatgaacaagaagacccagccccatcctctggagtggaactcgtttaccgaagataaaaacatcgagaaaccccaggtgccatttgatgctatcgagaacaaaaaggccgcagtgccacagataaaaaacgaaaacaaggaaattcactgcagcgacgacgagaacactccttgtcatatcaagcagattttcacacacccgcacctcgagcttaacccagattttcatcctaagataaaggattattattgcgaggtgcctttcgacgttgtgactgttaccattggggtggagacccctaaatgtttgtgcaaggttcacctatatgagcaggctgggccatccttcgcatcatatcctctgggcttaggtatgaacaaaatatcgatttttgtggtggacgaaagcccggctcacggcgaaacacttattacctataagctgaccatttatagggaagataggccatctttaccactgtttgaggccttcacggcgtgtggttttgtccaagattgtggactgctgatccatcctgaggaaacctgtggcctgcagccaatctccagtgactatattgaggcaatcctgcagtccgaactgaaaagatgccccagcggggacatgaaaggccagtggattgtcccctgtctcagttgtagtgataacaggacttgtgactggagagagattacctggcaaccgcataattgccagtacggtgtacttaccaagccccagctgcagcagtgtttaggaggccggaaaattctgtttattggtgactctacaaataggggaatcatgtactaccttattgagcgcctgaacgagactctccaggagtggcaaaaggtacatggaactaaattctaccacaatgttaacggcgggaagacactgatctcctatagctactaccctcagttttggatctcgcctagcctgaggccgacttttgagaacgctctggagcatctcctccaacgcagccggcccttggaaaatacagggcagactgttctcgtggtggggggtgtgcaatggctaaacagcaatcacttacaaatcattcataaggtgctcaagcgggaaaacctcctgaacatcctggtgatcatcaagactctgggtattgggttccatttgcccgtggatggagtgcattttctcacgcagtccgaagtacagaatttatggaaagaaaacctgataatcctcgacaccgcaaagaagcatggatacgaggttgtggacaccttcaccattaccatggggagatataaagagttcctgcaaggtaagtgcggatgccattttcacgaggttgtgaagagcaagctgtcaaaagaatataatttcatcaagatgaaaaggtctagaaaccatattatgggtcggtattttagcaatcagtccaaattacagcagggtaccgtcaccaattttagatccccttaccacgtgaggggccctatcaaccaggtatgtagcgaaattctgctgtcccggatgtgcgcgaacaagcggactatgtag

SEQ ID NO: 25433 - DNA, 609 bp, Artificial Sequence
  Description of Artificial Sequence: Synthetic coding sequence
atggtgtgcagaccagtctttccctgtagacgccgtttctgtcctcgcccatttctggtgggcctcgtcgtggccatctgcttattctaccagacccttacactcagaggtagccgtaagttgaccgctgctgcccccggagcggtccctcacacatccactgaaacgcaggccagccgatgcaagaaagggttttcacaagacaagcagtgtttcttgctcagtgggaacgcacaggaaacccgaaaggttaaggagtctatggaaacccattttggttcgcatggacgtagggccatcctgtacaggccacctttctactctaagaccgaactgcaattacatcaacacatactcacacagcatggatacacagtggtaattgctgaggagaggttgaatgcaggactcgggccgggattgcttgagcagggggacctgggcagctgggacttactaatttgcctatccagtaagaaggcggaagggaccccatgtataagtaaggaggtgatgtgccagttgggactacatcaaaagcagctgcgaaggagagaggagcgacagcggccaggctctcctgcaagtaggagactctccgtccgctag

SEQ ID NO: 25434 - DNA, 1650 bp, Artificial Sequence
  Description of Artificial Sequence: Synthetic coding sequence
atggtttgccgccctgtgttcccatgccgtcgacgattttgcccccggccatttctggtaggactagtggtggccatctgcttgttctaccagaccctcaccctgcgcggatcgcgtaagttgacagctgcagccccaggcgctgtccctcatacttctactgaaactcaggccagtcgctgcaagaagggatttagccaagataagcagtgttttctgctgtccggaaacgcacaggagaccagaaaagtcaaggaatctatggagacacactttggttcacacggacgccgcgcaattctttacaggccccccttctactcaaagacagagttgcaactgcatcagcacatcttgacacagcatgggtatactgtcgtcattgctgaagagagactcaacgcaggattaggccccgggttgttggagcagggggaccttggctcttgggacctgctgatttgcctgtcctcgaagaaggcagaagggactccctgcatcagcaaagaggtgatgtgccagctgggattgcaccagaaagccaacagactgcccgaaatacagcagccgttatgtagaaaggaaggattgtgccaaatagttcgccgtttcccagagcttcagctgcctgtatcaccctctgtctgtctagatcagggcatgcagctgaagcccagcacctcaagtcatctacttaaaacagtaaagccccgcgtgtggaaaccaggcgactggagtcgcgaacaacttaacgagacaaccgtgctggcaccacacgagactatcttcagagcggaagatctcagcgtaatattgaaggcttatgtcctggtaacctctctgacacccctgcgagcctttatccactccactggaactgtctggaatccacccaagaagaaacggtttacagttaaacttcaaactttttttgaaacttttctcagagccagtagtcctcaacaagcattcgacatcatgaaggaggctattggaaagcttctcttagcagccgaagttttcagtgagacgagcactctgggcccaaagactttccataggtgcagattttgcttccagctgctcacattcgatatcggatacggcagcttcatgtaccccgttgtactccaggtacatgaacatctaaactttcaggactacgataacatggattttgaggatcagaatactgaagagttcttgctgaacgatactttcaacttcttgtttccaaacgaaagtagtctgtccatattttccgaaatcttccagcgcctgtatcggtcggacgtgttcaaaggcgagaattatcagaaggagttgaaccagtgcctcagtttagaagagataaattcaatcatgacctttatcaaggaacttggctcactgggccaattccagttactcttcccttccaccaccccgggtatccagtcattgatgcacgagttttacgacgttgccaacccagttgggaatccaggatcggttctcacccagtattggagcctactgaacgtcttcgagcagtttcaattcatgaacaaaaagactcagcctcacccactggagtggaactctttcactgaggataaaaatattgagaaaccacaggtgcccttcgacgctatcgaaaataagaaatag

SEQ ID NO: 25435 - DNA, 2352 bp, Artificial Sequence
  Description of Artificial Sequence: Synthetic coding sequence
atggtctgtcggcctgtctttccttgtaggagacgattctgccccagacctttcctggtcgggctagtggtggctatctgccttttttaccagactctgactttgaggggctcccgcaagctgactgccgcagcacccggcgccgtgccacatacaagcaccgagactcaggcctccaggtgtaagaaggggttttctcaagataagcagtgttttctcctgtcaggtaatgcccaggagactcggaaagtgaaagaaagcatggaaacccacttcggatcccacggacggcgggctatactgtatcgacctcccttctattccaaaactgaactgcaattgcatcagcacatattgacacaacatgggtacacagtagtcattgctgaggagaggttaaatgctgggctcggaccaggcctgttagaacagggcgatttaggaagctgggacctgttgatttgtttgtcctccaaaaaagccgaggggacgccatgcatctccaaggaagtcatgtgccagctggggctgcatcagaaggctaatcgcctcccggagatccagcagcctctttgtcgcaaagaaggcttatgtcaaatagttcggagatttccagagctgcagttacccgtgtctccctccgtgtgcctggatcaagggatgcagctgaagccctcgacaagttctcatctgttgaaaaccgttaagccccgcgtctggaagcccggcgattggagtcgcgagcagcttaacgaaaccactgtgttagcgccacatgagacgatcttcagagccgaagacttgtccgtgattcttaaggcctatgttcttgttacctccttgacgccattgcgagcgttcattcattctaccggcactgtctggaatccacctaagaagaaacgattcaccgtaaagttacagacatttttcgagaccttcctaagggctagcagtccccagcaggcttttgatatcatgaaagaagcaattggcaagctgctgctggcggccgaagtcttcagcgagacgagcaccctgggcccgaagactttccaccgctgcagattttgtttccagctgctaactttcgacattgggtacgggagcttcatgtaccccgtcgtgctgcaggtccacgaacacctgaatttccaggattatgataacatggatttcgaagatcagaatactgaagaatttcttctaaatgatacctttaactttttgtttcccaatgaatcttctctgtccattttcagcgagatcttccagcgtctatataggagcgacgtattcaagggagaaaactatcagaaagaattgaatcagtgcttaagtttagaggaaatcaatagtatcatgacatttatcaaggaattaggatctctcggtcaatttcagcttctctttccctccactacaccaggaatacagagtctgatgcacgaattctacgacgtggccaacccagtcggcaatcctggctctgtgcttacacagtattggagcctgctcaatgtgttcgaacagtttcagttcatgaataagaagacccagccacatcccttagagtggaacagctttacagaggataaaaacatagaaaaacctcaggtaccttttgacgctattgagaataagaaagcggccgtgccgcaaatcaagaacgaaaacaaagaaattcactgcagcgacgacgaaaataccccctgccatataaagcaaatatttacccatccacacttggagcttaaccccgactttcaccctaaaattaaagactattactgtgaggtgcctttcgacgtagtgaccgtgacaattggcgtggagacaccaaagtgtctgtgtaaggtgcacctgtatgagcaggccggcccctccttcgcctcctatcccctgggattggggatgaataagattagtatttttgttgtggacgaatctccagctcatggcgagacattgatcacttacaaactgaccatctacagagaggaccggccgagcctgccgctcttcgaggccttcacagcatgcggttttgtacaggactgcggcctcctcatccacccagaagagacgtgcggccttcagcccataagtagcgactacattgaggctattttgcagagcgagctgaagcgatgcccaagcggggacatgaagggccagtggatagtaccttgcctaagctgcagcgataacaggacctgcgattggagagagattacctggcaaccccataattgtcaatacggtgtgctcactaagccacagctccagcagtgtctcggagggaggaagcttggggtggacgtacagcgagtcccacgatcacggaactag

SEQ ID NO: 25436 - DNA, 348 bp, Artificial Sequence
  Description of Artificial Sequence: Synthetic coding sequence
atgatggcggtaatgacaccatcagatggattgtcacaactgtcagtgcctcatctgacgcaccaacgactctggagtttatcctgcctggccatgctctttcaggccgtgttgatcctcagtgcaccgcaaatgtcgtgcctccttaaatgcttttatgcactggaccccctgcacccagtcatgtctgaggaattttccgctcaatatcgccatatgatggaccaacggtataggaccagaattcatgaggggtacatttcgcaagtgaagggggcatatctgcggatcgtgcacaaaaagcctatatcatacgccaagtccttccccaaagaaatggggaactag

SEQ ID NO: 25437 - DNA, 300 bp, Artificial Sequence
  Description of Artificial Sequence: Synthetic coding sequence
atgggtgaatgtccacacctggtcgacgtacgactcgggcaccggtctctcgcaacaggccctgagcaatcggacatttgtcatactgggtccgaggctcgatggacaaccacgtggtacggatctttgtccttcagcaggcacaagtataaaatgcttgcagatcttacgccaggtgtagaaatgtcctgtcgtcactgggcccgctggctgaccccagtcatccccgccctttggaaagccgaagcaggtggtcttcccgagctccggtccagccgccctgcctggaccacctggtag

SEQ ID NO: 25438 - DNA, 324 bp, Artificial Sequence
  Description of Artificial Sequence: Synthetic coding sequence
atggctggggggtacggagtgatgggcgatgatggcagcatcgattatacggtgcacgaagcatggaatgaggccacaaacgtgtacttaatcgtaatccttgtgtcctttggtctcttcatgtatgcgaagaggaataagagacgcattatgcggatattttctgtccctccgacagaagagaccctgtcggagccaaacttctatgatacgatatctaagattcggttacgacagcagctcgagatgtactccatctcacgaaaatatgactatcagcagccccagaatcaggcagactctgtccaactgtcgctggaatag

SEQ ID NO: 25439 - DNA, 324 bp, Artificial Sequence
  Description of Artificial Sequence: Synthetic coding sequence
atggccggcgggtacggcgtcatgggcgatgatggcagtatagattacaccgtccatgaggcctggaacgaagccacgaacgtgtacctgattgtcattctagtgagtttcgggctttttatgtacgcaaaacggaacaaaaggcgcatcatgaggatcttctcggtgccccctactgaggagacgctgtccgagccaaacttttatgatacaatttccaagattagacttcgacaacagctcgagatgtactcaataagccggaagtatgactaccagcagccccagaaccaggctgattcagttcaactgtccttagagtag

SEQ ID NO: 25440 - DNA, 324 bp, Artificial Sequence
  Description of Artificial Sequence: Synthetic coding sequence
atggctggtgggtacggcgtaatgggcgacgacggaagtatagactacactgtccatgaggcttggaacgaggcaactaacgtttatctgatcgttatactcgtaagtttcgggcttttcatgtacgcgaaaagaaacaagcgaagaatcatgcgcatcttctccgttcctcccaccgaggagacgctgtctgaaccaaacttttacgatactatttctaagatacgccttcggcagcaacttgagatgtacagtatatccaggaagtacgattaccagcaaccgcagaatcaggcagattctgtacaactgagcctggaatag

SEQ ID NO: 25441 - DNA, 324 bp, Artificial Sequence
  Description of Artificial Sequence: Synthetic coding sequence
atggccggtggttacggggttatgggcgacgatggatccatcgattataccgtccacgaagcctggaacgaagctactaatgtgtaccttattgttatactcgtgtccttcgggctgttcatgtatgccaagcgaaataaacgacggattatgcgcatcttttccgtaccgccaaccgaagagacgctgagcgagccaaatttctatgatacaatatctaagattcggctacgccagcagctggagatgtattcaatctctcggaaatatgactaccagcaaccccagaaccaagcagactctgtgcagctctcactggaatag

SEQ ID NO: 25442 - DNA, 324 bp, Artificial Sequence
  Description of Artificial Sequence: Synthetic coding sequence
atggccggaggatacggcgtgatgggggacgatggatccatcgactataccgtgcacgaggcctggaatgaggccaccaacgtgtatctaatcgtcattttagtcagtttcggcctgtttatgtacgcaaagaggaataagcggcggattatgagaattttttccgtgccaccaaccgaggaaacactaagcgagccgaatttttatgacacaatctctaagatcaggctgagacaacagctggagatgtacagtatatccaggaagtacgattatcagcagcctcaaaaccaggccgatagcgtacagttatctttggaatag

SEQ ID NO: 25443 - DNA, 651 bp, Artificial Sequence
  Description of Artificial Sequence: Synthetic coding sequence
atgtggcctccttgtggtacactccggactctggccctggctcgatctcggggcgcacgggcttgcagcggggatgggggcgtcagttatacccagggacagtctcccgaacccaggactcgggaatacttctactacgttgaccatcagggccagctcttcctcgatgattccaaaatgaagaacttcatcacttgtttcaaggatccccagtttctggtaacctttttctcaaggctgcgaccgaaccgctcaggacggtacgaagccgcctttcccttcctctccccgtgcggccgagagcggaacttcctgcgctgcgaggatcggcctgttgttttcacacatctgctcaccgctgatcatggcccaccccgactcagctactgcggagggggggaggctctcgcagtgccttttgaacccgcgaggctacttcctcttgctgccaatggtcgcttataccaccccgctcccgagagggccggtggcgtgggcctggttcgaagcgcccttgcctttgaactgtcagcatgctttgagtacgggcctggtgcacctgccctgcccagccacgttcgttggcagggacgtcgactggccctcaccatggatctggcaccactgctcctagccgcaaggagtccgtag

SEQ ID NO: 25444 - DNA, 261 bp, Artificial Sequence
  Description of Artificial Sequence: Synthetic coding sequence
atggggcgcaaagacgccgccacaatcaagctcccagtcgatcaatatcgtaagcagataggaaagcaggactataagaagactaagcccattttaagggctaccaaactgaaagccgaagcaaagaagacagccatcggcatcaaagaagtgggtttggtgctggctgcaattctggccctgctccttgccttttatgcatttttttatctacggctgactactgatgttgacccggacctggatcaggatgaagattag

SEQ ID NO: 25445 - DNA, 228 bp, Artificial Sequence
  Description of Artificial Sequence: Synthetic coding sequence
atggggagaaaggatgccgccaccatcaaactgcctgtggaccaatacaggaagcaaattgggaaacaggactacaaaaaaacaaagccaatcctgcgagctactaagctcaaagcagaggccaaaaaaactgctattggcatcaaagaagtcgggctcgttttggcagccatacttgctctcctgctagcgttctatgcctttttttatctgcggcttacaacctag

SEQ ID NO: 25446 - DNA, 261 bp, Artificial Sequence
  Description of Artificial Sequence: Synthetic coding sequence
atgggacgaaaggatgcagctaccatcaaactccccgtggaccagtaccgaaaacaaattggtaagcaagactacaagaagacaaaaccaatactaagagccaccaagctgaaggccgaggctaaaaagaccgcgatcggaatcaaagaggtgggattggtcctcgcagctatcctcgcactgctgctggccttctacgctttcttttatctgcggctgactacagacgtcgatccagacctggaccaggacgaagattag

SEQ ID NO: 25447 - DNA, 261 bp, Artificial Sequence
  Description of Artificial Sequence: Synthetic coding sequence
atgggcaggaaagacgcagctaccataaagttaccggtggatcagtacaggaagcagattggcaaacaagattacaaaaagactaaacccatcctgagagccacaaaactcaaagcggaggccaagaagacagccattggaatcaaggaagtcggactcgtattggctgcaattctagctctgctccttgcattttatgcattcttttatttaagacttacgacagacgtagaccctgacctagatcaggatgaggactag

SEQ ID NO: 25448 - DNA, 261 bp, Artificial Sequence
  Description of Artificial Sequence: Synthetic coding sequence
atgggtaggaaggatgccgcgaccatcaagttgccagttgaccagtacagaaagcagattggtaagcaagactacaaaaagacaaaacctatccttagggcaacaaaactgaaggccgaagccaagaagactgccattggtattaaggaagttgggcttgtacttgccgccattctggccctcctccttgctttttacgctttcttttaccttcggctgacaactgacgtcgacccggatctcgaccaggatgaagactag

SEQ ID NO: 25449 - DNA, 261 bp, Artificial Sequence
  Description of Artificial Sequence: Synthetic coding sequence
atgggtcgtaaggatgcagccaccattaaactgcctgttgaccagtatcggaaacagattggaaaacaggactataaaaagaccaagcccatccttagagccactaagttgaaagcagaggctaaaaagacagcgatcggcataaaggaagtaggcctggtgctcgctgccatcctggccctgttgctcgctttctatgccttcttttacctgagactgactacagacgtggatcctgatttagatcaggatgaagactag

SEQ ID NO: 25450 - DNA, 261 bp, Artificial Sequence
  Description of Artificial Sequence: Synthetic coding sequence
atgggacggaaggacgccgctactattaagctgccagtggatcagtaccgcaagcagatcggtaagcaggattacaagaaaacgaagccgatcttgcgcgcaacaaaactgaaggcggaggcaaagaaaaccgccattggcatcaaagaggtcggtctggtgcttgccgctattttagcgctcctgctggcgttctatgcattcttctacctgaggctgacaactgatgtggacccagacctggaccaggacgaagattag

SEQ ID NO: 25451 - DNA, 261 bp, Artificial Sequence
  Description of Artificial Sequence: Synthetic coding sequence
atgggccgtaaagatgcagccacaattaagctgcctgttgatcagtatagaaagcagatcggcaagcaggattacaaaaagaccaaaccaatcttgcgggccacaaaattgaaggccgaagccaagaagaccgctattggtataaaggaagttgggctggtgttggcggcgatcctcgctctcttgctggcattttacgcttttttttacttgagactcaccactgacgtggatcctgacctggaccaggatgaggactag

SEQ ID NO: 25452 - DNA, 27 bp, Artificial Sequence
  Description of Artificial Sequence: Synthetic coding sequence
atgggaaggaaggacgccgctacatag

SEQ ID NO: 25453 - DNA, 261 bp, Artificial Sequence
  Description of Artificial Sequence: Synthetic coding sequence
atgggccggaaagacgccgcaaccataaaattaccggtagatcagtaccggaagcagatcgggaagcaggactacaagaaaaccaaacctattctccgggccactaagctgaaggcggaagcaaagaaaacagctataggtattaaggaagtcggactggtgctggcagcgattctggctttgctgctggctttttatgcatttttctatctgcgtctaaccaccgacgttgaccccgatctggaccaggatgaagactag

SEQ ID NO: 25454 - DNA, 261 bp, Artificial Sequence
  Description of Artificial Sequence: Synthetic coding sequence
atggggcggaaggacgccgccaccatcaaactgcctgtggaccaatacagaaaacagatcggtaagcaggattacaaaaagaccaagccgattcttcgagctacgaagttaaaagccgaagcaaaaaaaactgcaatcggaatcaaggaagtcggcttggttctagcagcaattttggccctattgttagccttctacgcatttttttacctccgcttgacgacagatgtagatccagaccttgaccaggatgaagattag

SEQ ID NO: 25455 - DNA, 384 bp, Artificial Sequence
  Description of Artificial Sequence: Synthetic coding sequence
atgaactttatcttattcatctttattcccggcgtgtttagtctgaagtcctccactctcaagcccaccatcgaagccctgccaaatgtcctgccactaaatgaagacgtcaacaagcaggaggagaagaacgaggatcacacgcccaattacgcaccagctaacgagaagaatggcaattactacaaggatatcaaacagtatgtcttcaccacccagaacccgaacgggaccgagagtgagatatcagttcgcgcaacaaccgacctcaattttgctctcaaaaacgacaaaaccgtgaatgccaccacctatgagaagtccaccatcgaagaagagacaacaacctctgagcctagtcacaagaatatccaaagcatttag

SEQ ID NO: 25456 - DNA, 885 bp, Artificial Sequence
  Description of Artificial Sequence: Synthetic coding sequence
atgaacttcatccttttcatatttattcctggcgtgtttagcctcaagtcttcgacattgaaaccaacaattgaggctctgccaaacgtgctcccgctgaatgaggacgtgaacaagcaggaagagaaaaatgaagatcacactcctaattacgcccctgcaaatgagaaaaatggtaactattacaaggacattaaacagtatgtcttcaccacacagaatcctaacgggacagaatccgaaatttccgtgcgcgcgacaacagatttgaatttcgctctgaagaacgataagaccgtgaacgctaccacctatgaaaagtccaccattgaagaggagacaacaacgtccgaacccagccataagaatatccagcgctccacacctaatgtcccagccttctggacaatgctcgcaaaggccataaatggcactgctgtagtcatggatgataaggaccagctttttcatcccatccccgagtcggacgtcaacgccacccaaggcgagaatcagccagacctggaggatctgaaaatcaagattatgctaggaatctcgctcatgaccttgctgctctttgtagtgctgttggccttctgttccgccacactttacaagctccgccacttgagctacaaaagttgcgagtcccagtattctgtgaatccagagctcgccaccatgagctactttcatcccagtgaaggggtttccgatacttccttcagcaaaagtgctgaatccagcacctttctgggcacgacatcatctgatatgcgaaggtctgggaccagaacaagtgagagcaagatcatgacagatattatttcaattggcagcgacaatgagatgcacgagaatgatgagtcagtgacccgctag

SEQ ID NO: 25457 - DNA, 798 bp, Artificial Sequence
  Description of Artificial Sequence: Synthetic coding sequence
atgaactttatcctgttcatattcattccaggcgtcttctccctgaagtcttcgacactaaaacctaccatcgaagccctgccaaatgtactcccactgaatgaagatgtcaataaacaggaagagaagaatgaagatcatacacccaattacgctccagcgaatgagaagaatggaaactattacaaagacattaagcagtacgtcttcacgacccagaatcccaacgggaccgagtcagaaataagtgtgcgcgccactaccgacctgaactttgccctgaagaacgggtcaacccccaatgttccggcattctggaccatgctggcaaaggcgatcaacggaactgctgtggtgatggacgataaagaccaattgtttcaccccattcctgagtctgacgtaaatgcaactcaaggagaaaaccagccagatctcgaggacctgaaaataaagattatgctgggtatttcccttatgacccttttactgtttgttgtccttctagccttctgctcagcaaccttgtataagctgagacatctgtcgtataagagctgtgagtctcagtattctgtcaatcccgagttagccactatgtcatacttccatccctctgaaggagtgtccgacacatctttctctaagagtgcggaatcctctacctttctgggaacgacttctagcgacatgagacgctcgggtacgaggacatcggaatctaaaataatgaccgacatcatcagtatcggcagcgataacgagatgcacgagaatgatgagtctgtgactcgatag

SEQ ID NO: 25458 - DNA, 339 bp, Artificial Sequence
  Description of Artificial Sequence: Synthetic coding sequence
atgggtagtagactctctcagccctttgaatcttacatcaccgccccaccagggaccgctgcggctcctgcaaagcccgcgccaccggctactcccggagctcctacgagccccgctgagcaccggcttctgaaaacatgttggtcctgcagagtcctgagcgggcttggtctgatgggggccgggggttacgtgtactgggtggcacgaaagcctatgaagatgggctacccgcctagcccctggacaatcacgcagatggtgattggcctcagcatcgcaacgtgggggattgtcgtgatggcagatccaaaaggcaaggcatatagagtggtgtag

SEQ ID NO: 25459 - DNA, 1212 bp, Artificial Sequence
  Description of Artificial Sequence: Synthetic coding sequence
atgtccacttctacgagccccgcggcaatgttgttgcgacgcctacgaaggctgagctggggtagtacagcagtccagttattcattttgaccgtggttactttcgggctgctggcccctcttgcgtgccacaggcttctgcattcttacttctaccttagacattggcacttaaaccaaatgagccaagagtttctccaacagtcactgaaagagggggaggccgccctgcattatttcgaagagctgccatctgccaatggctccgtgcctatcgtgtggcaggccacccctaggccctggctggttattactatcatcaccgtcgacagacaacctgggttccactatgtcctgcaggttgttagtcaattccacagactattgcaacaatgcggtcctcaatgcgaggggcatcagctgtttctgtgcaacgtggaacgaagtgtctcccactttgatgccaagttgctgtctaagtatgttcctgtcgctaatagatacgaaggaacagaggacgactacggggatgatcccagtaccaacagcttcgaaaaggaaaagcaggattacgtatattgcctggagagcagcctacaaacctacaatcccgattatgttctgatggtagaggacgatgccgtgccagaggagcagatctttcctgtgcttgaacatctgctgcgcgctagattcagcgaacctcaccttagggatgcactctacttaaagctatatcatccagaaagactccaacactacatcaatccagaacccatgcgaattttagaatgggttggagtgggaatgctgctcggccctcttctgacctggatttacatgaggtttgcctccagaccgggtttttcttggccagtgatgctctttttctctctatattcaatgggtctcgtggaactcgtgggccggcactattttctggaactgcgcagattgagccccagcttatatagtgtagtgccggccagccaatgctgcacacccgccatgctgttccctgcccctgctgcccgcaggaccctcacctacctttctcaggtctattgccataagggcttcggcaaggatatggctctctacagccttttaagagccaagggcgaacgcgcttacgtcgtagaacctaacctggttaaacacattgggttattctcttcactgcgctacaactttcaccctagtctgctgtag

SEQ ID NO: 25460 - DNA, 1212 bp, Artificial Sequence
  Description of Artificial Sequence: Synthetic coding sequence
atgagcaccagtacctcaccagcagctatgctgctacgacggctgcggaggttgagctggggaagcacagccgttcagctgttcatcctgacagtggtgactttcggcctcctcgcacctcttgcctgccaccggctgctgcattcctacttctacctccggcactggcacctgaaccaaatgtcacaggagttcctgcaacagagtctgaaggaaggagaggccgcccttcattatttcgaggagctcccctccgctaatggctcagttcctatagtctggcaggctacaccccggccatggctagtcatcaccataatcacagtcgacagacaaccaggtttccactatgtcctgcaagtcgtaagtcagtttcatcgccttttgcagcagtgtggtcctcagtgcgaaggccatcaattatttctgtgcaatgtggaaagaagtgtgtcacacttcgatgctaagctcctgtcgaaatacgtgcccgtggcaaacagatatgagggtactgaagatgactatggagacgatccgagtaccaatagctttgaaaaggagaagcaggattatgtgtattgtcttgagtcaagccttcagacttataaccctgattacgtgttaatggtagaggacgacgccgtgccagaagagcagatctttcccgtcctggagcatctgctgcgcgcgagattctccgaaccccacctccgggacgctttgtacctcaagctttaccatcccgaaaggttgcagcattatattaatcctgaaccaatgagaatacttgaatgggtgggcgtgggaatgctgctagggcctcttttgacttggatttatatgcgctttgcctctcgccctggctttagttggcctgtaatgctattctttagtctctattccatggggctggtggaattagtgggcaggcattacttcctggagcttcggcgcctgtcaccctcattgtacagtgtggtccccgcttcccagtgttgtacacccgccatgctgttcccagctcccgccgcaagacggactctgacatatctgtctcaagtctattgccacaagggttttggcaaagatatggctttgtatagtttgctgcgggctaaaggggaacgggcctacgtggtggaaccaaacctggtgaaacatatagggctgttcagctccttgcggtacaatttccacccaagcctcctgtag

SEQ ID NO: 25461 - DNA, 1212 bp, Artificial Sequence
  Description of Artificial Sequence: Synthetic coding sequence
atgagcacgtctaccagccctgcagctatgctgctacggcggctacgccgattaagttggggctccactgccgtgcagttgtttattcttaccgttgtgactttcgggttgcttgcccccctcgcttgtcaccgcctgttacattcctatttctacctgcgacactggcatttaaaccagatgagccaagagtttttacaacagtctcttaaggagggagaggccgccctgcactatttcgaggagcttccctcggccaacggctctgtacccattgtctggcaggccactcctcgcccctggttggtcatcacaataatcaccgttgatagacagcctggcttccattatgtgctgcaggtggtctctcagtttcataggctcctgcaacaatgtggcccccagtgtgagggacaccagttattcctctgcaatgtggagcgatcagtgagccatttcgacgcaaaattacttagcaagtatgtgcctgttgcaaaccgctacgagggcactgaagatgactacggcgacgatccctctaccaactcgttcgaaaaagaaaagcaggactacgtatattgccttgaatcctcactgcagacttataaccctgactacgtgctcatggtggaagatgacgccgtgcctgaggaacaaatcttccccgtgctggagcatctcctgcgcgcccggttctcagagccacacctccgggatgcgctttacctaaagctgtaccacccggagagactgcagcactacatcaaccccgaacctatgcgcattctggagtgggtaggggtgggcatgttgctcggtcctctcctgacctggatctatatgcggtttgcatctcgaccaggcttctcatggccagtcatgctattcttctctttatattctatgggcttggtggagctggtcggccgccactactttctggaacttagacgcttatcgcccagcctctacagcgtcgtgcctgctagccagtgctgcaccccagcaatgctcttcccagcccccgccgccaggcgcacactgacatacctgagccaggtttactgccacaaaggatttggaaaagatatggccttgtacagcttgttgcgggccaaaggagaacgtgcttacgtggtagaaccgaaccttgtgaagcacataggattattttcatctcttcgctacaatttccatccctccctgttgtag

SEQ ID NO: 25462 - DNA, 690 bp, Artificial Sequence
  Description of Artificial Sequence: Synthetic coding sequence
atggacagtctggaccggtcttgtcaggactggtgtgatcgcaagcagcactggctggaaattggacctccagatcttgtcgagcgcaaaggatcactgaccctaaggtcccaccacaagaaatactcaaaaccagtgctggtgtacagctggcatcgggaccgggaagcctttcctaagggctacgatatcgaggggccagagaaggtgaaaaaactctgtaactcgacctatcgcagactcgggaccgacgagtcaccgatatggacatctgagacacatgagaaactttcccagatgtgtcttaacactgagtgggtagagatgaagagtaaagcccttctgaacgaggagaccgtctctagtgggatcatagagcgagtaactggactgcctgcaacgggattcggagcggtatttcccaggcacccccctgattggtctaagatgtgtgcccttacaacctactccgaagactacgtgcctccttatgattatcagccacatgcctacccttgccaggatgactactctatagtgcaccgcaagtgccgttcacagttcaccgacttgaatgggtctaagaggttcggtattaacacatggcatgacgagagcgggatctatgcaaactctgacgtgaagcagaagctgtatcccttgacctccggtcccatcgtacctatttag

SEQ ID NO: 25463 - DNA, 1272 bp, Artificial Sequence
  Description of Artificial Sequence: Synthetic coding sequence
atggaccgcggccagcctagcctggaacccgcagctgctgctccacgcgcgtctgggcgttgcgtcatcgctcctgtcagagccgtgctaagactgcgccgaagagtgtgtgtgctgagaaagcggagattgttgcaaccgggcggggggcccgacgtcggtactggggccccacgccccggctgcagccctcgcgccccaagagcagacctggaccaacctaagttttttacttttgactccccagcggagttaccgtcccgcaccccccgaaaaaaacggagaaggtctaggttggtcctgtatcccgagacctcgagaaaataccgccctagggtcgagcataggagtcgagcccagaggtgtctgctgctgttagtggccattgttggttttcaggtgctcaacgccattgaaaacctcgacgacaatgctcaaagatacgatttagatggtctcgaaaaggcactacaaagggctgtgttcggccagcctgctgcagtgagtaggattgtagcccttatgagagattacctcgccacacacgtgcatagtcgtcccctgcttttggctctgcatggcccgtccggcgtgggtaaatcacatgtggggcgactactcgctcggcattttcgctcagtgttggaagactcggcactggttctccagtaccatgcccgacaccactgtccagaagcacgggccgctcaagactgtcgcgaggaactggcccggagggtcgctgatgtcgtggctcgggcagaggccgaggagaagacacctctgctggtgctcgacgatgtggagctcatgccgcgcccgctgctcgatgagctgcatggattcctgcagccacaacggtctcatcacttccataacgctatttatgtcctgctgtcgggtgcgggcggtgcagaggttaccagattcgtcctccagaatgcctccagggctctacctttgcggcccgatggttttcgatcagccgaggccgccgctgcccaggctgaagaagatctgcgagcgagccttctcgcagttcttagtcgggagcaccccttgtggcaggcagccgcgatcgtccccttcctgttgctcgataagcgagacgtggtgagttgctttagggacgagatggcaggtgagggcttcttccctgatcaggcaagggcagagaatctggcagcccagctctcgttctacagggttgctggccgtgagttcgctgtgacaggctgcaagcaggtggttgccacggtgaatttattgtag

SEQ ID NO: 25464 - DNA, 4941 bp, Artificial Sequence
  Description of Artificial Sequence: Synthetic coding sequence
atgtggcacgggaatcatgtgcagccgggggccacccaccgtccaaatcagggattggagatgttacaaggattggggatcggcatgaaggccttccataattttaactattttctgtttttttataatgttctcctcggccttggggcctgcctctccaggctgctaatctcctgtctgctcggcatgtggctgatcgctaggattgacagaaccattatgcagtccggatatgaaggagccgacatgggtttctctgcctggattggcatgctctacatggaccattaccatatcaaccccgtactggtcagcttttgtcatattctgattacgaatcaccgggaaaaaaaactacagcagagtaccaaatactggtgtcttaaccagtccgcagagtccctgcgaatctgtgcaatgaggggcggcgagaatagaccacccgctcgagtgcagagctcctccgaagagctggaactgcgccatcagagcttggacgcatttccagggaggcgattgcctggacgaggcattcagccagccgctaagatgagcagcgtgggtaaagtgactcaagtacctaacgggaaggcctatcagcaaattttccaggcagaggtgcagcttgtccacagcttggctgcaactcgtaaaagagcggccgagaggtctgtgactttgaaatccggcaggattcctatgatgaaaaaagtcgagactcctgaaggggaagtcatgtctcctcggcagcagaaatggatgcattcactgcccaacgattggataatggagaatcctgtgctccatcgggaaaaggagcgcgcgaagcgagaaaaagcacgagagtccgagaacactatcgcagccagggaggtgcggggtctgatggacaccatcgtaccggaaaagatttcaacaagtacgtttcagcgacaggctgaacataaacggaaatcctatgagtccgctttggctagctttcaggaggagatcgcccaggtgggtaaggagatggaaccattaatcgtggataccggtggattgttcctgaaaaaactgacggagtcggacgaagagatgaatcgactctttctcaaagtagagaacgacaccaacctggaagactatacgatccaggctcttctggaattgtgggataaagtcgctggcaggctgctcctgagaaagcaggagattaaagagctcgacgaggccttacactccctggagtttagtagaactgacaaactgaaaagtgttctgaaaaagtatgcagaggttattgaaaaaaccagctatctaatgcgccccgaagtctatcggctaattaacgaagaggctatggtcatgaattatgccttactgggcaataggaaagctcttgcccagctctttgtgaacctaatggaatcgacactgcagcaagagctagactcaagacataggtggcaaggtctggtcgatacatggaaggctctgaagaaagaggccttgttgcaaagtttctctgaattcatggcaagcgagtccatccacactccccctgccgtgactaaagagctggaagtgatgcttaaaacgcagaacgtcctacagcagaggagactgaagcatctttgcactatctgtgacctactcccaccatcatatagcaagactcagctgaccgagtggcacagctccctgaatagccttaataaggagctggacacgtaccatgtcgattgcatgatgaggattcggctcctatatgagaagacctggcaggagtgcctaatgcatgtgcaaaactgtaagaagcaattattggattggaaagcattcacagaagaagaggccgagacacttgtgaatcagttctttttccagatggtgggggctctgcaaggtaaggttgaggaagatctcgagcttttggataaatcattcgagactctcgctgatcagaccgaatggcagagctcccatctgttcaagtatttccaggaagtggtccagctctgggaggctcaccaatcggaactccttgtccaggagttggaacttgaaaaacgcatggaacagcacaggcagaaacacagtcttgaatcacaagtccaggaagcgcacctcgaccggttgctagatcagctgcgacagcagagtgacaaagagactcttgcttttcacctggagaaggtaaaggattatcttaagaacatgaaaagcagatacgagtgtttccatacgctgctgaccaaggaagtgatggagtacccagccattatgctcaaggagctcaactcttatagctccgcactctcgcagtacttttttgtgcgagagatcttcgaacagaacctagccggcgaggtgattttcaagtttcggcaacctgaggctcacgagaaacctagtcagaagcgagtgaaaaagctccggaagaagcaaggaagcaaagaggatatgactaggagtgaagaatccatctctagcgggacgtccaccgctagatcagtcgaggaggtggaggaggagaacgaccaagaaatggagagcttcatcacagaggaagtcctcggtcaacagaagaaatctcctctgcatgctaaaatggatgagagcaaagagggctctatccagggcctggaggaaatgcaggtggaaagggagggctccctgaacccatccctgaatgaggaaaatgtgaaggggcaaggcgaaaagaaggaagagagcgaagaagaagatgagaaggaggaagaggaagaagaagaaaagcttgaagaggagaaggaggaaaaggaagcccaggaggagcaggagagccttagcgtgggtgaagaagaggacaaagaagaggggcttgaggagatctactacgaagacatggagtctttcacgatctccagtggaaacacttacttcgtatttgtgccactggaggaagagcattgtcgcaaatctcactcaaccttttctgccatgtttattaacgacacttctagcgccaagtttatagagcaggtcacaatcccctccaggctcatactcgagattaaaaagcaattatttagtgagggagggaatttctctcccaaggaaattaactccctttgcagccggctggagaaagaagcggctcggatcgagcttgttgagagtgtgattatgcttaatatggaaaaactcgaaaacgaatacctcgatcaagctaatgacgtcatcaacaaatttgagagcaagttccataacctttccgtggacctcatcttcattgaaaagatccagagactcctcaccaacttacaggtcaaaatcaagtgtcaagtggcgaaatccaatagccagacaaatggcctgaactttagcctccagcaactgcagaacaagattaaaacgtgccaggaaagtcgcggagaaaaaacaactgttacgacagaagagctgctctccttcgttcagacttggaaagaaaagctgtcccagcggatccaatacctgaattgctccctcgatcgggttagcatgactgagctcgtatttacaaacaccatcctcaaggaccaggaggaggatagcgatattttgacatcgtccgaggcgctggaagaagaagcaaagctcgacgtagtgactcccgaaagtttcactcaactctctcgggtaggaaaacccctcatagaggaccctgcagttgatgtaatcaggaagttgctgcagctacccaataccaagtggcccacgcatcactgcgacaaggaccccagtcaaacgggatttaaaaggcatcgatgtcagcccgaaaactctgggaagaaggcagtgccatccgcgtccgccacatcagcgggcagtctacaaactactcacccccccctgtctcatagctttacgccacatcctaaacccaacaagatggagcggaagtaccgcgtgttgggtgataagccccctcccgcagcagaggactttaagggcattatcctgaccctactctgggagagctccgagaatctgttgaccgtggccgaagagttttatcgcaaagaaaaacggcccgtcacacgcccggattgcatgtgcgatacattcgatcagtgcgccgagaacatcagtaagaagatactagagtaccagagccaagcaaacaagtaccacaacagctgtctaatcgagctgagaatccagattcggagattcgaggagctcctcccacaagtgtgttggctcgtgatggaaaattttaaggagcaccactggaagaaattcttcacctccgtaaaggagatcaggggtcagtttgaggagcagcaaaaacggctggagaaaaggaaggataaaaatgcccaaaagctccatctgaacctggggcatccggttcactttcaagagatggaatctttgcacctcagcgaggaggaacggcaagaagagctggacagcatgattcggatgaacaaagagaagttggaagagtgtactcggcggaatgggcaggtgttcatcacgaatctcgcaacattcacagaaaagtttcttctgcaactagatgaagtcgtcaccatcgacgatgtgcaggtagcccggatggaacccccgaagcagaaactctcaatgctcatccgccgcaagctggcgggattgagcttgaaagaggaatcagaaaaacccctaattgaacgcggaagccgcaaatggcccgggattaagccaacggaggttactatccagaataaaattctccttcagcccacaagttctatctccactacgaaaaccacgctgggacacctggctgccgtcgaagcccgcgacgccgtttacctgaagtacctcgcgtcctttgaagaggagctcaagcggatacaggacgattgtactagccagatcaaggaggcccagcggtggaaggatagctggaagcaaagtctgcatacgatccagggcctgtacgtgtag

SEQ ID NO: 25465 - DNA, 5106 bp, Artificial Sequence
  Description of Artificial Sequence: Synthetic coding sequence
atgagggggggcgaaaacaggccaccggcaagagtgcagtcctcaagcgaagaactggaattgcgacaccaatctctggacgccttccctggccggagattgcctggccgtgggattcagcccgctgctaagatgtcctcggtcggtaaagtgacgcaggtccctaatggcaaagcatatcaacaaatcttccaggcagaagtacagctcgtgcattccctagccgccacccgcaagcgcgctgccgagcgcagcgtcacattgaagtccgggcgcatccccatgatgaaaaaagtggagaccccggagggcgaggttatgagcccacgacagcagaaatggatgcatagcctgcccaatgactggattatggagaacccagtattacatcgggagaaggaacgagccaagagagagaaagccagggaatctgagaatacaatcgcggcccgggaggtgagaggacttatggacactattgtccctgaaaaaattagcacctccacattccaacgccaagcagaacacaagagaaaaagttacgagtccgccttagcatcttttcaagaggagatagcccaggtagggaaagagatggagccactaatcgtcgacaccggggggctgttcctgaaaaagctcactgaatccgacgaggagatgaacagattgttcctgaaagtggagaatgatacaaatctcgaagactacactatccaggcactcttggaactatgggataaggtggccggtaggcttctgctaagaaagcaggaaattaaggagctcgatgaggctttgcactcgctcgaattttcgagaaccgacaaactgaagagcgtgcttaagaagtacgctgaggtgattgaaaaaacctcatacctgatgaggccagaggtctatagactgatcaacgaggaggcaatggtaatgaactacgcattgctcgggaacaggaaggccctcgctcaactgttcgttaacctcatggaaagtaccctgcagcaggagcttgattcccgtcacagatggcaagggttggtcgatacctggaaagcactgaaaaaggaagctctattgcagagcttctctgagttcatggcaagcgagtccatccacactccccccgcagttactaaggagctggaggtcatgcttaagacgcagaatgtgctgcaacagcgacggctcaagcacctttgtaccatctgcgacctccttccaccttcctattcgaagacccaacttacagaatggcactcctccctcaactcactgaataaggagctggatacgtaccacgtggactgtatgatgagaatccgattgctttatgagaagacctggcaagagtgcctgatgcatgtccagaattgtaagaagcagctcctagattggaaagcctttacagaggaggaggccgaaaccctagtgaatcagtttttctttcaaatggttggggctctgcagggtaaggtggaggaagacctggaactgttagataaatcttttgagacacttgcggaccaaactgaatggcagtcatctcaccttttcaagtacttccaggaagtggttcagctttgggaggcacaccaatccgagctgctggtccaggaactcgaactggagaagcgcatggagcagcatcggcagaagcattcactagaatctcaagtccaggaggcccacctggaccgccttctcgatcagctgaggcagcagtccgacaaggaaacactagcattccatcttgaaaaggtcaaagactacctcaaaaacatgaaaagcaggtacgagtgttttcacaccctcctcaccaaagaggtgatggagtatcctgccatcatgctgaaagagttaaatagttattccagtgcacttagccaatatttttttgttagggaaatctttgaacagaacctggccggcgaggttatcttcaaatttcggcagcccgaagcacatgagaaaccctcacagaagcgcgtaaagaagctgcggaagaaacaaggaagcaaagaggacatgactagatccgaggaaagcattagcagtggaacttctactgccaggtctgtcgaagaagtggaagaagagaacgaccaggaaatggagtccttcatcactgaagaggtcctggggcagcaaaaaaagagccccttgcatgccaagatggacgagtctaaggaagggtcaatacagggcctagaggagatgcaggtggagcgggagggatcactgaaccctagtctgaacgaggaaaacgtgaaggggcagggcgaaaagaaagaagaaagcgaagaagaggacgagaaggaggaagaggaagaagaggaaaagttggaggaggaaaaggaggagaaggaggcccaggaggagcaagagtctcttagcgtgggtgaggaggaggataaagaggagggactggaagagatctattacgaggacatggagtcttttacaatatcatcaggcaacacttattttgtcttcgtgccattagaggaggagcactgtaggaaatcccacagcacgtttagtgcgatgttcataaatgacacttcctcagctaaattcatcgaacaagtgactatcccatcacggcttatcctcgaaatcaaaaagcagctacgtgctggatttttcgaacacttggagaaatggttcgaccagtgtagcctgaatacaagggtaacagtggccacgaagattaatgaattggatagtgagctggaactgcatctccatctgcatcaaccccgtgctcagcagatcgagaaggacatccacaatgtacgcgcggctgagctcctccttcatcaggaacagctcgacagccactgtgccggggttaccgaaacgttgaaaaaaaagcgtctgatgttctgtcagttccaagaggaacagaatgttcgcagtaagaacttccggcttaagatctatgatatggagcacattttcctcaatgcaacacggtcccagaaattagtgacattaagcaacaccttacaccaggagctccttagctacgtggatgtgacacaggtgtcccttagaagcttcagacagtacttggaagagtccctgggtaagctaaggtacagtaacattgagttcataaagcactgccgcctgttctccgagggcggaaatttcagccccaaggaaatcaattcactgtgcagtaggctagagaaagaggctgcgcgcatagagttagttgaatccgtcattatgcttaatatggagaagttggagaacgagtatctggatcaggctaatgatgtgattaacaagttcgagtcaaaattccacaaccttagcgtcgatctgatcttcatagaaaagattcagcggctactgactaatctccaggttaagatcaagtgtcaagtggccaaatctaatagccaaacaaacggcctgaacttttccctgcagcagctgcaaaacaaaattaagacttgtcaggaatcccggggcgagaagactactgtcaccacagaagagctgctgtccttcgttcaaacctggaaggaaaaactgtcacagcgcatccaatacctcaactgtagcctggatcgcgtgagtatgacagagctggtctttactaacaccatcctaaaagatcaggaggaagactctgatatcctcacttcgagcgaagcacttgaagaggaagctaaactcgatgtggtgacccctgagtccttcacccagctgagccgagtgggcaagcctcttattgaagatccagccgtggacgtcatacgcaaattgctgcagttacccaacacaaagtggccaacccaccactgtgataaggacccatcacagaccgggcgcggtgcctgggcgtgtgggtcgagaggcagctccgaagccggagccgggggcgcagtgtgtagccctcccgttctgtgctcttgccctggcccaagcagccccaaaggattcaaacggcaccgctgccaacctgaaaacagcggtaaaaaagcggtgccctctgcatcagctaccagtgccggaagctttactccacacccaaagcccaataagatggagaggaagtatagggtcctgggggataagccacccccagccgccgaggacttcaagggaatcatcctcaccctcctgtgggaaagcagcgagaacctcctgacagttgcagaggagttctacagaaaggagaaacgaccggtgactcggccagactgtatgtgtgatactttcgaccagtgtgccgaaaacatatcgaagaaaatccttgaataccagtcccaggccaacaagtaccacaattcctgcttgatcgaactcaggatccagatcagaaggttcgaggagctgcttccccaggtttgttggctggttatggagaatttcaaagagcatcattggaaaaagttctttacttccgtgaaagagattcggggccaattcgaagaacagcagaagagacttgagaaaaggaaggacaagaacgcccagaagctgcacttaaacctggggcacccagtccactttcaggagatggagagtctgcacttgtcagaagaagaacggcaggaagagctggactctatgatacgtatgaacaaagaaaagctggaggagtgtaccaggaggaacgggcaagtgtttatcaccaacttggcgacctttaccgagaagttcttgttgcagctcgacgaggtggtgaccatcgatgacgtccaggtggcgcgcatggaaccccccaagcaaaagctcagtatgttgatccggcgtaaactggctgggctgtctcttaaagaggaatcagaaaagccactcattgagcggggctcccgcaagtggccgggtattaagcccactgaggtgacaatccagaacaagattcttctccagcctacttcgagcataagcacgacgaagacaactctgggacacctagctgccgtcgaagcgcgagatgcggtgtatctcaagtatctcgccagtttcgaggaggagctaaaacggattcaggatgactgcaccagccagatcaaagaagctcaacgatggaaagactcctggaagcagtctctacacacaattcaggggctgtatgtgtag

SEQ ID NO: 25466 - DNA, 663 bp, Artificial Sequence
  Description of Artificial Sequence: Synthetic coding sequence
atgtggcacgggaaccatgttcaacccggtgcaacccacagaccaaatcagggtctggaaatgttgcaagggttgggcataggcatcctaacaatctcaatcgtagtggggttaatgatcttacagatgtgcattgccgctagcttctttttacagcctaagctgggtactgctgataagcaaaagccacttgccctcaataatcgtaaagcctttcacaacttcaattacttcctgttcttttacaacgtgttgctcggattgggtgcatgtttgtccagacttttgatctcatgccttctgggcatgtggctcatagcaaggatcgaccggaccattatgcagtctggctatgagggggcagatatgggattttccgcctggatcggaatgctctacatggatcattaccatatcaaccctgtcttggtgagcttttgtcatatccttatcaccaatcaccgcgagaaaaagctgcagcagtccaccaaatattggtgtctcaatcagtctgccggacctcatgtctctgcacggtcccggacacggtggtttcttttgcagacgctcatcgataatccgcggcttactatgcacaggaagctcaaattggggcactcttcccaggaatcccagattctaatggcttgtagcgagtcttag

SEQ ID NO: 25467 - DNA, 2049 bp, Artificial Sequence
  Description of Artificial Sequence: Synthetic coding sequence
atgtggcacggcaatcacgtgcagccaggcgccacccataggcccaaccagggccttgagatgctgcaaggtctcggaatcggcatgaaggccttccacaattttaattattttttatttttttacaatgtacttctaggcttgggggcatgcctgtctcgtcttttgatatcatgtctcctcggtatgtggttaatcgcccgaatcgaccggactatcatgcagtcaggctatgagggtgcagatatggggtttagcgcatggataggcatgctctatatggaccactatcatataaatccagtcctggtctcattctgtcacattctgatcacaaaccatcgcgagaagaaactccagcagtcaacaaagtattggtgcttgaaccagtcagcagaaagcctgcgcatctgcgcaatgcgcggaggtgaaaatcggccccctgctagagtgcaatcgagttcagaagagctggagttgcggcaccaatcactcgatgcgttccctggacgcagactgccagggaggggtattcagcctgccgctaagatgagctcagtggggaaggtgacccaggtccccaatgggaaggcataccagcaaattttccaggctgaagtgcaacttgtacacagcctggcagcaacaagaaagagggcagcagagcggagcgttactctgaagagcggtaggatccccatgatgaagaaggtggagacgcctgagggggaagtgatgtcccctcgacagcaaaaatggatgcactcattacccaatgactggattatggaaaacccagtcctgcatcgggagaaagaaagagcaaaacgtgaaaaagcaagagagagcgagaacaccatagctgcgagggaggtaagggggctgatggatactatcgttcccgagaagattagcacatcaacttttcagagacaagccgagcacaaacgtaagtcttatgagtccgctctggcatccttccaggaggagatcgcccaggtgggaaaggagatggagccacttatcgtggatactggcggcttgttcctcaaaaagctaacggaaagcgatgaggaaatgaaccgtcttttcctgaaggtagagaatgacacaaacttggaggattataccatacaggcgctcctagaactgtgggacaaggtagcgggccgcctgctgctgagaaagcaggagatcaaagagctagatgaagcactccactctctagagttctcacggactgacaagctgaaatccgtactcaaaaaatacgccgaggttatcgaaaagaccagctacctcatgcgaccggaagtctaccggctgataaacgaggaggccatggtgatgaactatgccctccttggaaaccgtaaagctcttgctcagctgtttgtaaacctgatggaatcgacgctccagcaagagctagactctcgacaccggtggcaaggcctggttgacacttggaaggcgctgaaaaaagaagcattgctgcagagctttagtgatctgcttccgccttcctatagtaagactcagcttacagagtggcacagtagcctgaacagccttaataaggagcttgatacttatcatgtggattgtatgatgcggatcagactgctatatgagaagacatggcaggaatgccttatgcacgtccaaaattgcaagaaacagctgctcgattggaaggctttcactgaggaggaagccgaaacactcgtaaaccaatttttctttcagatggtcggcgccctgcagggaaaagtggaagaggatctggagctcttggacgtcagagctggtgattgcagtactggggagctgaggaacccgtctagactgtggcagatccgccaatcagggagagtacatacttcgtcctcaatttcgcggaggtggtataactgtgggcggcacacacgcgcctcttgttggtgtcggtcctggagctggcgtaggggctggagctccacgggccgctctacagcatggcgcgcaaggtgtaggagaccaacctctatcggctcatggaccaactag

SEQ ID NO: 25468 - DNA, 2712 bp, Artificial Sequence
  Description of Artificial Sequence: Synthetic coding sequence
atgcgaggcggtgagaaccgtccaccagccagagtgcaaagctccagtgaggagctcgaactgcgtcatcagagtctggatgcctttcccggaagaagacttccaggcagaggcatccagccagccgccaaaatgagctcagtaggcaaggtcactcaagttccaaacggcaaggcatatcagcagatcttccaggccgaggttcagctcgttcactccctggctgccacacgcaagagggccgccgagcgcagcgtcactctcaagagcggccgtatccctatgatgaaaaaggtcgagacccctgaaggagaggtgatgagtccgcggcagcagaaatggatgcatagtctaccaaatgattggattatggagaaccctgtactccaccgagaaaaagagcgcgcaaaaagagagaaagcgagggaatccgagaacaccatcgccgcccgcgaggtgaggggactcatggataccatcgtgccagaaaagatttctacaagtaccttccagaggcaggcagagcataagagaaagtcgtatgaatcagctttggcttcttttcaagaggagattgcacaagagatggagcccctaattgtagataccggcggcctcttcctgaaaaaactaactgagtccgatgaggaaatgaaccgcctttttctgaaagtcgagaatgacactaacttagaagattacaccatccaggcactcctagaactctgggacaaagtggccggccggctcctgctgcgaaagcaggaaatcaaggagctggatgaggctctgcactccctcgagttttctcgcactgataagctgaaatcagtgctgaaaaagtacgcggaagtaattgagaaaacctcatatttgatgcgcccagaggtttaccgacttatcaacgaagaggcaatggtaatgaattatgcccttttgggcaacaggaaggccctcgcacagctgttcgttaacttaatggaatccacacttcagcaggaactcgatagccgccacaggtggcaaggattagtcgacacttggaaggccctcaagaaggaagcccttcttcagagtttctcagagtttatggccagcgagtccatccacactccccctgcagtgactaaagaactggaagtcatgttgaaaactcagaacgttctgcagcaaaggaggctcaaacatctatgtacaatttgtgaccttctccccccttcatactccaaaacccagctgaccgagtggcactccagcctgaactcccttaacaaagagctcgacacctatcacgtggactgcatgatgcgaatacggctgctgtacgaaaaaacatggcaagaatgtctgatgcacgtgcagaactgtaaaaaacagctgctcgattggaaagcattcacagaggaggaggccgagaccctggtgaaccagttcttcttccagatggtgggcgccctgcaaggtaaggtggaagaagatctcgagctgttggataaatcttttgagacattagccgatcagactgagtggcaaagtagtcacctgttcaagtactttcaggaggtcgtccagctttgggaggcccatcagtctgagctgctcgttcaggaacttgagttggaaaaacgcatggagcaacacagacagaagcatagcctggaaagtcaggtgcaggaagcgcatctggaccgcctactcgaccagctcagacaacagtcggacaaagagaccttggcatttcatctggagaaggttaaggactatctcaaaaacatgaagtcccggtacgagtgttttcataccctacttactaaagaggtgatggagtatcccgccataatgctgaaggagcttaattcctacagttccgcactgagtcaatatttttttgtgagggagatcttcgagcagaatttagcaggcgaggttatttttaaattcagacagcctgaagcccatgaaaagccaagccagaagagggtcaaaaagctccggaaaaaacaaggctctaaagaggacatgaccagatcagaagagagtatctcttcaggcacatccactgctagatccgttgaagaagtggaagaggaaaacgaccaagaaatggaaagcttcatcacagaggaggtgctggggcagcagaagaaatctcccctgcacgcaaaaatggatgaatctaaggaaggatcaatccaggggctcgaagagatgcaggtggagcgtgaaggatctcttaatccaagtctgaatgaggagaacgtaaaaggtcagggagagaaaaaggaagagtctgaggaggaagacgagaaagaggaggaagaagaggaggagaagctggaggaggagaaagaagaaaaagaggcccaggaggagcaagaaagtctctccgtgggggaagaggaagataaggaggagggcctggaagagatatactacgaagatatggaatcgttcacaatctccagtgggaacacatatttcgtgttcgtccctctggaggaggaacactgccgcaagtcccactccactttttcagccatgttcattaatgatactagttcagccaagtttatcgagcaggtgactatacctagtcgccttatcctggaaatcaagaaacaccgcgcctggtggtgtgtgcccgtgattcccgctacccaagaggcggaggcaggtgagagccctgaacctaggagacggaggctgcagtag

SEQ ID NO: 25469 - DNA, 5106 bp, Artificial Sequence
  Description of Artificial Sequence: Synthetic coding sequence
atgcgcgggggagagaaccgaccccctgctcgtgtgcagtcatcctccgaagaactggagcttcgacaccagtccctcgacgcctttccgggtaggcgattgccaggtagaggcattcagccagccgctaaaatgtcttcagtcggcaaggtcacccaggttcccaacggaaaggcttatcagcagatctttcaggccgaagtgcaactcgtgcactccttagcagcgacgaggaagcgagctgcagagcggtcagtcacacttaagtctgggagaatccccatgatgaagaaagtagagacccccgagggcgaggttatgtcccctcgacagcagaagtggatgcactcactgcctaatgattggattatggagaaccctgttctgcaccgagagaaagaaagggcaaaacgggagaaggcccgggaatcggaaaacacaatcgccgcgcgggaggttcggggcctgatggataccatagtcccagagaagatatccacatcaaccttccagaggcaagccgagcacaagcggaaatcatacgagagtgctctggccagcttccaagaagaaattgcacaggtcggtaaggaaatggaacctttgattgttgatactgggggcttgttcctaaagaagttaactgagagcgacgaagaaatgaatcgactttttctgaaggtggaaaatgatactaatctggaagattatactatacaggccctgctggaattgtgggataaggtagccggacgtctcctcctgagaaagcaagagataaaagagctggacgaagccttgcatagcctggagtttagccggacagacaaattgaaatctgtcctgaagaaatacgctgaagttatcgagaaaacatcttatttaatgaggcccgaagtgtacagattgattaacgaggaagctatggttatgaattatgctttactcggcaaccgcaaggctctggcccagctcttcgtaaatctgatggagagcacgctccagcaggaactggactctaggcatagatggcaaggcctagtcgacacatggaaggctctgaagaaggaagccctcctgcagagcttctcggagttcatggccagcgagtcaattcacacgccacctgcagtgaccaaagagctcgaagtcatgttaaagacacaaaatgtgctccagcagcggcgcctgaagcatctatgtaccatttgcgatcttctcccaccaagctacagcaagacccagctgactgaatggcattcatccctgaacagcctgaacaaggaactggacacctatcacgttgactgtatgatgaggatcaggctgctgtacgagaagacatggcaggaatgtctcatgcatgtgcagaactgcaagaaacagttgcttgactggaaggcatttaccgaggaagaggccgaaaccttagtaaatcagttcttctttcaaatggtaggggctttacagggtaaagtcgaggaagacctggaattactggataagagctttgaaacgttggcagaccagacagagtggcagtcctcacacctttttaagtactttcaggaggttgtccagctatgggaggcccatcagtccgagcttctagtgcaggaactggagttggagaagcggatggagcaacaccgccagaagcattccctcgagtctcaggtgcaagaggctcacctggaccggctcttagatcaattgcgacagcagagcgacaaggagacactggcctttcacctcgagaaggttaaggattaccttaagaatatgaagagcagatacgaatgcttccatacactgctgaccaaggaggtaatggaatatcctgctatcatgctgaaggaactaaacagctacagtagtgccctgtcccaatacttcttcgtgagggagatttttgagcagaatctggcgggtgaagtaatttttaagttcagacagccggaggcacacgagaagccctcgcagaagagggtgaagaaactccggaaaaagcagggttctaaagaagatatgaccagatcagaagagtccatttccagtggtacaagcaccgctcgctccgttgaggaggtagaggaggaaaacgaccaggagatggaatcctttatcactgaagaggtgctgggccagcagaaaaaatctccgctacacgccaaaatggacgagtccaaagagggctccatccagggcttggaagaaatgcaggtcgagagggagggctcactgaatccatccctcaacgaagagaatgtgaagggccaaggggagaagaaagaagagtcagaggaggaagacgagaaggaagaggaagaagaagaagaaaagctggaggaagagaaagaggaaaaggaggctcaagaggagcaggagtccttatcggtcggggaggaagaggacaaggaagagggactcgaggaaatttactacgaggatatggaatcctttaccatcagttcgggaaacacatacttcgtgttcgtccctctcgaggaagagcattgtagaaaatctcactctacttttagcgcaatgtttattaacgacacgagcagtgctaaatttatcgagcaggtgaccatccctagcagactcatcctggagatcaagaagcagttgagagcaggctttttcgaacatttagaaaaatggtttgaccagtgttccctaaatacacgcgtgaccgtggctaccaaaattaatgaactggacagcgaactagagctgcacctgcacctacaccagccaagggctcagcaaatagaaaaggacatccacaatgtgagggcagctgaactcttactccaccaggagcaacttgacagccactgcgccggcgtcaccgaaacccttaagaagaagaggttaatgttttgtcaattccaggaggaacagaatgtgcggtccaagaactttaggctcaagatctacgatatggagcatatcttcctcaatgcgacacgcagccagaagttagtgaccctttcaaatacgttgcaccaagagctgctgtcctacgtggatgtgactcaggtgtcgttgcgctcatttcggcagtacctcgaagagagtttaggcaagctgagatattcaaatattgagttcataaagcattgtagattgttctctgagggaggcaacttctctccaaaggagatcaacagcctgtgttcccggctcgagaaggaagcagctagaatcgaactggttgaatctgtgatcatgctgaatatggaaaagctcgagaatgagtatctggaccaggctaacgatgtgataaacaagttcgagagcaaatttcacaacctgtctgtggacctaatattcatcgagaagatccagagactcctcaccaacctgcaagttaagattaagtgtcaggtggccaagtcgaatagccagacaaatggtctgaattttagcctccagcagctccagaacaagatcaagacctgtcaggagtcacggggggagaaaaccacagtcaccacagaggagcttttgagcttcgtgcagacctggaaagaaaagctgtcccagcgcattcagtaccttaattgttctctggatcgcgtgagcatgaccgagcttgtgtttactaacactatcctcaaagaccaagaggaggactccgacatccttacatcatcagaagcactcgaggaagaggccaaactagacgttgtgacgcccgagtctttcactcaactgtcacgtgtagggaaacccttgatagaggatcctgccgtggatgtgatccgcaagctgctgcaacttcctaacaccaagtggcctacccaccattgcgacaaggacccctcccaaactggcagaggagcatgggcctgcggatcacgcgggtcttcggaagccggagccggtggggccgtgtgctcaccacccgtgctgtgctcctgccccgggccatcctctcccaaagggttcaaaagacaccgctgtcaacctgaaaacagtggtaagaaagcggtccctagcgctagcgcaacttcagcggggtcctttacaccacatccaaagcccaacaagatggagaggaaataccgcgtactgggagacaagccgccacccgcggctgaagatttcaagggcattattctcactttgctctgggaatctagcgaaaacctgctgacagtggccgaagagttctaccgaaaggagaagaggcccgtcactcggcccgactgcatgtgtgatacatttgaccagtgtgctgaaaacatttctaagaaaatcctcgaataccagtcccaagccaacaaatatcataactcctgtctgattgagctaagaatccaaattcggcggtttgaagaattgctgcctcaagtgtgttggctggtgatggagaacttcaaggaacaccactggaagaagttctttaccagcgttaaggaaattagggggcagtttgaagagcagcagaagagactcgagaagagaaaagataagaatgcacagaagttgcacttaaacctaggccaccccgtgcacttccaagaaatggagagcctgcatctgagcgaagaagagaggcaagaggagctggactccatgatcaggatgaacaaagaaaagctggaagagtgcactaggagaaatggacaggtgttcatcacaaacctcgccacattcactgaaaagtttctcctgcagctggatgaggttgtcacaatcgatgatgtgcaggtggcccggatggaaccaccaaagcagaaactttcaatgctcattagaagaaagttggccgggctcagtcttaaggaagaatcggagaaaccgctcattgagcgtggctctcgaaagtggcccgggattaagcccactgaggtcaccattcagaataagatcctccttcagcccaccagtagtatctccacgacaaagactaccctcggccatttggccgccgtggaagctagagacgcggtctacctgaagtacctggctagctttgaggaagagctgaaacgaatacaggacgactgtacttctcaaataaaggaggcacagcgatggaaagacagctggaaacaatcgctgcacactatccagggactttatgtttag

SEQ ID NO: 25470 - DNA, 2700 bp, Artificial Sequence
  Description of Artificial Sequence: Synthetic coding sequence
gggcggccagccgccgtggtcgctgggccagctctggcagcactgcgagaaagcctgcggatttgtgctatgagaggaggggagaaccggcctccagcccgtgttcagtccagctcagaggaactggagcttaggcatcagagcctcgacgccttccccgggagacggctccctggacgaggcattcagcccgccgctaagatgtcatccgtgggaaaagtgacccaagtgcccaatggtaaggcctatcagcagatttttcaggcagaggtgcagctcgtgcatagccttgcggccacacgaaaaagagctgctgaacgctctgtcaccctaaaaagtggcaggatccctatgatgaagaaggtagagacgcccgagggtgaagtcatgtctccaaggcagcaaaagtggatgcacagcctcccaaacgactggattatggaaaaccccgtgctgcatagagagaaggagcgcgcaaagcgcgagaaggctcgcgagtctgagaacacaattgcagcccgggaggtgcgaggactcatggatacaatcgttccagagaagatctccacttctacctttcagaggcaggccgaacacaagcgtaaaagctatgagagcgctcttgcctcgttccaggaggaaattgcccaagtaggtaaggagatggaacccctaattgtcgacaccggcgggctgtttttaaagaaactgacagagtccgacgaggagatgaaccgtttgtttctgaaagtagaaaacgacaccaatctggaagactacacaattcaggccctgttggagctgtgggataaggttgctgggcggttactgctgagaaaacaggaaattaaggagcttgatgaagcgctgcacagtcttgagtttagtagaaccgataaattaaagagtgtgcttaagaagtacgctgaggtgatagagaaaacctcttacttgatgaggcctgaggtctaccgactcatcaacgaggaagcgatggtcatgaattatgccctgttgggcaatagaaaggcattggctcagctcttcgtgaacctcatggaaagtaccctgcagcaggaactcgacagtcgtcataggtggcagggattggtcgatacatggaaagctctgaagaaagaagcactcctccaaagcttttcagaatttatggcctcggagagcattcatacgccaccggccgtaaccaaggaactggaagtcatgctgaaaacgcaaaatgtgctgcaacagcgccggctgaagcacctgtgcaccatctgtgacctgctgccaccaagctactcaaagacgcagctaaccgaatggcatagctctctaaactctttgaataaggagctggacacatatcatgtggactgtatgatgcggatccgactactttacgaaaagacctggcaggaatgtctgatgcacgtacaaaactgcaagaagcagcttctagactggaaggcctttaccgaggaagaggccgagaccctggttaaccagtttttctttcagatggtgggggcgctgcagggaaaggtggaggaagacctggagcttctcgataagagtttcgaaacgctagctgaccagacagaatggcagtcatctcatttgttcaagtatttccaagaggtcgtgcagctatgggaggctcaccagtccgagctcctggtgcaggaactggagctggaaaagcgtatggagcagcatcgccagaaacactcgctggagtcacaagtacaggaagcccacctggatcggctgttggaccagctcagacagcaatcagataaagagaccttagccttccacttggaaaaagttaaggactacctcaaaaatatgaagtcgcggtatgagtgcttccacactctgttaacaaaagaggtgatggaatatcccgccattatgctgaaagagctgaatagctattcttccgccctgtctcagtacttcttcgtgagagaaatcttcgaacagaacctggcgggcgaagtgatctttaaattccggcagcccgaagcacacgagaagccatcccagaaaagagtaaagaaactcaggaagaaacagggctccaaagaggatatgacgcggtccgaagaaagcatcagctcaggaacaagcaccgcccgctccgttgaagaagttgaagaagagaatgatcaagagatggaaagcttcatcactgaagaggtacttgggcaacaaaagaaaagccctctccacgcgaagatggacgaatcaaaggagggttccattcagggcctagaagaaatgcaggttgaaagagaggggtctctgaatcctagtctcaatgaagagaacgtgaagggtcaaggggaaaaaaaggaagaaagcgaggaggaggatgaaaaagaggaggaagaggaggaagaaaagctcgaagaagagaaggaagagaaagaggcgcaggaggagcaggagtctctatctgttggcgaggaagaagataaggaggaaggcctggaagagatctattatgaggacatggagtctttcactatttctagcggtaacacgtattttgtttttgtccctctggaggaggagcattgccggaaaagccacagcaccttctcagcaatgttcatcaacgacacatcttctgcaaaattcattgaacaggttaccatcccgtcccgcctgatactagagattaagaagtag

SEQ ID NO: 25471 - DNA, 585 bp, Artificial Sequence
  Description of Artificial Sequence: Synthetic coding sequence
atggcaaagcgccgcgctgccgaaccagtcacctttcacgtcccctggaagcggttgctgctgtgtgattttgccgagcagccaccaccgccgccgctgtggatccgtcctcctggtgtcgctcacgccggccagttgctgggcgttcctgagcagcaccggaagaggaagattgacgccgggacaatggctgagccatccgccagtcccagcaagagaagggactctggcgacaatagtgcccccagtggccaggagagggaggaccacggactggagacaggtgatcctccactgccccccccaccagttctacccggaccaggggaggagttgccaggggccaggctgcccggcgggggaggagacgacggtgctggcagggccggaccccccagaggcgattggggcgtcgcttccaggcagcataacgaagagttctggcaatacaatactttccaatactggcgcaacccattgcctccaattgacctggcagacatcgaggacctgtccgaggacacattgaccgaggcaactctgcaaggacgcaatgaaggggccgaagtcgatatggagtcttag

SEQ ID NO: 25472 - DNA, 558 bp, Artificial Sequence
  Description of Artificial Sequence: Synthetic coding sequence
atgccacgattgttcctttttcatctgttagagttttgtctcctgctgaaccagttcagtagagccgtggcagctaagtggaaagatgacgtgatcaagctttgcggacgagagctggtgagagcccaaatcgccatttgtggtatgagcacttggagcaagcgctctttaagccaggaagatgcgcctcagacaccacgacctgttgctgagatcgtcccatcgtttatcaacaaagacactgaaaccatcattattatgttggagtttatcgcaaacctaccgcccgagctgaaggctgctctgagtgaaaggcagccctctttacccgagttgcaacagtatgttccagccctcaaagatagcaatctgtcattcgaagagtttaaaaaactaatccgcaacaggcagtctgaagcagcggactcgaaccccagtgagctcaagtatctgggtctcgatacccactcccagaagaagaggagaccatacgttgctctgtttgagaagtgttgtctcatcgggtgcactaaaagatccctcgctaagtactgctag

SEQ ID NO: 25473 - DNA, 486 bp, Artificial Sequence
  Description of Artificial Sequence: Synthetic coding sequence
atgaaaaagattgagatcagtggcacatgcttgtcttttcatttactgttcggcctagagatccgcatgcgccgaattgtgttcgccggcgttatcttatttagactgctgggcgtgattctgtttcgtttgttaggagttatcttgtttgggagactaggggatcttggaacatgccagaccaagcctggccaatactggaaggaagaagtccacatccaggatgtaggaggattgatatgtcgtgcttgtaacttgtccttgccttttcacgggtgcctgttggacctgggcacttgccaggctgaacccggtcagtactgtaaagaggaagtgcacatccaaggcgggatacagtggtactccgtgaaggggtgcactaaaaatacgtcagagtgtttcaagtccacgctggtgaagagaattctgcaactgcacgagctggtgaccactcattgttgtaaccatagtctctgtaacttctag

SEQ ID NO: 25474 - DNA, 384 bp, Artificial Sequence
  Description of Artificial Sequence: Synthetic coding sequence
atgggcgttggctttaccgagctggaatacctcgctccgtggctgagacctccctttagcgaccttggcacctgccagacgaagcctggccagtattggaaagaagaggtgcatatccaggatgtgggaggcttgatttgccgggcatgcaacctttcgttgcctttccacggctgcttgctggatctggggacttgccaggccgagcctggtcagtattgtaaagaggaggtgcacatacagggcggtattcagtggtacagcgtaaagggctgcaccaagaatacatcagagtgtttcaaatcaaccctcgttaagcgaattcttcagttacacgagctggtgactacacactgctgcaatcattctttatgcaatttttag

SEQ ID NO: 25475 - DNA, 513 bp, Artificial Sequence
  Description of Artificial Sequence: Synthetic coding sequence
atgcaaaatcgaactgggctgatcctgtgtgctttggccctgctgatgggcttcctcatggtttgtctgggcgcattcttcatttcatgggggagcatttttgactgtcagggatctctgatcgccgcttatctgctcctgcctctgggcttcgtgatactgctgtcaggcatcttttggagcaattatcggcaagttacggaatccaaaggggtcctccggcatatgctacgccaacacctcgctcatggcgcccttcccgttgctacagttgatcggccagatttctatccccctgcctacgaggagtccctcgaagtggagaaacagagctgtccggctgagcgagaggccagtggcatccctcctcccctgtacaccgagacaggactcgaattccaggatgggaacgatagtcatccagaggctccaccttcctaccgagagtcaatcgctggcttagttgtaacagcgatctcagaggatgcacagaggcgcggtcaggaatgctag

SEQ ID NO: 25476 - DNA, 4338 bp, Artificial Sequence
  Description of Artificial Sequence: Synthetic coding sequence
atgggcaatctcgtgatccctctggggaaagggcgtgccgggcgggtggagtctggccagcgaattccgcctcccgctcctcgcccctctgtggaatgtacaggagacgatatcgctctacagatggaaaagatgctgtttcctcttaagtccccatcagcaacatggctgtcacccagctcgaccccctggatgatggattttatcctcacttctgtgtgtggactagtgctgctgtttttgctgcttttatacgtgcactccgaccctccttcaccacctcctgggcgaaagcggagctctcgggaaccacagcgggaacgctcaggtcgttcaagaagcaggaagatctcagctctgaaagcttgtcggatactgctgcgtgaactagaggagactagagacctgaattatctgcttgaaagccatctgcggaagttggccggagagggctcttcacatctgcctctcggaggcgatcctctgggggacgtctgcaagccggtccctgctaaagcccaccagcctcacgggaagtgcatgcaagatccttctcctgcctcccttagccctcctgcccctcccgcaccactggcttccaccctctctcccggaccaatgaccttcagcgaaccctttgggccacattctacgctgtctgcgtcaggcccgcctgaaccgcttctccccctgaaatgccccgcgacacagccccacgttgttttcccaccttctccccagccacatggccccttggcatcatctcctccccctcccgactcatccctggccggattgcagtgcggctctaccacgtgtccagttccgcaatccagtcctctccacaatcaggtactgccccccccaacccgcgttatatccggtctgggatgctctagcgacccgatctgggacctgtactgctggcgcgaggccgctaccacctggggcctgtccacttacagccacggaaaatcacaaccacgtcatctgcccgatcacaccagcgaagcatccttttggggggatcctacacccaagcacatggaagtgggtggatgcaccttcattcaccctgacgtacagaagctcctggaaactttgatcgctaagagagcactcatgaaaatgtggcaggagaaggagcgcaaaagagccgaccacccccatatgacttccctggggaaggagtgggacattaccaccctaaatcctttctggaatgtgagcacacaacctcagcagttaccccggccacagcaggtgtctgatgcaaccacggtgggaaaccatcttcagcaaaaacgctcccagctcttctgggacctgccatcactgaacagcgaatcgctagcaactacagtgtgggtgtcccgtaatccatcgagtcagaatgctcatagtgtgcctttggacaaggcaagcacttcactcccaggggaacccgaggtggaggcatcatctcagctaagccaagctcccccccaaccgcatcacatggcccagccccaacacttcacaccagcgtggccacaaagtcagccacctcccctggcggagatccagacccaggcccacctctctccgcctgtgccttcattaggctgctcatcacctcctcaaattcggggctgcggggcctcctaccccacatcacaggagcgcacacagtcggtgatccccacaggcaaagaatatctggagtggccactgaaaaagagacctaagtggaagagagtgttaccctctcttctgaagaagtcccaggctgtgctgtcacaaccaactgcacacttaccacaggagagacccgcctcctggagccctaaatccgccccaatccttccaggcgtggtgacgagccccgagctgcccgagcactggtggcagggccggaatgctatccatcaggagcagagctgtggacctcccagtcggttgcaggccagcggcgaccttcttcagcccgatggcgagtttccaggacgtccacagagtcaagctgaggacacacaacaggccttgctgccatcccaaccctctgactttgccggcaaggggcgcaaggacgttcagaaaaccgggttcagatcctcaggaaggttcagcgataaaggatgtctgggctccaagttgggccccgaccctagtcgcgatcagggcagtggtcggacatcagtaaaggctctagatgaagacaaggaggcagagggggatcttagacggtcttggaagtaccagagcgtgtcctccaccccacgggacccagacaaagagcatctcgagaataaattacagattcacctggcccggaaagtgggtgaaattaaggaagggtggatacccatgccggtcaggcgatcatggctgatggccaaatgtgctgtcccaaaatcggacactcatcgcaagcccgggaagttggcctcctggcggggcggtaaggcgcacgtcaacaccagtcaggagttgtctttcctgcacccctgtactcaacagattctggaagtgcacctcgtgcgcttctgcgtgcggcattcctggggcactgatctgcaatccctggagccgataaacgtatggagtggggaagcacaggcgccgccattcccccagtctacatttaccccttgggcctcctgggtgtccagagtggaatccgtgcccaaggtgcctattttcctgggaaagaggcctcagaatgggccgggggataacaggacgacttccaagtcagtccctaccgttagcggaccactagctgcccctccaccggagcaggagggcgttcagcgtcctcccaggggcagtcagtctgccgacacacacgggcgatccgaagcgtttccgaccggtcacaaaggtagaggatgctcgcagccccctacctgttcccttgttggacgcacttggcagagtagaaccgttctggaaagcggcaagcctaagcccaggttggaaggatccatgggcagcgagatggctgggaatgaggcctggctcgagagtgaaagcatgtcccccggagatccctgttcgtctagagccttacaggtactgagcatcgggagccagtgggctcgcgctgaggacgctcttcaggctttaaaggttggtgagaagccccccacatgggaggtgaccctcggagcatcagtgcgtgcctctagtgggagcgtgcaggaggacctccggtcaaccggcgcccttgggacaaccgggaacccctcagcctcatctgtgtgcgtggctcaagatccagaacagcttcacctgaaggctcaggttgtttcagaaattgccttgatcgtccaggttgattctgaggagcagctgccaggtcgcgctccaggtatcctccttcaggacggggccacaggcctgtgcctgccagggcgacacatggatatgctgacagcggctgacaggctcccaactcaggcccccctgagcacctcccagagcgttagcgggaaaaacatgaccgccagccaaggaccctgtgctcttttatggaagggcggagacagccctggacagcaggaacccgggagccctaaagccaaagccccacagaagtcacagaaaacacttggatgtgcggacaagggcgaggctcatcgccggccaaggaccggggaacaggggcaccggagcaaggggcctcgcactagcgaggcctctggcaggtctcaccccgcccaggctagggagatcggcgacaagcaggaacgaaaatataaccagttacagctggaaaaaggccagactcctcctgagtctcactttcagcggaagatctcccatcacccccagggactacacccccgaaaggggggtacccgctgggaagatgttttacaaaagggcaagcctggtgcagatgcgtttcagtcatggggctcgggccctccccggcagttcatggactgcatggctgacaaggcatggaccataagtcgggtcgtcggtcaaatattggttgacaagctaggattgcagtggggacggggcccttccgaagtcaaccgacacaaaggcgatttccgcgcccaggaaaatgtgccttcctgttgtcatcgcggtcattgtcaccaagagagatcgagagagatgcgggcactcgcttgtagcccaaaggctacgcctaagggccatcactgccccgtaaagaatagagggattagggacagggacagctcttgggcacctccaccaagggagcccgtgtcccccgccggccctcaccatcaccggcccagaatggccagcacatctggcggaccacacccgcagctccaggagctgatgagtgctcaacggtgtctggctagttag

SEQ ID NO: 25477 - DNA, 1761 bp, Artificial Sequence
  Description of Artificial Sequence: Synthetic coding sequence
atggaggtgggcggttgcaccttcatacacccagacgtccagaagctgcttgagacactcatcgccaagagggcacttatgaagatgtggcaggagaaggaacggaagagagctgatcaccctcacatgacatccctgggcaaggaatgggacatcacaacgctgaaccctttttggaacgtctctacacagccccagcagctccccaggcctcagcaagtgagcgacgctacgacagtggggaaccatctgcagcagaagcggagccagctgttctgggacctgccatccttgaattcagaaagtctggctactacagtgtgggtctctcgaaatccaagtagccaaaatgctcactccgtccctctggataaagcgtcaacatcactgcctggggagccggaggtggaggctagtagccagctctcacaggcgcccccacagccccaccatatggcacagccccagcacttcacccccgcgtggcctcagtcacagccccctcctttggccgaaatccagactcaggcacacttatccccacccgtcccatccctgggatgctcaagccctcctcagatccgcgggtgtggcgcatcctacccaaccagccaagaacgaacccagagtgttattccaaccgggaaggagtacttggagtggccactcaagaagcgcccaaagtggaagcgcgttttgccgtccctcttaaaaaagagccaagctgtgctttctcaacccacagcccacttgccccaggaaaggcccgcctcttggagccccaaaagcgcccctatcctgcccggggtggtgactagccctgagttacccgaacattggtggcagggccgtaacgcgatccatcaggagcagtcctgcggcccccccagtaggttacaggcttccggcgacctcctgcagcctgatggcgaatttccaggtcgcccgcaatcccaggcagaagacacccagcaggcactgttgccaagccagccatccgattttgcaggcaaaggccgtaaggacgtgcaaaagaccgggtttaggtcttcaggcagattctccgataaaggctgtctcggcagcaaactgggtccagacccaagtagagatcaagggtccggccgaacctccgtaaaagcgctggatgaagacaaagaggctgagggcgatctgaggagaagttggaaatatcagtccgtaagcagtactcctcgggaccctgataaggagcatctggaaaataagctgcagattcacctggcaagaaaggtaggcgagatcaaggagggctggatcccaatgcccgtgcgaagaagttggctcatggccaaatgcgctgtcccaaaaagtgatactcacagaaaaccggggaaactggccagctggagaggaggaaaggcccatgtgaacaccagtcaagagctatctttcctccatccatgcacccagcagatactggaagtccacttagttcgtttctgcgtcagacactcatggggcacagaccttcaatcactggagcccatcaatgtgtggtcaggcgaggcccaggctccgcccttcccacagtctacttttactccatgggcatcatgggtgtcaagagtggagtccgtgccgaaagtgcctatattccttggaaaaaggccgcaaaatgggcccggggacaatcgaaccacctctaagtccgtccccaccgtcagtgggccactcgctgctacgggcgtcacagcaacaaagaacgtagcagagagatag

SEQ ID NO: 25478 - DNA, 1029 bp, Artificial Sequence
  Description of Artificial Sequence: Synthetic coding sequence
atggcttgtgaacctcaggtggatcccggggcaacaggcccccttcctccctcaagtccgggctggagtgcactgcccggaggcagtcctccggggtggggacaagagctgcacaatgggcaagtgctcactgtactccgaattgacaatacctgtgcaccaatcagctttgacctcggggctgctgaagaacagctccaaacctggggaattcaggtaccagctgaccagtatcgctctctggcagagagcgcgctcctggagccccaggtgaggaggtacatcatctataatagtcgccccatgcggttagccttcgccgttgtcttctacgttgttgtatgggccaacatttattccactagccagatgtttgcactcgggaaccactgggcgggtatgctgctggtcacactggccgcggtgtctttaactctgaccctggtgctggtgttcgagcgtcaccaaaagaaggctaacaccaacactgacctgaggctggctgctgcaaacggggcgctgttgcggcacagggtccttttgggggtcaccgacaccgtagaggggtgccagagtgtgatacagctgtggttcgtctattttgacctcgagaactgtgtccagttcttgagcgatcacgtccaagaaatgaaaacctcccaggagtcattactgaggagccggctctcccagctctgtgtggtgatggagactggcgtgagtcccgcgacggctgaaggcccagagaatctggaggatgctccactcttgccgggcaactcatgccccaacgaacgcccactgatgcaaaccgaactgcaccagttagtgcctgaagcagagcccgaagaaatggcccgccagctgcttgctgtgtttggcggttattacatccgcctgctcgtcacatctcagctgccccaggcaatgggaaccagacacacaaacagtcccaggatcccctgtccttgccagctgatcgaagcctacatcctgggcaccggctgttgtccattcttggctcgatag

SEQ ID NO: 25479 - DNA, 1032 bp, Artificial Sequence
  Description of Artificial Sequence: Synthetic coding sequence
atggcctgtgaaccccaagtcgacccgggcgccacagggccactgcctccaagctcacctggttggtccgccctgcctggcgggtcacccccaggttgggggcaagagctccataatgggcaggtgctaacagtcctccgaatcgataatacctgcgcgccaatctcattcgatctgggagctgcagaggagcagctccaaacatgggggatccaacaagtcccagcggatcaatatcggtccttggcagagtctgctctcctcgagccccaggtgcggcggtatatcatctataactccagaccaatgagattggccttcgccgtggtcttctacgtggtcgtatgggcaaatatttactcaacctcacagatgttcgctctagggaaccactgggcagggatgctacttgtgaccctcgctgccgtgagcttgacacttaccctggtgttggtattcgaaaggcaccagaagaaagctaacacaaataccgatctgcggctggccgcagctaatggtgctcttttacgtcaccgcgtgctccttggagtgactgacacagtcgagggttgccaaagcgttattcagctctggtttgtttatttcgacctagaaaattgtgttcagttcctgtccgatcacgttcaggagatgaaaaccagccaagaatccctcctgcggagtcggctgagtcagctttgcgtcgtcatggaaaccggggtcagtcctgcaactgcagaggggccagaaaatttggaagatgccccgctgctgcccggaaattcctgcccaaatgaaaggcccttgatgcaaacagagctgcaccagctcgtcccagaagcagagcccgaggagatggcgcgacagctgctggctgtgtttggcggatattatatcaggttactggtgacctctcagttaccacaggccatgggcacgcggcatactaacagtcccagaataccatgtccttgtcaattaattgaggcatatattcttggcacgggatgttgcccttttctcgccaggtag

SEQ ID NO: 25480 - DNA, 2136 bp, Artificial Sequence
  Description of Artificial Sequence: Synthetic coding sequence
atggccagatcaagaagccgaagcccccggtggaaacatcggtcattgagtccggtgccacgcaacgctgaacactacaagcagagacattcgcatggccactacgggtgtgagtaccgtaaggaccctaaacgacctgtggcttggagaatggactcagaaaagcatggtcagagcaaacccaggattccgtcacgcggtaacatctactaccagtcatacgagcacagaagtcccagcccgaatatccgcaacagtctggagaatgtgtatatgtataagccccacagaggctattcaccaggacgcggggacagcaatcggagggctcagtacatgcctaaatactctgagggaattccatacaaggagcacgaacgcaactcttacccccaaaaggtgcagggcggtcacagccccgacgaccatcgagtgcgcgggtccggtaaaggaggcaagccacctcaaaggagcattgccgacagctttagatttgaaggcaagtggcacgaagatgagttgaggcaccagcgcattcaggaggaaaagtactctcagtccactcggagaggctccgaggacttcgaaacacgttctagttttcagaagcggtaccccgaggatcgggatttccgaaagtatgggcacaccagcaaaagaccaaaagacgtggagcggtatgaatctcgtgagccagctcgaaaccccaaatggaagcccgaacatagcctgcctccctatcaggaggacactgaccaatggaacctcggtcctcagacctaccgccacgccgaacgggaacatcccgagacttcatcagccacaaaggtctcttatgattacagacacaagaggcccaagctcctcgatggcgatcaggacttctccgacgggcgaacccagaaatattgcaaagaggaagaccgcaaatattcttttcaaaagggccctctcaatcgtgaattggattgctttaataccggacgcggccgggaaacacaggatggtcaagtaaaggaaccattcaagccctctaagaaagacagcatcgcatgcacatattcaaacaagaacgacgtcgacttgcgctcctccaatgataaatggaaggaaaagattaagaaggagggggattgtagaaaggaatcaaattcatcctctaaccaacttgataaatcacaaaagctgccggacgtgaagccatcacccattaatctgcgtaaaaaaagcctgaccgtcaaggtagatgtcaagaagacggtggacacctttcgcgtagcttcatcctactccacagagaggcagatgtctcatgatctggtagccgtgggtaggaagagcgaaaacttccatccagtatttgaacatttggactcaacgcagaacacagagaacaaaccaaccggggagttcgcacaggagatcatcaccatcatacaccaggtgaaggccaattatttcccaagccccggtattaccctgcatgaacggttctccaccatgcaggacattcataaggccgacgtcaacgaaatccccctaaattcggatcctgagattcaccgtcggatagacatgtcccttgcagagctgcagtctaagcaggcagtgatatacgagagcgagcagacccttatcaagatcattgaccccaatgatttgcgacatgatatcgaacgccggagaaaggagcgcctacagaacgaggatgagcatatcttccacattgcaagcgcggccgagagagatgaccaaaattctagcttttctaaggtcaagaacgtccataccgacggttttcagaagcctactcatttcattaagagtaacttccggaagtgcatcgagaaaccatacatgaactataccactcaacgcaaggatattatcacacataaaccctttgaagtggagggaaatcaccgaaacaccagagttcggccatttaagagtaactttagaggcggtcgctgccagcccaattataaaagtgggctggtgcagaagagcctctacatccaagcgaaatatcagcgcctccgattcaccggcccacgcggttttataacccacaaattccgggagcggctgatgcgaaagaaaaaggagtacacagatgttgcgactgggatttag

SEQ ID NO: 25481 - DNA, 1509 bp, Artificial Sequence
  Description of Artificial Sequence: Synthetic coding sequence
atggccattcacctcgataaacagaacattattctgaagaatgacaaagatgagtacctcaagaagaccagagacggcgtcttgccaccttatcaagacgctaagccaccatccccggcaagcattaagaaaacctatacgacctccaaattcaatgatgcagagcctgctaaaggtaacctgttcattggcgtcgaggtgttgccggagaacctccatctggacgaatccgagacaagcgaggaagaccatgggagcctggaaaaagagaagtatgaacagtttttgagcctagaggaggggaccaaggcacattacttctttgaaaaagtggttaatgctgctcagacatggtttagtttgttcggctggccagaaggcccccactccttcagcatcccagaaactatccgtagagatgtctataagatgcaattctactctagtacgtcaccacctcagaaattctcccggcagaatgatttttctaagtataataagaccatttacgatgtccttctgcacctgtcaggcaagatgcccccaggaatcaacagcagccagagtctcccagtcgataatcacgagaagagggtaattcaactgcatctacagcactcttccctactggacttcctgaatgctcagggcggctgtataagtcacgtgctacctgagtttctactcgaacccgaagactataaacgctggattgagattatgtctagtaccaatacaatgcccgtgagctcctgtactcccaaaaagaaatgcagtatcgtgattgaaatgtccaaattcgaggcctggagtaagcgggcctggacagacgtgttcttacaaatttacaaagtcctcgtcctgtcccgcgtcgtgccatattgcagcaacaatatgccccccatctgtgtccagaacacccctaaggttaacccatgctttgcctcttcaaacatatacagcgattccgagcgtatcttgctgagttggatgaatatcaactacgaaaatacaagacacgttatatggaagaattgtcataaagacgttattccttcagagcgatggatcgttaactttgacaaggatctgagcgatggcctcgtgttcgccacacagctgggtgcttactgtccgttcttgatcgagagtcatttcataaacatgtacacacgacctaaatcacccgaagagtatctgcataactgccttatcattgtcaataccttgtatgaaatcgactttgacgtcgagatccaggtgtgcttacgggtcttccctaaagagatggacgctggagtgtctggtttgcgaaaagaagatatgcctagcgtttgggttgtgaccatccggctggctgtggctgtcgcccggacaaagcggcagaagaaaggagatatacagtttgcctgctttttcgtctgtctgttcttctttatctttgttgttatcagcttttctctttggagtcgcatgcacttttttctgttactccccttggatatctag

SEQ ID NO: 25482 - DNA, 1509 bp, Artificial Sequence
  Description of Artificial Sequence: Synthetic coding sequence
atggctattcatctcgacaagcaaaacatcatcctgaagaatgacaaagatgagtacctcaaaaaaactagagacggcgtgttgccaccataccaggacgcaaagccaccttcccccgcctctattaagaaaacatacaccacctcaaaatttaatgatgcggaaccagctaaaggaaacctttttattggtgtagaagtgctcccagagaatctccatctcgatgagagcgaaacaagtgaggaagatcacggaagcctggaaaaagagaagtatgagcagtttctctccttagaggagggtaccaaggcacattactttttcgagaaggtcgtaaacgcagctcagacatggtttagcctgtttggctggcccgaagggccgcacagcttttctattccagaaactatcaggcgcgacgtctacaagatgcagttttatagttccaccagcccccctcaaaaattttctcgccaaaacgatttcagtaagtacaataagactatctacgacgttctgttacacctgtctggaaaaatgcccccaggcattaattcctcacagtctttgcccgtggacaaccacgagaaaagggtgattcagctgcacctgcagcatagctctctgctggactttctcaatgcacagggcggctgtataagtcacgtgctacccgagttcctcctggagcccgaggactacaaaagatggatcgagatcatgagttctactaacacgatgccagtgagcagttgcacacctaaaaagaagtgctctatcgtcatcgagatgagtaaatttgaggcttggtctaaaagggcatggaccgatgtgtttctccagatctataaggtcctcgtactgagtcgcgtggtcccatactgtagcaataacatgcctcctatttgcgtacaaaacacaccgaaagtgaacccctgttttgcctcatcaaatatatactcagacagtgagcggattctgctgagctggatgaacatcaattatgagaacactcgacacgtgatctggaagaactgccacaaggatgttattccttccgagcgatggattgttaatttcgataaagacctctccgacggactggtgttcgctacacaactgggtgcctactgcccgttcctcatagaaagccactttattaacatgtacacaagaccaaagtcccctgaagaatatctgcacaactgcctgattattgtcaacactctgtatgagatagacttcgatgtggagatccaggtctgcctccgggtgttcccgaaggaaatggacgctggagtttccggcctacggaaagaagatatgccatccgtatgggtcgtcactatcaggctcgcagtagctgtcgcccgcaccaaacgccagaaaaaaggagatattcagtttgcctgtttttttgtatgcttgttcttttttattttcgtggtgattagcttctctctgtggagccgcatgcatttctttctgcttctgccccttgatatatag

SEQ ID NO: 25483 - DNA, 471 bp, Artificial Sequence
  Description of Artificial Sequence: Synthetic coding sequence
atgctcttaaactatatccctgtgtgctacaaaatcctgcatctcacgggtgaagttaagagtcccgagctgctgttcgatccgccattcatcttctttacgcctgtgcccctggacattactacggtcatggacattaatattctaccgcaaaattattttcgaaattcaaccctgtgtgtgcaaatccccacagttcggcttctcgacggagaggagattcatcctttgagcgtcaaattcccgaaaggacgcgtgattcctggatcccatagcggcatcaataataaactgacctgtcacctctcgttcaagagtagtaaaccagtctccttcttcaccaacctgctgttttgtgacgatcggaagaactggtgtttccactttcagctgctgcagcagcagaagactgcttttctacttttcacacacatttggcagttcatatggatctcaaagacccttttctag

SEQ ID NO: 25484 - DNA, 462 bp, Artificial Sequence
  Description of Artificial Sequence: Synthetic coding sequence
atgcttctgaattatatccctgtgtgttacaagattctgcatctaaccggggaggtgaagtcaccggaactcttgttcgaccccccctttatctttttcacacccgtgcccctggacattaccaccgtgatggacatcaatatacttcctcaaaattatttccgcaactcaactctgtgtgtccagattcccacagtcagactgttggacggcgaggaaatccaccctctcagtgttaaattccccaagggccgggtgatcccaggctctcactccggtattaacaataagctcacatgccacctttcctttaaatccagcaaaccagtgagtttcttcacaaatctgctgttctgcgatgatcgaaaaaattggtgctttcatttccagctgcttcagcagcaaaaaactgcttttttgctttttactcacatctggcagttcatctggattagcaagtag

SEQ ID NO: 25485 - DNA, 1086 bp, Artificial Sequence
  Description of Artificial Sequence: Synthetic coding sequence
atgaatctagttatttgcgttttactgttatccatctggaagaacaactgtatgactacaaatcagaccaacggtagtagcaccaccggtgacaaacccgtcgaaagtatgcaaacaaagctaaattacctgcggcggaacctgttaattcttgtgggtattattattatggttttcgtgttcatctgcttttgctatctgcactataactgcctgtccgacgatgcatctaaagctggaatggttaagaagaaagggatcgccgcaaaatcatcaaagaccagcttcagtgaggctaaaaccgcttcacagtgtagccccgagactcagccaatgctgtcaacagctgataaaagcagcgactcttcctcacctgagcgggcaagcgcacagagttctaccgaaaagctgatccggcccagcagcctgcagaaacccagtatcccaaacagcgccggaaaactgacaagaccatcttacccaaaacgttccagtaaatctagttgcagcaaaaagttaagcaagtcctcccacttggaaaaagcccataagaagggaagtctcgagaaactgtgtaaactcgattacgcctgcaaactggcctctagcgacaagcctgtaaggccaccccaacttttcaagcccctgtatagtagccaccctcagaatgaaatcagccccagcaaaccctttggccctcaagagctggctaagcctccaaaacactttaacccgaaacgctccgtctctctgggcagggccgcactcctttctaactccgagctggctgagacctgccagccctataaaaagaaacatctggtggctaaaacctacaggcccctagtaaacgatatcagcgaagccaaggagaagaatacccaaaacctgcacgtcagcagtaaggtcaagagctcctccaggtctttcagaaaactggattcacggaacaatgcctacggcgatcacgttaatgactccgatacaatgaagtattattcagaagtggatagcgataaagtcattattatcacctgcgatcgagggtacaaccaggtgacatccgaggttaccctaaatgattag

SEQ ID NO: 25486 - DNA, 300 bp, Artificial Sequence
  Description of Artificial Sequence: Synthetic coding sequence
atggaaccgcagaaactcctgatcatcgggtttctgctctgctcccttacctgcctgctcctggaaaccgtggcctcttcaccgctgccgctgtccgccctgggaatacaagagaagacaggatcaaaaccgcggtcaggcgggaaccaccgctcttggctgaacaatttccgggattacctgtggcagctcatcaaatccgctcttcctcctgcggctatcgtggcatttcttctcacgtctgccctgatgggcatcctgtgttgctttaccattctggtggtggatcctgtacactag

SEQ ID NO: 25487 - DNA, 6054 bp, Artificial Sequence
  Description of Artificial Sequence: Synthetic coding sequence
atgtctctaggtttggcgcgtgctcaggaggtggaactgaccctggagactgtcatccagaccctcgaaagcagtgttctatgccaggagaaggggttaggggctcgcgacctggctcaggacgcccagataacttcccttcctgccttgattagggagatcgtgacacggaatctgtctcagcctgaatctcccgttctcttacctgcgacagaaatggcctcacttctcagcttgcaagaagaaaaccaattgctgcagcaagaactctctcgggtggaggacctgttagcccaatcaagagccgaaagagacgagcttgcgataaagtacaacgctgtgagtgaaaggttagagcaagcacttcggctggagcctggcgaactggagacgcaggaaccccgcgggctcgtcagacagagtgttgaactccgccgccagcttcaagaggaacaggcatcctatcggcgcaaactgcaggcctatcaggagggacagcagaggcaagcccagctagtccagcgacttcagggtaagattctacagtataaaaagaggtgctccgagctggagcagcagctgctggaacggtctggcgagttggaacagcagcggctgagggataccgagcactctcaggacttggagtcggctctgatcaggttagaagaagaacagcagaggtccgcatcccttgcccaggttaacgccatgttgcgcgagcagctcgatcaggccgggagtgcaaaccaggctctgagtgaggatataaggaaagttacaaacgattggactcgctgcagaaaggaactagagcaccgtgaagctgcctggagacgtgaggaggagtcctttaatgcctacttctcaaacgagcactcgcgattattgctgctctggaggcaagtggttgggtttcggcgcctagtgtcggaagtgaaaatgttcacagaacgtgacctcctccagctgggcggcgaacttgcgaggacatcacgtgcagtgcaggaggccggcctgggcctgtccacagggcttcgccttgcagaatcaagagccgaggccgccctagaaaagcaggctctgctgcaggctcagttagaagaacagctaagggataaggtgctcagggagaaagacctggcgcaacagcagatgcagtccgacctcgataaggcagacctgtccgccagggtcacagaactcggcctggcagtcaagcgactggagaaacagaacctggagaaggaccaggtgaataaagacttgactgaaaaattagaggcgctagaaagcttgaggcttcaggaacaggccgccctagagaccgaagatggggagggcttacagcaaactctcagagatttggcacaagctgtcttgagtgattccgaatctggagtccagctgtcagggtccgaacgaacggccgacgcctcaaacggcagtcttaggggtctgagtggccagaggaccccatccccgcctcgccgctcctctccaggaagaggcagaagccccaggcggggcccaagcccagcatgttctgatagtagcacattggcacttatacacagtgccctccataagagacagctccaagtacaagacatgcgcggtcgatatgaagcctctcaggatctactgggaaccctgcgcaaacaattgtctgacagtgaatccgaacgcagggccttagaggagcagcttcagaggctgcgagataaaaccgatggggctatgcaggctcacgaggacgcccaaagggaagtccagaggctccggtccgctaacgaactcttgagtcgagaaaagtctaacctggcgcatagtctacaggtggcccagcagcaggctgaagagttacggcaagagagggagaagctccaagccgcgcaggaagaactgagacgacagcgggacaggcttgaagaggaacaagaggatgcagtccaggatggcgccagagtgagacgtgagctggagcgaagccaccggcagctggagcagctggaggggaaacggagcgtgcttgccaaggagctggtggaagtaagagaggccctctcccgggccacgcttcaaagagacatgctccaggccgagaaggccgaggtcgctgaagctctaaccaaggcagaggcaggcagagtagagctagaattgtcaatgaccaaactgcgggcagaagaagcttccttgcaggactctttaagtaagttgtccgccctgaatgaatcacttgctcaagacaaactagatctcaaccggctggtggctcagctagaggaggagaagtccgccttacagggccgacaaaggcaggccgagcaggaggctacagtggctagagaggagcaggagcgcctcgaagaacttcgcctggagcaggaagtcgcgaggcagggcttggaggggtcacttcgcgtggccgagcaggcacaggaggctctcgaacaacagctgcccacattacggcatgagaggtcccagctgcaggaacaactcgcacagttaagtagacaactgtccgggagagaacaagaattggaacaggctcgccgcgaggcacagcggcaggtggaagctctcgagagagcggcccgcgaaaaagaggctctggcaaaggagcatgcaggattggccgtccaacttgtcgctgccgagcgcgagggtcgcaccttatccgaggaagccacaagactgcggttggagaaggaagctctggaggggagcctttttgaggtgcagagacagctcgcacagttggaggccaggcgtgagcagctggaggcagaaggacaagcactgctgcttgctaaggagaccctgaccggcgagctggccgggttgagacaacagatcatcgcgactcaagaaaaggcttccttggacaaggagttaatggcacaaaaactcgtgcaagccgagcgggaagctcaggcctcactgcgggagcagcgcgctgcacacgaggaggatttgcagagacttcagagggaaaaagaggcagcctggcgtgagttggaagcggagagagctcagctgcagtctcagcttcagcgagagcaggaggaactgctcgctcggctggaggccgagaaagaagaattgagcgaagagatcgcagcacttcagcaggaacgtgatgaaggtttactcctcgccgaaagtgagaaacagcaggctctgagcctgaaagagagcgaaaagacagccctgtcagagaagctgatgggtactcgccactctctggcaaccatctccctggaaatggagcgacagaagagggacgcccagagccgccaagaacaggaccggagtacagtgaacgcactcaccagtgaacttagggacctgcgcgctcagcgagaggaggctgcagccgcacacgctcaagaggttcggcgcctccaggaacaggcccgcgacctcgggaaacagagggactcttgtttgcgagaggccgaagagctaagaacacagcttagactgctcgaggacgcccgcgacggtctgagaagggaacttctagaagcacaacgtaagcttagggagagtcaggaaggcagggaagtacagcggcaggaggcgggagaactcagacgttccttaggggaaggcgctaaggagagggaagcactccgcagatcaaatgaagagctgagatctgccgttaagaaggccgaaagcgagcgtatatcattgaaactggccaatgaagataaagagcagaagctggcactgctcgaggaggccaggacagctgtgggcaaggaggcaggcgagctgaggactggccttcaagaggtggagagatctcggctcgaggccaggcgggaactgcaggaacttcgccggcaaatgaagatgcttgattccgaaaacacaagattgggcagagagctggccgaactgcaaggtcgcttggccctgggtgaaagagcggagaaggagagtcgacgagaaactctggggctgagacagagactactgaaaggcgaggctagcctcgaagttatgaggcaggaactgcaggtggcccaacggaaactgcaagagcaggagggagagtttcgtacacgcgagaggagactgctgggcagcctcgaagaggcccgcggcacagagaaacaacagctggatcacgctcgtggactcgagctgaagctggaggcagccagggctgaagcagcggaacttggcctgcgactttcagcagcagaaggtagagcgcagggactcgaggccgagctggccagagtcgaggtgcagcgacgcgctgctgaggcgcagctgggcggactcaggtctgctttgagaaggggcctaggcttgggcagggcaccgagcccggcgccaaggccagtcccaggatcgccagccagagatgcaccagccgagggctcaggtgagggactaaatagtccgtcaaccctggaatgtagccctggatcccaacccccaagcccagggcccgccaccagtcccgctagtccagatctcgatcctgaagccgtgcgcggcgcgctgcgcgaattcctgcaggagctgcggtcagcgcagcgagaacgggatgagctacgaactcagacctccgccctgaacagacagcttgccgagatggaagccgaaagggacagcgccacatccagggcacgacaattgcagaaggcagtggccgagagtgaagaagcaaggagatccgtggatgggcggttaagtggggtacaggcggagctcgccctgcaggaagaatccgtcagacgctcagaacgcgaacgcagggctacactggaccaggtcgccactctagagcggtcgctccaggccaccgagagtgaactacgcgcctctcaggagaagatctcaaagatgaaagccaatgagacaaagttggagggagataagagacgcttgaaggaagtactggacgctagcgagtcacggactgttaaactggaactccagcggaggagcctcgagggagaactccaacgaagcaggctgggcttgagcgaccgggaagctcaagcccaggcactgcaggatagagtcgatagtctgcagcgacaggtggcagatagtgaagtcaaggccggcaccctgcaactgacagtcgagcgactgaacggggccctggcgaaggttgaggagtcagagggcgcactccgggataaagtccggggcctgactgaggcactggcgcagtcttctgcctccctgaattccacccgcgacaaaaatttacatctgcagaaggctcttaccgcctgtgagcatgatcgccaggtgttgcaggagcgacttgatgccgctcggcaagccctgtctgaggcaagaaagcagtctagtagcctgggtgaacaggttcagactttgagaggggaggtcgctgacctggagctgcagcgggttgaagccgaaggccaattgcagcagttgagagaagtccttagacagagacaggagggcgaagccgcagcactgaatacagtgcaaaagctgcaggacgagcggcgtctcctccaagaacggctgggttccctccagagggccctggcccaacttgaagctgaaaaaagggaagtggagcgctccgccctgaggctcgaaaaagatcgtgtcgcattgcgacgcacactggacaaagtggagcgcgagaagttacgctcccacgaagacacagtgcgtctgtccgcagaaaaggggcggcttgaccgaaccctcacaggcgcagagctggaactcgcagaagcccaaagacaaatccagcagttggaggcccaggtggtggttctggagcagtcacactcaccagcccagcttgaagtggacgctcagcagcaacagctggagttgcagcaggaggtcgagcgcctgcgctctgctcaggcacagaccgaacggactctggaggctagggaaagggcccatagacagcgcgtgcggggtctagaagaacaagtgtccactcttaaaggtcaattgcagcaagagctgaggcggagcagcgcccccttcagcccgcctagcggcccgccggagaaatag

SEQ ID NO: 25488 - DNA, 5697 bp, Artificial Sequence
  Description of Artificial Sequence: Synthetic coding sequence
gaaaagggcctgggtgcacgggatctggcacaggatgctcagatcaccagcctgccagcattgatccgggagatcgttaccaggaacctttctcaaccggagtctccagtgctgcttcctgctacggagatggcctctctgttgtctctgcaggaggagaaccagctactgcagcaagagctgtctagggtggaagatctgttggcccagagccgcgccgaacgggacgagctcgcgatcaagtacaacgctgtctctgagcgagacacagagcatagccaggacctggagagtgccttgatccggctggaggaggaacagcagcgttctgcgtccttagctcaagtgaatgcaatgctgagagagcagctggatcaggctgggtcagcaaatcaggcgctgtcagaagatatccgtaaggtcaccaacgattggacaaggtgccggaaagagctagagcatcgtgaggccgcctggagacgcgaagaggaatcctttaatgcatacttttccaacgagcactcccggctgttactactgtggcggcaggtggtgggatttaggcgcctggtctcagaggtcaaaatgttcaccgaaagggatttactgcaacttggaggcgaactcgcacggacaagccgtgccgtgcaggaagccggccttggcctgtcaaccgggctaaggttggccgaatctagagcggaagcagcactggagaaacaggccttgctccaggcccaattggaggagcagttgagggacaaggtcttgagggagaaggaccttgcacagcagcagatgcagagcgatctggataaagcagacctctctgcgcgggtcacagagttgggactggctgttaagcggcttgagaagcagaacctcgagaaagatcaggttaacaaagatttaacagagaagctcgaggctctcgagtccctgcgcctgcaggagcaggccgcacttgagacagaggatggcgagggcctgcagcagaccttaagagacttggcacaggccgtgttgagcgacagcgagtcaggagtgcagctctctggtagtgagcgcaccgcggacgctagcaacggaagtctacggggcctgagcggacagcgaacaccttcccctccaaggagaagcagcccagggcggggccgaagcccgcgtcgcggaccctcgcctgcctgctccgatagctctacacttgctctgatacattccgcacttcataagaggcagctccaggtccaggacatgagagggagatacgaagcctcacaagatctcctaggaacactccgcaaacaactatcagactccgagtcggaacgacgggcccttgaggaacagttgcagcggctacgtgacaaaacagatggcgccatgcaggcgcatgaggatgcccaacgagaggtgcagaggctgagatctgctaacgaactgctatctcgggagaagagtaacctggctcactccttgcaggtggctcagcaacaggctgaggagcttcgtcaagaacgagagaaacttcaagctgcacaggaagagctgagacgccagcgcgataggctagaggaggagcaggaagacgctgtgcaggatggggcgcgggtccgccgggagcttgagagaagtcatcggcagctcgagcagctggagggtaagcggagcgtgctcgcaaaagaactggtggaggtgagggaggcactcagtagggccaccctccagagagacatgctgcaggctgagaaagctgaagtggccgaggctcttaccaaagccgaggctggccgcgtggagctggaacttagcatgacaaagttgcgcgccgaagaagcttcattgcaggactccttatcaaagctcagcgcgctcaacgagtccttagcccaagataagctggatctcaatcgtctggtcgcacaacttgaggaggagaagagcgcccttcagggccgccaacgccaagctgaacaagaggccactgtcgctagagaggagcaagagaggctggaggaactcagattggaacaggaggtcgcccgccagggattggaaggatctctgagggtcgccgagcaggcgcaagaggccctcgagcaacaactccctacgctgaggcatgagaggtcccaactacaggagcaactggcacaattgagccgacaactctctggacgcgagcaggaactcgagcaggccaggagagaggcccagcggcaggtcgaagctctagaacgggctgcccgcgagaaggaagcccttgcaaaggagcatgcagggcttgcagtccaactggtggcggccgagagggaagggagaacgctgtctgaagaggccaccagattgaggctggagaaggaggcactcgagggctccctcttcgaggtgcaaagacagctggctcagttggaggctcggagagagcaactggaggccgaaggtcaggcactgctcctggccaaagaaacactgacaggcgagctggcgggccttaggcagcagataattgcaactcaggagaaggctagcttggataaggagttgatggcccagaagcttgtgcaggctgagagggaggcccaggcctcacttcgcgagcagagggcagctcacgaggaagacttgcagcgactgcagcgcgagaaggaggctgcttggcgggaattggaggccgagcgcgctcagttgcaatcgcagttgcagagggaacaggaagaacttctggcacggcttgaggctgagaaggaagagctgtcagaggagatagctgcattacagcaggaacgggatgaggggctgcttctcgccgaatccgagaaacaacaggcgctgtctcttaaggagtccgagaagacagctctttcagagaaactgatgggcacacggcactcacttgcaaccatttcacttgagatggagcgacagaagagagatgcccaaagcaggcaggagcaggatcgctcaacagtaaatgcactcacctcggagttacgtgatttgagagcgcagcgagaggaggccgcagctgcccatgcccaggaggtgagacgcctgcaggagcaagccagggacttaggcaagcagagagatagctgcctcagggaggcagaggaactgcgaacccagctcaggctcttggaggacgctcgggatggcctgcggcgagaattactggaagctcagaggaaacttagggaatcgcaggaagggagggaagtacagcggcaagaagcaggcgaactgaggcggtcactgggtgaaggagccaaagagagagaagccttgcggcgttcgaatgaagagctgagatccgccgtgaagaaggccgagagcgaaaggatctcactaaagttagcgaacgaagataaggagcagaaactggcactgttggaagaggctaggacagctgttggcaaagaagccggcgagctacgaaccggactgcaggaagttgagcgctctcgcctcgaagctaggcgcgaactgcaggagcttcgccgccagatgaagatgctggatagtgagaacactcggttggggcgggaactggcggaacttcaggggcggttggcgctgggtgaacgcgcagagaaggagtccagacgggagacccttggcctgcggcagaggctgctgaaaggcgaggcctctctcgaggttatgcgccaagaactgcaggtggctcaaagaaagctccaagagcaagaaggagagttccggaccagagagaggaggctattaggctcattagaggaagcgagggggactgagaagcagcaactggaccacgcccggggcctggagctcaaactcgaggccgcaagagccgaagcagccgagctggggctccgcttaagtgcagctgaaggcagggcccagggtcttgaagccgagctcgctagggtggaggttcaacgccgggctgccgaggctcagctggggggactgaggagtgccctcagaagaggtctgggtcttggtagggcgccctcgcctgcaccacgacccgtcccaggttctccggcaagggacgcgcccgcagagggcagcggggaggggctgaactccccatccaccctcgagtgctccccaggtagtcagccaccttccccagggccagcaacttcccctgcttcacccgatctggaccctgaagccgtgaggggcgccctgcgcgaatttttgcaagagctgcggtcagctcaacgggaacgagacgaactcaggacccaaacctcagccctgaatagacaactggcagaaatggaagctgaaagggattccgctaccagcagagcacgtcagctgcagaaggctgtcgcagagagtgaagaggcaagaagaagtgttgacggcaggctctctggggttcaagcagagctggcgctgcaagaagagtctgttagacgcagcgagcgtgagcggcgcgccaccctggatcaggtggccacattagagcgctcactccaggccactgagagcgaactacgcgccagccaagagaagatcagcaagatgaaagctaacgagaccaagctcgagggtgataaacgtaggctgaaagaggtcctggacgcctccgagagtaggaccgtgaaactcgagttgcaaaggagatctctagaaggagaactgcagcggagccgcctcgggttatctgatcgagaagctcaggcccaggcattgcaggacagagttgatagcctgcagaggcaggtggccgacagtgaggtcaaggccgggacactgcagctcactgtggagagactcaacggtgccttagctaaggttgaggagtcagagggagcgctccgtgataaagtgaggggcctcaccgaagcacttgcacagtcaagtgcaagtctgaactctacacgtgacaaaaacttgcaccttcaaaaagccctgacagcgtgcgagcatgatcgccaggtgttacaggagaggttagatgcagcacgccaagctctgtcagaggccagaaaacaatccagcagcctgggcgagcaggtccaaacactccgtggagaggtagcagacctggagcttcagagggtcgaagccgaagggcagttgcagcaactgcgcgaagtcttgcggcaacgacaagagggggaggccgccgcgctcaacacagtgcaaaagctccaggatgagaggaggctcctgcaggaacgcctagggagcctacaaagggcccttgcccagctcgaagccgaaaagcgcgaggtggagaggagtgctctccggctggagaaggatagggttgccctacgacggacattggacaaggtggaacgggagaaactgaggtcccacgaagacacagtgcgtctttccgcggagaagggacggttggatagaacgcttactggcgccgagttggagctggcagaggcccagcggcagatccagcagctagaggcacaagttgtggtgctagaacagtcccattcaccagcgcaacttgaagtcgatgcacagcaacagcagctcgagctccaacaggaggtagagcgtttaagatctgcccaagctcaaactgagcgcactttagaggcccgggaacgggcccaccgccagagggtgagaggcttggaggagcaggtgagcaccctgaaaggacagctgcaacaggaattgagacggagctctgccccatttagccccccatcgggacctcctgagaaatag
